United States Patent 6,812,339 (POLYMORPHISMS IN KNOWN GENES ASSOCIATED WITH HUMAN DISEASE, METHODS OF DETECTION AND USES THEREOF) - sequence listing, part 67

SEQ ID NO: 16336 - DNA, 94847 bp, Human
tctccaaacctcttttcccagagccccaaatacattgtgtacattttctgcatttgaagatatcagggaaaagttttaccaaatattttgttactgtttaacataacttgccatttttctaacttcttctaacagattcctcactattgcctgcccatccttgaagccaatgtgtttctcaggattttgttttatgcaccctagctcagattttgctattctgtcaaacaactgcaatctcttagggcttacaataacagatatttatttcttgcccatgctgcttaggcactatgggtcagctgtggctctggttggttctgaggggctcagctaaccgtcaaacattttcttattttctgggatccaggctaaagggacatgttcttattttggaaagcaaggactgctataaaggcaaaacatgcaaacacattttaaacatactcttggacatggcctacactgcattgacttacattccattggcaaaaggcagtcacatgtccaaacctaaagtcaatggatgggggctatactttgcctacagagaaatatgacaagtatgagtaggggacaaataagtattaacaaaaataaaatctaccaattcaattcactcgtaagtgtatggtagaagaaagacctggtaactttattaagttcctatgaattctacattccttcccttcaacatggctctttcataatcctgattattggtattattttctgactccagtggatagttaacattctgtgggttccagctttcatttcctcctcttcttttgataattaccaactaattgagtgtctcctgaagtcattggggaagcacatagctggaatggtggaggcagaaaacccaggcaagtgaccacgaggaaagccattattagaacaagcaaaatacaagagggtggagaaggagtggcaatatgaccactttaaggagttcatgaatgaaagatagtaagttggtaggaagtgtatggcttttaattcattaaaaacatagttctagagtgagacgaatactgcggtagactttaagactttgaacaagatatttgacatctttgaactttattttcattgcctgccaaatgaagacaatagctaaaagatagtattatgtgaaaatgcatattaaattgttaagtgtcttgcttattgatacttacctgtaccataacaggtggcagcaatgttttatatatatgcaattggtaatcagcaaatgttatttatatctaaatttttatgtggtgactgtctgtgagtatcctctttacaattatgcaggagtctcataatttcatttaggtatgactaaagacaaatcaatataaaacaaaaaaggagaaacttaaaacaacgtaggtaagatctgtaaataaaatacagcttccagtttcattgtgtttccttacaaaaactatatttgaatcagttgtggactagttaaaagcaacctatttttcaaagcagacataaaaatcaaaattagggcaaataagtaaatgtgtaatattaatttaagtactgtatatattatgccattatagtggtattatatcaacttaatataattaaggaattataattttttctgcaatccttatcctaattctatagcctatgtttatgtttttttgacatgtgtcttttatcacatatttggaattatgctatcatacaggtttatatcactatttttaaactaaaaattatataataaatacttccctttgtattatggagctttcctaatcattatttaatgtatatataatagtttatcaagtgaatgacagtaatatatgcaaccgcttctcagagttggcatttagattagttttcccatattatgattactcaagtgagctaggggaaggggtcatagaatcctgagactagctgacaaagtgttgagtgacaaagagatagatggaactaagtatgttcaggattctaaaaagagcaatggttcacaaggaaacttctgcctcaggtggggagaggagtccatagatcagggaaacttatgtcttggtgaaatggaagaccatgtttctaaacacctgtcgccaggttggttcaccttgctgtggtactgttcttaatcctgcctcagtgatactgtattttttagaaacttaagggattctaacatctttctgaatctcatcattgatatcaggagatcctgtggggttttttttatttgattttttaaaatgggcattttaatataaaagtcagaaaggtattctttggccatgtaatcttcctagaagtatccaggaatttttctttaactcctcttctgtagtgccagttaatgatctaatgctttcaaattgagaaaagaaccaaaacaccagagaatctttggaaactaatgcaaaatggaggatccaaaatctcttaaatataattctgtttttttcctaagttgaaaggtgagaaaagtattattaagtggcttcccagctatgctctaaggaattctaaactttctaggaagaaccagggacaatttcaggagtcaggggatgctgataagtggaattccaggctctctatgatgcttccaaccccataaaccagagtagctggtttgcatagcaggattctgagtaagatttcattcctagaaaggattctgtggctttaaaagctttagaaggagaaaaacaaaaacaaaacgggatatacacacaatgattgttatcatcctcttttactgtagagccatatacgtaatttccctaagccatgactctgggagagaagaaaagactgcacacatggtaacatgtaaaactctcagataaatttttccctaaaggacatgaaaatcatatttaaaagtttgggctgactctccttttcaggaggggagcactgttcagcactgttcaggcttcctatgtaagggaagaaaaaaataattttctttctatattttctgagttcttagctgtgaccccagtaactaagtgcagattaacaagagaaaaacaaaaagaagtttattaaagtatgtacatcattatacttgtgagatacccagaaaaatgagtaaatctcaaggaggtggatttgaattcaggctttaataccattgtccactgataaaaagaaagaagagtgtaggaagggccagttatgtggagatgcctagaaaaagcatataaacaatgataaggtttgttacacagattaagtccatgccttctcttttggtaagtctctagttatttagttgttcttctcttcctggtgcagagagggagacaccactaaaaatagaaatttcctttatagatataaatttcccttacaaaaagggtgacttaactttcagagcttctcctgtgtctgctggttctcaaaataatcagctcaaagtaatccttatgctaaagaggcatattttggggtggcatattccggtcttctgtaaacactagataatatctataagcacggatcgatttctctttcctcaagtatgatagaaatttagctacaaggagaaaatcattagaaaaaaagataagaaaattttatatttaatatgaacagaagtacaactcacaaccaagtaaacatgtaaggaaatatatttatatttgcatactaaagttttgtatttcaacatttttgtatttgcaagtttttaatagaaacataagatttactcattatataatatttaaagatttcaaaatatataaatcatacatggtcactttccaaaggcataatttgtatagatatgtaaatatatgtacattatctcactaaaggaagaagctgaggaaaaattaatatacatagaaagtttatttggaccaagcttgcggattgcagctctggagcatcgattcagttgccccgaatatacactccaattagtggcagtctacaagtggatttttaaaagaagagggggttcttgagttgtttacaaaaaaaattacattaaaataacatcagctattgattggctatatgttgtttttgtttgtttgttttgtgtgacaaactccagaacatgaagataatggatgaagcagctagtcaagaacaaaattactttgaacaattgcctccaccatgggtggggaagaggggctgggctgactgaagtctcatactcatgtctctctgggcctgataaattttggatacctcatgttgctcagattgctctgagctagttttcttttctcaacctaagtagtctttctgtgtatacaatttaaaataattatattctgttctacatcttacttttttcatttattacacttttaacaacattttagctgtataagtgcatgtaaatctgcctattcattttatagttatatgatattaacactttttatgaatgtacaatttatacattttctaatgactttcagtttgccacagtgataaatgatgttgccctggacatcatgtgtctttgcatacctgtgcaattgtgcctacaagaaaaacatctttgtagtgcagttgcttggttaatggcttttataaatgagtcaccactactactatactagtttcctggggcagtcgtagcaaactactacaaacttggtggcttaaaacaatagaactatattcttacatttctagacatcaaggtgaagaaccacattccttaaaaaggttctatgggagactctgttccatgcctcttctagcttctggtggcagttggcattccttggcttgtggtcacatcactttctgctgggcctccatcctcacatcacatctctctctgcgtcttcctttctgtgtgtgtgtctctgaactccctctggctctttttgttataaggatacatgtgattgcatttagggcccacctgggtaatccagggtaagattctctctcaacagccttaatttatacactcttttgccatataaggtaatattacaagttctggggatccagacatggacatagctggcattcaccctattataactttttacacacaattctgccgtttgagtatatcttgtccgaaatgcttgaaaccaggtcagctgtggaatttgtcacttgtgatgtcaaataggcactcaaaaagttttggattttgaagcataatttttctgatttttggatttggggatgttcaacctgtattagaaatcaggggaattgttttgtatgggaggtgtacttccaattcttcatagataattatatactggtttatattatttttttctaacttgcccattataaagcatttttagttagtttgacccttattgccagttagcattctcaaagtcatttaaccaccgcaatagtgtagtctaaaaacaggttttgtgttactgacattttgtggtctatgagctattgatatctctcttgtctagatgtcaaagtaaattagtcaataggatttaagagatggttcactctgaagaataaaatagcctctcgggattagagtccaattttaatttaattacatgttgggaaagaaaagatttggttcaatttaatttctgttgtaaaattgggtgagttgtcacctaaacttaaacactgtacattaatttgatgttgctatatccttttgtataaaaaaagaaaatagccaaaaaaccagacaattattctttgagaacaaattaattcatttaggtgaaaacataatataatataacttataaacactttataagtaggatgtagagaaaaactcatgctttaactgtagggcttctagaggaatttatagtgaaaccaatagtctaagaactattgattattttgggacttagtttgctgagtacattatttctaaactgtattttgaaatataaacttctggatagcatggaatattggtaagacttcatagaatggaggcatgctggtttaggtttcaaaagttgaagaaagattattcacaaaataaataaaggaacattctaatattttatgtgactgaaagagtcttgaataaaatattatagtctagccatggatcatcactaatagtttcattactcctatgtgttacatatttttctccatagtttaatcaacccgtattgattctaaaagaaaaggcaaagttattgggcttcagtccatcccaccacataaattgttgaaaaacacctgaaggtcactcttgtaaacagtgatattatattggagcctatacactcaaaaacattatggacagcacaggtgtaaataagctggaaagatgatgaatttcaaaagactttgaaggatagttgtagtttttgaattccaaagataagaatataaattctgatgaacaagaccatcagaatggacatgcgcaagaactgaaatctggaaattcccagaggaataaaatcgaaggagtataattttatgcagaaaaagttagctttcatgttgtgttatagtggaatcagcaacaaaagccctaatgaaaaaaaatactagttgtggtagcaatttggtcacctactagacattatacttaaaaaagtcactttgcaattctgatcctttatgccctcatctatgaaacgtgattcaaaataccagttccttggagttcatgggattatgaaaataaattatttgtatttttagaaaaataaaaagctctaaaacattgtttatttttatgcaccctattacaagtaaagccaatcataaatcatatggcatgtgtgtgattactaaggatcaaaattagcagatgacaaagcccaacttctggctataataattaaagctacttttgtagggggaataagctttatgcctacttggacttcaggaagcagtcctctaaataatggtttttccaaattgaaggaaagccttctcactggcttaaggattgttggttttctacaggctttgtagtcagacacacaaactctaaaacactacctttttaaaaaaacttttaaaccactttaatggggtatgatttacatacaaaaagctgtctataatgtatacaacctggttagtttggagataagtgtacacccatgaaaccgtcactgcaatatatgccttaaatatatccacatccaaaagtttgctcctgccttctttattattgttacattttgaaaagaacacaacataagatctaccctcattccacatggtttaagtgtacaatacagtattgttaactacagataatatgctgtacagtagatctctaagatctattcatcttgcataattttatctttgtttctttgactaattcctctccattttcctcttctagtcacctggaaacaactatactattctctgcttctatgtttcctcatctttaatgtttccactaaaacactacctttcatttttaaaactaaagattagtaaatgcattgtataaatatatctgcataagtgtatatgaaatatatgatagttaatatatgtaaagaaaaggatgtaacatagattaatatagatataactgtcaagcagagtcttcctggattatttacccatttgttgaaaggaactctggatgtgagttagtctttctggaagaaaatgggtcaattatgttaaggtgctgtgaaatttcacagaaatgttggtgagcatatataatttggacttgtcaagatctcttttatctggtccctaagctggcctgtataaattatattaatttttttttctattttcttggagggctgccacatggagcctgtataaattatgagtgtaattaagcacatagactgaaagatcaaaacctaatttttagatatgccttaggctgtcttctgaggctttgccttgaagccagggaagttctccctgccagaggaaatagatagaaaatacatttcctcaaaatataaaggttttctacctttggatgagctggttacttgtggtgggatggagctgctgttctcgaattacccagctttaaaaagccaccgatgggtccgaagcctcctggtaggaccagagctgatgtatgagcctcttctcactgctctaatcccaggcccaggagacccatttagtgtgaactcttcattcctaccacaagttagacctttagttccatccttatgaatttctcatatccctgacttttaagcctctttactcatagtcttcctagtccccaccctccatttctcatggacttggcatgcagatcacacttgcttcatcctctcatagaaacgtcatttgacctggtggctgtgttgcctttgttcagcactttagaataggtggccctggatataaggcagacactggttatttaattcaaagtattgacattttcttagttttgatctaggcaaagaaagccttggtccaaacaaaacaaactcttaggtactaaattttatatattcagcaccatatttaaattgaaacaaagatattggatggattagagatttagcatatttttctgtcgccccgatttgattaggaagtgtgaattctaaatcagaagatctctaaaataatttttgtttccttcctaaaacccagtctgtcttattataagccatgtatattactgacagtatttctaatacttatattttaattttttattttcattgtcagtggatatttaatttatttaattgaattttagagaaaattatttaaatgagtataggtaattatttaagtgacagatagtgaatgccaataagaattttctttcttataataataggcttgtaatctactgtttttttcaacaaaacctaatttttttaatcttatactttttattttaattttttctcatgcgcatgtttggtcattttagtcatatcttagttctattattatattgacgaagatatattcaattttgctaattattaaaagatgttcaaaatttattgaggtgatttaaaggcagtggctctaattaggcttattgaattcaaatatgcatgtaacaatttgttttctatttctttagataatccaaaatctactctacatcttttcctttgtattgccttcaaatatcactcttcaaagtttagtgactaggcttaaagattccacatataatccaaagaaatctgttcaagtggacatctatcaacacgtaaaactatacttttaactctgtttttcttggctgtgcttacaagctgtgcttgttaaaagaaataagacacaacagatataaattgtatgaaaatgttacagaattgggcataggaaaaaaaggcatgaagccagagtgtgtatgacttgaatcttgacaattggtcaactcaagagtcactaatgaggaagaggtgacagtgttggaattggaatttttggaattgattggttctgggtctcttttctaatggatcagttaagagatcataagatgtcattttatatgaagaaaaacaaaataagtagtagataagaaaatgaagaagtatgtgagtggcgccttgcaccctggaacccatagttatcattcaaatcaaggaaatatgctgaaaacagaaagtaaaatttcatataaatgagaaataaattgatgaactatggaaaaacaagtaatacaaaacagaaaagattaaggagaaaaaacgcttaatcatatgttttttatttaaaggcaaggaaacttttgaaaggaatgatttgtgtagcatctgagaaaatagcttcacttttataacaaagcaggaacaatttaagtagttgacaattcagagaactaacatacagtacattagaaaaacatgaatttaatagggaatataaatcagaattcctaggtgatattccttcaggccagaatgtagagaaatgtgaaacagttgattatctatggaaggctgatgtgcaggtcacttattgtcattcagaaccattaacgaaagaacacttgtgcattaaaatatgtctggggatatgattgatacttagaggaggatatgtagttgtgtgtatgcatgtgcacacgcacgtgggtgcacatgtgtatgtgagtttgagatagaaaaatgggaagagttgaaggaaaaggctggtagtatatgctattactatccatttttacttctttccgtttttctgatgcttccatttttagtccttttctgaatttggatggtggcctcatcatttacttgtatatactgtagtcaagatatatttagcaaatattcctttcctttacttttcatttaggatgttatctaaagccaacctcgtctcaggcacttatactataattgctaccagcatttgccttgatattgctgcccctgtctagaaaagactgttaaaaaaaaaaaaagtctgcctcaaacaaacatatatgggcctaacattttattttggtttatttctgtttatctttgttacaaaacaaaacctgaaacttcatacttacagagataaaatgacagcagatggcataatgggtgaaatgttttctttttccaatttcaaatatttatagctatttattgatcaatttatcttttatttaccctattatatgctaataactatactgagaacttggggtacaataattgacttgttatcttagactctgatgggaaagatgggtagtaaataaatcagtagaaatgttatttgaaggcaacaatattgtagatgtttccaaattattcattgggagaatcaggaatttggagcaaaaatctatgttttcctacgattcaaattgaaatcagaactataagaaaagtacttattacaatagcttataatattgagataagaatctaaacagtcctgaatttttatgaaataatttatagaatattaactagggaaatattgttaaaactgattatgcaactatttatgattttaaagaaatccaaataaatgagatattcaaatcttagaactgtacttctatatagcacatttttattaaatttatatacataaatatatacacacattgaatatacatatatacaggtaaatatttactgcatttgttgtttcttcaattctaagaagcacatatttcacattttaacatctttgaaatgaagatgtcttacactggatggcatcttatgatcattgttgctaaggtggcaggaatggcagagtcatggcctatgcctattaattgtttctgatcatgattgtacagtttcagtcttttgatatttcagtcaataaaccgtttgtggaccattagaggaaggaatataagttccgttgttcactgaatatcttctgttgatattttctggtaagatgaagaacatcagtgtcaaaatttaaaatggcataagcagcttgaaagaaattcctagagacagtaatggagtactctgtagaaatgccaaaccatggatgctctttataggccagaggaggatattgtgtaagaaaacacagctattgcaaactgtgattcaaaaagtgattcagaagaatcataatccgattgtgaaaatatttagcaatacctaatgagttagaagttgttttcttttagtacatatttatacacgtaattttgatataacttaaaattgttgtcattttcaattggataaaatgtattatgtaaacatgtataactgaagctatagcagagtattcaccagtatgtttacatagtttactctagtgttaggattgtgggtgatttgcatgtttttctttacgtatttttttatttttaaaattttaaattactaattagtatttatatctttggcaaatgataaatagttattgattttaatctttaagtgaaaatttattttaaatgtgtagggtaattactgaagtataaatatgatgcctaaacttccaaattttagaaggacaagttggaagcttttttcctttggtgtaagcataactagtaaaataaaagaactgatatttaaagaacagaatggctctaactacatgaaaagatactcaaaattattagtaatcacagaatgcaaattaaaactacaatgaattttttcatgtctactgcattagaaaaaatttaaaaattatgcattggtcaggatatgtgacaaggagaactcttatgcactgctggtttcagtgtaaatttctacaataaatcttctataattcctgtccagtatctctgaagaattatttgcacaaatgccccaagagaggaaagtacaggaatgttcataggagtataatgacatctaactggagacagtccaaatctctatacatagttatgggttacatatagatatagatacatacacatgtatattcagaaatgacatatggtcaatccttattatgagtggttccatatttgtaaatttgcatatccacagaaatttgtgattcacagcacttttgcaatcatttgctgacatgcacagaacagcaaaaaaatttgttatgcaacacttacattcccagctgaagtcaaacaaggcaagaccctgccttctggttttagttttctctcatactgtaaaccagtattctttttatagtctaataccatgtttttcacattttgtgctttttgctggtgatcttgctgtttaaaatggtccctaagagtaatgctgaagtgctttctagcattcctcagtacaagaaaactgtgaagtgttttatagaaaaaatacttgtgttagataagcttcatccagacatgagttacagcgctattcgctgtaagttcaatgtcagtgaatcagcaatatgtattaagtaaggtgtctttaaacagaaacacacataaaacaaggttttgtattgattggttgatgaaaatgtgatcagagtctcacagaaacctatccttgtttttctactatgtgcagcggttcagcatttggtaattcagtgttcatggtgactttacagaacacagcttccatgaataatgagaatcaactgtactctgtgacatcagatttataagtctatgtgcatcatgtctgaatctaaaattataatattaaatttaaaaactgtttccaagattatatatgtcatatgcatattattacatgcatataatatagaaaatttaatatatatttgaaatattaataattgtattaaataattatttaattattaattattaagaatttaattttgactctttgatctatatatattttaggtaatgcaaattttatataaaatgtaatatatttagtttatgtattacatataaatttaggaacacatacacatatacatatacacacgtacatatatggtaaaagtataaataaaattaagttaaaagccatcatacaattcgggatagttgttgccttttggtagagaaagagtgatgtggtcagagaggaacacacagaggtgtttagattaaaaatggctattgctattttctgaagatcctaaaattatttcatatttttagagaaactctggaggatttcacattcagccccaactatgacttattgaacacttaactatgtacagatgactaatctgaggcaagcatacattatttcatttaattcttatattactcttgtgaggtaggtactccatgcaatttttttcgacgctcaagatgagatcgtcatgcaaagttcactttaagatttggcttttaaaagttatagcttctacattaaatgtaataaaagacatgtaatttggaaagccacatatatattttttctcttcaaaaatgtaattttaagatcttcactcatcttcattttatgtataattttaagaaaaattaggatgataggtaaatttgtctagtacgtattagtcatgccatttacatgtagtcttctgtcaatgctcttaattaccttgtaaactaaatatagttattaacctgtttttacagatgaaaccacagactcagttttattactttactaagtgttacagagtaaatgatggagccagtattcgtagcatttgaagctcttatgcttaattttcatgccacaagatgaaaccatgtaaaggaaaataggcttaaatttacaatttcataataaactagaattttagaaaatagaattgtgtatatgtgtgtgtgtgtgtacattctgtcttctattttattctttgtataggagcaaaccaagtagaatgcttttaaagggtctataagttcaaattattttaatataagagtgatacatttcttaaggggggcatatttaaatgctgggaaaattctaattcatagaatttatactagtgttgacacctatttattgtgtgagtctgcacacacctctttactttcctatgggcatagtttcctgtctgtaaaatggaaatcccatatttataacatgatttgaatattaacaaattataatatttgtattgatgttattattttaaaatatgggtttaagattacttagaaatgttatttatgatctttgaagtgagtgaaaaataaataatccagttgtatttctgaatgtttactatagcagatatgataaaaactacaatagtttaaactcaagaattagtaataaaagatggtttagttttctttatgcaagcaggaaaactgcagagtgaggactttaagccccataactgtttttacacgctgattatacaacaaagagtagtttaccacataaatgtccttcggtatttcctcagtattcttctagggtttctttttttaattttcaagcaataaaataggtactttaaaatatagtaataaaatttagtaatatatagattcagattctttagacaactttcaaagatcatttgctattttcaactggtttcactaatacctacaatatttatttccttttcttttttccttaaatattatacatcttcaaagatactatttccaatgcacatgtgctgtaaactcatcatgttaggttaactgatgaccaaggagaaataaacctatcttccaattaatagatgaatagatagatagaagacagaaaacgtttatgtttctaagaaagcaaaaatgattacaaaagcaagctgtacacatgctgaaaacatacaaaccatctcaaaataattgttgagaggtgtggtatttggggttgattttagcaattttagcatctgcacgacattaacttatagaagtggctttgccccaattactgtgattgactaggatctacattatgtgcattaattgtttgtggttaaagcctttcatttgaccttgtcactatagtttccatgacattttttggtaggcttctaacatacaaatgtgtacctataaaaaatctttcaagttattttattcattttttgaaaagcagatgcctatgaccattttgatcaataaaaagaatactacggatatgcagagaggatgtaataaaaatgccgaggatttttttgcttgcttttttttctccctaaattacatcactcggcagtcttatttctaattctatttatattatctgtagagtcagcagtgattagtgaaatccagtcactgctattactattttacttaggtcaggcttcttaatatctctgaaatttgtcacatttaaaaaatagaaaaaataccttaaaaggcttttattgaaactaaactgaataaatacttactgaaaataaaaagcatttatttagcataataagtacacagtatttattgagtgagatccccttatccatttttgtatacctataagattacattataggttactttgagtatcatgcattaattcaataagataagtaatttgaactcttgaaactattccatcaaattaatgccactgtatccaaagccatattttatatgtgtgtatttagtcaggaataactttaaattttactttattgtaatttcttggaaaaatcaaaagggtttgcctttttcataccatttaacaatttttaaaatttgttttacctacgttgtctaatagaatggtaggtgcatttatcatttatacctctacttcctataaaagagtaatttgagactgctttttaaaaaataaacataaaacatcacattgtaccccataaatatataatagatacaagcaaatatataaaaaagctaattttttgatgtatgagtatgtgaagaagacatgtaaaatatatttataaaaaatgtttaaaaaggagatattttctgtacaaatcattgtggcaattaaaagtcttatttagctattttactttaattaaaaaacattttagggatagggcctgtctctgtcacccaggatggagtgcagtggctccatcagagctcactgcagccttgaactactgggtgagtatagttagtaatactgtatagtatactggtaatttgccaacagaatagatttcaggtgttctgagcacaaaaaagaaaagtggtaactctatgaggcaagggttatgttaattaggttgaccgtagtaatcattttgctatgaatatgtataacaaaacatgttttacaccttaaatatataatttttattttttaaaaatagtgggggctggatgcggtggctcacacccgtaatcccaacacattgggaggctgaggtgggtggatcatctgaggtcaggagttcgagaccagcttggccaacatgacgaaaccccatctctactaaaaacacaaaaattagccgggcatggtggcgcctgcctgtaatcccagttactagggtctgaggcaggaggatcgcttgaacctgggaggcacaggttccagtgagccaatatcatgccactgcactccaacctgggccacagagtgagactctgtctcaaaaaaaaaaaaaaaaaaagaaaaagaaaaaaaaaagaaaaagaaaaaagtgagttagaattatctctacaatcatcaaaaagcgtagacaacagaaagcaataaaaaaagccaatagatcatgtcaaaaggctttgcatccatcatttcgttccttggcttagccttaaacaggaaggaaaaatgagaccaaaagtatcaattaatgaggttaaaacaactggtgattgaagtagaatatgtatcagatctatcttagagctatgactgatgtataatgtaaaatggtacttcagttcagatctaaattcttaacttcactttgagtaatttttgtttcaataatcaaattaaattatttaaatatttagcccacaataatcaaaggtatataacttgcatcaattgtttttgtacattttctggtaattttctgagtataagagtgtgaaaaatattcatgaaaaatcatattgtagttttaactggaaagtactattttagtgactatgaagagtggtaaacaaaaggggaaataaaatttaaactgttatttcattattttaatataggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtaagcttcttgcaataaatagaatcctgaattaagaaaataattcctccatgtcacaatgttttacatggagtgtcttggtatattaaaaccctgtttttatgttatagtcacttaaaaccaatcaaaagtataattagaactgaaatttcaatgattttagtgattcagcatcttaagctatttgcttcgaattgagtcttaatggaggatttgtttgaataagaatttgtaagcacaaagcaagatttactaaattatggaatttctaagtgaggctacttcatttagtttgaaataaagtccacaacatattgctgatgtcatttttcacaatcgctacctctggtagaaatgctttcttctgaatgagaagaaaatttaagttgctgacagtttataagcccagaaagtacatcactttaagctgcaaaaatgaagggttaacatgtacattctagacccattcaaatttgtgtgactgaaataattatttatctctataaggctcattaaataggacatctttttaacttaaattgttgcttggaaattatcttattacattctatgttcaaatgagggtattagtcatgaaggataatgaagaaatcaaagtaccatcccacttctaaatgttgcaaatttggaattattggtgccttattatgtcatctattttctgtaaatcaatctcaatagcagaccagactctcttgtagaattttttgaaagtcattacttaaaatatgtcttttagcgtttttatttttcaagtggatatttgactttaagggatagatatagactcagactatagtcatttaaagaaattatatcaattatcttctgtgatttcttatttttcaagtaaggataatatggctcttagtcatgaaaatataacattagtataatatccagtatttagtaatatttactttcacccaaggcctaagtacttaatatgtgtgatatgacttaatcctcttaatgatccgtgaaataagtattatcttctctttattccatagctaaggaaatatatacaatagctctcccaagtcaaacaacttgttagtagtaaacagagactgtaactcctagcatttaacacctgtggtctctgactttctcataactttctctttacatctagagagtgacaaagccagatctggcccaggccttctataaacctgattcaattctttctacttcagctcagtggcttgtgtaccacctccaccaatgtcatttgttcagtgacataataattattctttaggacattatctttttgttgtactacgaaggtaaacagttgatcctgaaataattccctgtgtgtgtgtgtgtgtgtgtgtgtttatgtgtgttggtgttggaatgtgttttatactttttatatatagtgactttatattaatacagcatatgtttcccttattcatttggttaggttaaacatgcatttttcttccagtatcaaaaggtatcctttaaatactatttgggcgtgtcaatggaaaattctacttctaacacacattctatgaatctcctttggacagttgctttatagattgtaagaatgttatttcttgtgaccatagaaacagtaggtattgtagagtagatattcctgtatcctgtgggacaggtgttgtttaataatgttttgctagagcagcacacagtcatcttgatttcagctccaaaacgtgctaatattaagatatgtagagggttttcttgcctcttaaatacaattgaaacagtctcttctagtgaattaatataagtccattgaatttgaacttcaggtcttacatagtcataattccttattgagcagatagttgactaactcatcagtaggacaaaattttatatactgttttaattaagccaaatcttaatttacattctctgttagttttcagacctcagagtcttgatgacttaaaacaatacaggttatttctttctgaagcaatgtttcaaaaagtggctattccatcacccaaggctttgtatgttgttccctaaatctgctccatctgttggacaaatagtaaaggcagacagcatggaagatcatatggactattttagggggtatgcctgggaggaataaacattatttctgtacatattctattgatcagaactcttatactgccctacccagagttaggggccatggatgctgggaaatacagccttcccaaaggaagaaacagaactacataacatctagccagtcctagtcagagcctggtatctcaatattctccattgaacaaaagaagcatgtgtttatagacttgcctatgacagccctccaccctctggctggatctaaaaggaacattagaatgaacaatggcataattaactttctcaaaccactaaatctcaatatgaaattataaaaagtaaatatactatatttactacaaataaatgtttttattttattcatacttatttttctattttaatatatatggtataattttttaaaagcacaaaagaactcttctgaaattcatgaagaaaatggtagtttgttaaaatagttataaatttggaaaaagctgccttaaaatttttagggtgatagatgaataaaatatgtctaagttaaatattaacagggattttatatatgcttgttttgtgaaagcagtgctagatacatacaaattcttggtatttagtaattgatgaaggcaatatctaggtgagatccaagtaagtacctggaatattgcctaaagtcctccattatcggggctaaaacatgcaaatgtttcatctctggccatagagaaaagtcaggaattgcagaaattctgctcacctttggtccttcttttaaaactggaaacacaattctaggcccattgtctagtggatgaaaatgcttttacctgccatgtccactgttgaatatagatcttacacgtttacatagtttgttggaaataacatctatgtcttatcctgataattagtttctaatcttttaaccaaaaataattggcacatttaaaattataatctaatgtggaaataattttcttaatgtggatgcagataattttttttcagaaacatagtaactatttagaacaaaaagtctgatatagtcagttaatctaagacacaggtattagtcctgttactcacattgcagtctttcttcaactgtggtctacagaatgcttagcttctgagtcatgagtcttgttaaaaatgaagtcctaggccttatcccaaatccccttttatcaggatttctgttgttagagttcagaaacttgcattttaacaagcatctctgaaaacaacttcactttatatacaacacaggggttcactgttgtagaagaaaatcactatttgattttaaaatacttaaattttcttacactatgtgaaatatatttataggagccttttaggttgatgattataaaaaaaatttggagagcaaaggtgaaaagacatagtttactgtgaagtataatgagtctctctagcaagtagctgaaatattctgttcaacacaatgctaattgcattagcctagagaacacctaagatctgacacattcattagggcttagcagtcaacctattaatcactactgtggggtcactgagtaagatggagcatgttcagaggcctggcctgtgatgtcaggactggagtctcttgtagtaattagttggtatctgggctttggtagcaaggtattatcttcccttctgatgtctgaattaaaaatgaaactaatgaaaggttcgcaggaaggatggaaaagaatgcaaattatgtttataccttacttcatccttagaataatggcatcacattacagcaatccatctggatgtccatatgttctcctggagatctagcaaattttagcaaataggtcaaacagtgtggtcaccccattaataaagcactaagtagaggtagaaaacataatttaaactttctacactgtttagaaggacatagggttttattttgtaaatagtgattacataggattatcttttagtgcaatatttgtttttgtattctattgaatgataatctatacatggttacctctacagttactggcgacagatttggactgccagtttctgtgagtactttatatgacttttctggtaaaaatctattctgacttggaagaatcagccattctggagagaagaattggctttgtctccatggtaacttatttttctgttttatgtgaatagtgacggccaattgtgctaaagtaagggtgatagttttgtgatgaactactttacatggggattgaacattagaacactgagcttattttactggaggccgagaagcaaaaggctttaacatagcaggttggtggtcataatatacaatatgtatttttctattctcttaaaattttaaataagctcaatatattattctacattgtgccctaatattttgcagaatgagggaggctattaaaataattcatgctgtgcaatatcttagcagcaataaaaaaagaaagtcattccattcctgtgtttgagataggtagagctttcatcttagatttataaaaagcaaaaagtaccaggtacactttgacagccctgtgcaagtaggctgtggactttttatatctatgccatgttagactctttttttcatctgtaggcataaatattactaaagctttctatgaaatatggtacagtgtggcagaaactattatgctcaccgtgcatccatgcactcctctatatttcccagctttcctccccttaggctgaggccaagtgactagttctgaccaattaaatataagcggaaggacatctgtccctctggacacctcctggacaaggtggtttgatctggcatgcatcttccctttctctacagttatatagactatactgatcattacaaacatgagggcttggtttattgtgtaacaacaatataagttatataaattattacatgggatgagaacacactatgagatagccttagtcaatttagcttatattatatcatgaaatgtacaagtgctactctatcagatctctgttagagaagaggtatcctttggtagcctagagaacacctaagatctgacacattcattagggcttagcagtcaacctattaatcactactgtggggtcactgagtaagacagagcgtgttcagagcatgttcatttttctcaaatgaaaaagaagttgtgagtggatattatcattgccagtcttcatggaataaaagtgagaggcaaggacttcaaaacacaaagtaggaatggaatcatggccctggagctttctatgatgaaatctgtgtgtctcttccaaaacagggatgaaaggggacagaggtcaacaacagattggaagtgtgcttagagcctttgaaattattccaggacacactttccctacagagggctgataatctagtacaaataatatcagatagttactaaatgttattttcaacagaaattctaagaacctttattgaaatcttttctgactgatatatgtgcctcagacagtgaacctttcacttactgatgtataaaaagaacctatttattaatttatgacctgacaagaataagactatctttcctgatttttggcttaaaaattttcaaaaatatgttattatatcattactcactttatgcagatgtgtttttgttgtaaatgacagaaacctgatacagataccctaaagcctaaagagaaatgttcatgtatacaaatcagaggagaagcagagacaccaatgtcttccagctcaactagcaccagtaattctgtttgtccagcatgttacactctctcttctctcttctgtttcttccagagggcagctttgtttatttatgttgatattcttcccctggcacaaggaagatgtctaccaacacttcagcctcatatttcagctcaaatttgacactaggaagactgccactattccctaagttatactttgacaaattctaaggaagattgctaggacatggcctactttgcatttgccctgcaggcagtgggtgaatgagggactaacattggcagcctgagtggaactatgtatctgagataggaaacgagcagttccgtaatggaagggcactactgttcccagaagaaggaaggattctgaagagacaaagtattaacaataagcacttactactttagtctttttaaagagattaatatgttatgtttcaagaataaaaatgtgttgggttttactagtcactcatggggaattttgcatgtagatactttatagctagctagcaagctgcatagataggttacatgtcaaaatgcatatatcatatttggaaactattgcctaatgaaatataatgcttagtagccatgaaatataatgcttagtagccacccagaggactcaattgcattttgttaaaatttgaaacagggtcactctgttgcccaagctgagtgtagtggtgtgatcatggctcactacagccttgacttcctgggctcaagcaattctcctgcctcagcctcctgaatattctgggactacagaggtgcaccaccatgcccagctaatttctggttttttgtacagacgaggttttactagtctcaaacatctggactcaagccatactcccaccttggcttccaaaagggctggacttacagatgtgagccaccacacccacccagccctaattgcatcttatgtgagttggtgcctagagtggaacatagatatggaaggtactgggatctcaaaatggattattaattatgtaattgtgcaatgagaagcagaagagcattatagttggagagtgagctccaaaatattaatagcagatatgaaattgagactttgctacttggtcattcagcctatttgccattttaccttggacacagtttccttatctgtaaaaatcacacaagaatatatacatttatgagtgcatatgtgagtgtgtgtgtatgtataatgtacactctcctgctcagagtcattattagtaataaacaccaaatacgatacttaggaaattgtagtttttgattcactgcagttgttgctgctgttgttcttgatattctccattatgcagtgaaactgcagataaggaacaaagaagatagtaagtctgactcaagcaatctgtgccaataacatttaaaaacgactggaaatgcaagaaataaatagggtcaataatcatttctaaaagaaatctatgccctttacccatattttccgtggcatttctcttgtgcctcctatgatttgaatagtggacaagacattggtcattctttttgggccatcctatattgaaaaatccttctatgtttagggaattcccaacatcaccattttctgactccccaagggaaaagacagaaatatactttctcagagtttattacacttaagggcacaggcatgtgacccagtctccgtcaacccggtgtagaaaggcccgttttcattcagaaactactgatgtgtagaagcagattcctcaagaaaaacattcagatgaggtggttataggtaattaataatccattcacgcaaaactagtgtcagtgtttagggtcaatgggacttgcagtgtaaactatgtggtcattggtggcagctgtgatgtccccactggagcaatcagttttgtcatgtgatttggtcagcatcatagcttggtttttttaatcccccctcatattctctgacattctttcatgtccttattgaatgccttcttctttaactaggatatatgatagatacatgtggttaagttccccaaaggtcctagtgaggtctagcatgaaatgctctcgtgaactaactggttattctgaaaactttctatggatgttttcttttcttttcttttctttttttttcttttcttttcttttttgagatgtagtctcgctctgttgcccaggttggagtgcactggcacagtatcggctcacttcaacctctgcctccagagttcaagtaattctccctcctcagcctcttgagtagctgggattacaggcacccacgaccacacccagctaatttttgtatttttgatagagacagggtttcaccatgttggccagtctggtctcaagctcccaacctcaggtgttccacccatctaggcctcccaaagtgctgagattacaggcatgagccaccgcacccagctgaatgtttcctttaaaagaaggacctttcctactctttcccagctcttcctcaacaacatattaggattgaagaatttaccgcagttctttttaattaactattttaaagggctctgtaaaaattgaaattaatttttatattttcatatgctgtgggtgacttaagtttgatggattatgtcacaaaatgcaaagtaaatacacattgaatattttttcattataatagtagtgactttggcagagtaaatgcattgttccaaagggatttttaaatggttaatctagatggctctccttgagttagaatttgctcagctggctggaagtatatgcttcaggagtgtggttcatagatttgaccctaaggggacgccctggcaatggcagacactagccttgcacaatcattgcctgaggattcatttgtagtcaccagaggtagggatgtccaggtaatccagcatcacaattaagaagaaaactatacataatttcactcattcatttattccatagatacacactgagcatcttaaatgtgcaaaacactggtgtggcattggaaaaaccacagcgagccaacagacacaggctatgctttcagaatattaaatagccatttacacttttccttatttcattacagttatgataaatgttagtaaagaggcacagtgggtgccatgcaacagcagaaaatggaaatcgatctcataattgagtgatcaggcaatatttcttggagctgaatttgaaggataaggaggcagcgttagtcaagggagaggaagtgtttgaggcagaggaaacagtatttgtgaaagccgtggaagagtcatggagagttctagtagcccagaggaggtgaatgtgattgatctatggtgaaaagatggagaaagttgtgtttgacagtctaaaacctactggaaatgatcctgggccacatattgtatccatataaacaaaagagaagaggatcagaggataggcatctatgctaccatgttagtctgctctagctgccataaaataatatcacagactgagtggattaaacaatggaaatttatttctcacagctgtggaggcaggaagttcaaaatcaaggtgccagtagggctggtttctggtggggcctctctcttcggcttgttagatggctgcctcctagttgtgtcctcacatggtcttttctttgcatgtgcacccacccctggtgtctttctctctctctctctctttttttttttccttttgagatggagtcttgctctgccgcccaggctggagtgcagtggcacgatctaggctcactgcaacctccgcctcccaggtccaagtgattctcctgtctcagcctctcgagtagctgggattacaggtgcccaccaccatgcccagcaaatttttgtatttttagtagatatggggtttcgccacattggcaagactggtcttgaactcctgacctcaggtgatccacccgcctcggcctcccaaagtgctgggattacaggcatgagccaacatgcccggcctctctctcttcttataaggaaactagtcatagtggattatggcccaacttaatatttcttatgaccttatttaaccttaattacctcctcaatggtcttaactccacagacagatacattaagtgttagggcttcaacatgaattttggagggatataatttagttcgtaacaggtactaggatcataactctgagtactctcctcccttttaatcaattttaagagcaaatgcataatccagaatgtgttaaaatacaggtggttgtcattatttgtggtagttatgctctataaagttgccacaaacactgaatgaaaaaataccaaattgctgcttctaggggagatttagggttacaggcccctgaacctctgatcataaaattttaattcaccaagcaatccatgactttgttttctatgtgtttccatttaaagacattgtattcaatatatttcactgactgacattgaattttggccaaaggtgctataatttattcctgaattaagcttattaaacacatacctttcctccataagtcatatcacagccgtcttgtgcctaggaacaccaaacagcacttcagcattatgctttgaggccattttaaacagaagaattaccaactaaaagcacaaaaatgcagaaaatgtggtattatatagaccctgaaaaggacagttgtttacactctgggagctggaccaagaaagcagttcatcatcttgtttgacctccgctgggaaggtgagggcacacaatgcatgtcaggtgatccaaatttttcaccactctgcacatagccaccagtgactgcaaaagaactgagagtattgattttaaggttacaaatcaattttagtaagtagataaatatgtaaatatagaatctgcaaataatgaaggttgaatatacctattccctttctctggtgaaattaccgcatttcttatactttataaaggtgtttgtaattacccaatgtttttattacagtttgtttatctgttgtttataagaattggataagcctgcacaaccacaaagctaatttacattagcgtttttgtaggtaggcattggttatcatcctggagtttactgaagttctttttaaaggaacacaactttcttaagctataaaagcaataataattacacttagaatagtactaatcactagaagggtgttaagtgtaaagctttggaaagcttctgtggaagctttgatggatttttgaaaactgatgaacaactgaagatccacagccttgaattattctgattagaatgtgctgtgcatgactgtagcattctgttgggtggtggtttcctgctttggccttgcatctcatgcagtcaatgattggattagcggcagcctgtggaagcaacctgtatatattctcagcaccccaggaaatgagtgtgcattcttggaaggctgaaatggaataaaaccgttaaatagaactccgatctacgtcagattcatctcttcttcttatatgatgagtaaagagcatctgtaaataggactatgagagaaatctgggtagtgaacaaaggggagcaaaaggagaaatatgatgtgtgtgcaggcgatttggaatttcttttaaattttccaatcttctcccagataatcctgagttcatgtatatgacttacactgatacagaaatacaagaatcagctgggtgcagtggctcatgcctgtaatcccagaactttgagaggccaaggcagggggatcacttgagtacagaagttcaagaccagcctggacaacatggtgaaaccctgcctctacccaaaatacaaacaattactggggtatggtggtgtgtgctgtgtcccagctactcaggaggctgaagtgggaggataacttgagcccaggaggggaagttgctgtgagctgagatggcaccacttcactccagcctggacaacagagcaagactctgtctcacaataaataaaaataaataaataaaagaattatctataaatcaaaagcatttaaagtatctttttggttctattaggaaaaaatcgtatagtaagttcaaaacatttaggcttttatctcagctggtgtaagcggctgtgatattggtgcaaagatgaaatgataggtgttttggcaacggcagctgtaaaatctacgtagcaaacaacagatggttgcttatttgacttttgggcaagaactgggatatagaaattgctgttgaaataggtctttctcaatgtttcagatttctatcatcttccaaagagtgagcatggatctagagactgagaaaatttttaaagcttccctttgtattcttagtctcttgttatgtgggacaaattttccccacttccatcagaaatatgcaaagggttgaattttaataaccttagttacagtgttcttgaatacacagaggttgtcattaactttccaaatgcctcttgggcgccaggagtatttcatgattagtttaaaatgtatgtaaaatatctacacagagttagtttggcacttgcagataaagaaaaacaagtttaatcagatgaccctgataaaatgaactgtaagtccttctcatgaacactgcttctcacgagaaatattaagtacctctgttgtggcaaaaatattacttaatggtattccttaaatcgaacatgatatgttttagaagctagatacaacttttcaaaggcaacataacctctgccccttagagttggctcccaaattagatcaaacacaactgaactagaaacctgaggcaattcatgcatgcttctgaaactgtttccctaacaaaatagtctcacctctgtgccctataaacactccaaaatacaaatgtgggagaaaaaaaggaaaggtttttattcacttcatattttaagtttatatttgtaatctcttgtttatttgagtgattttattctctttggcttattaaatgaaacagcagtgaatgttgaacaattatatttagattttttttctacctatttgtgaagaaacaaaattggacacagaaatgccttttgaaagatatattttctgcagacattcatgctcccttaggaggggcagtaatagtgtcagaaaaatacatctcacaaagtatctaaatttctgtttggttccagacagttctctttttattgctttagctaagtcataaatatttattaaccatagaataaatttaataaggtcaaaattaaattagctatatatacaagtactagttatagcttcaatggtacttatgtaatattccaaatataactctttatttgttgtggtgatttttttctaagaggtcttcctttttccactggcaatcttgtttatttattcctttggagtgcttaatcattgattttaagtaaagagcctgcatacaatcttgtttcaaagcataccaaaagctttcagagatgaataactcatcgtttttactaaatatctaaacaattttttgccttttttgtttctaagaggcattgacatagtggaatagtggtagggcatggaggatttggctgtgttcagattccagtgctgcttcctactaattggaattttgggaagatactcgatacctctctgcttcaattccttatgtataaaatgcccatggtttatttgtatgaactaatatttctgaactctactgattagctcatatctcataattaaatacaataagaaagaataacgtggctatctgggtgaagatgtcttaccttctcaacatgtttatgttaaggttatgttataacattgagcttatttaagctgttttgaaaattcaaaattatccaaagatgtggacagcttctgcagcatgggaactagggaaaatggataagaaggaaataagtatcacatgataatgcctgctttgccttatatttcaacctaaaagaattgtagacataaggagaaaaagtgattcatctttctgttactctggccatctttagcctatggtacttctagacactatctagattagatgttttaacatttagtccaggctttatgttctatcatctaggacccgattcccccacttcttttgtctttttcaatgcactagagtaagaaaacttgtcacatgtgagaatgtataaattgtaaaatccattttaattacagaggtcattgtgctttccctttgctgtgaatagctgtgtattgtgttcaaacagactataacacaataggtgcacaaaatgagcaccattcttcataacatggcatccagagaaaattaaaaacagagaagctaaaatcttcaaaagcacgtatttgtgaattcatgtttgtttttgaaacagacaatacctgttctagtaagaaagacaaatcagattttatctttacaaggtaaaaatatcaagtctaagaagagatataataaaacaatatgaaatcctgaagagtatgcattatatgaagagatgtgttaattaaattccacaatattggaattgcagtgggaaataagacagaaaaatggggcccaagagaagcttgaaaaagatctattttataacataagggaaaaatatacaaaatgtgtgatcccaaaaaaatgagttaaaccaaattttataacagtttgtaataaataaactttagataaattcattagtgatagctgtaggtttaaagggaaacaaaagtattaaatatatattttatatcaatctgcacttattgaggattgctgtattttgaatttactaagaataaacatgttaatcttctttttttcttggcagcatcataagccttttatttttgtgatctgatttcaaatattcattgagagattttttaccccatccccacctccaccctccaaaaacagagaactggttgcaaattggagcaaatgctgccctagatttgcactttccaggattcttcacagcatgaataaaagctccatggcctcccacggagtggcccaaaatagacaattttccgtggtccactggaaagttggcatttatcagtggtggaaccttagctattataaacatgctaatcttctaagtaaatattggaaacaggatgcatacctgggtctacctgactttgaatctcatgtttttgtaaacttttctggaataggaatgcctcatgactatacctttcttttctaattcttcaggttggtatcatatgcaatagctgtatattccatcagttgattgacgtgttattatgggatcgctgtctaaagaacacaattggaaagataataaatttgttccagtttggaatcttcctaagttattgttaattgttacttatgtatttatagttgactaaaatttattaggtctttttctttttttaagcaccctttcataaatttggtctatgttttcttgaaataggtttttagtcttgtgagaccataattagtacccataacaacagaaatgtatatctttttgtcattgaaaaggaccagtcatagtagggtaaacttcttgtatcactaaaatgaaatagtgaacaaaagcatatatttgatgtcagaccaaggaatgtcctgtttccggtatctccttaagtgtgttatccatcccttctaaattttagtgatttttctacaatataggggaaaattatatatccaatccagacactttgtcataattgagaaaagggaatgaattaagcaatagctatcatcaccattatcatcatccaatctcctccccactccttgtcttccagaagctccccaactcccatgttcacacccttaaacttgtcattatcaatagctttcaaataatctcaatttttaaataacttactcctcaatcaccatgtcgtatcttccaccgcattgttttctagtactgcaactataataatcctttaactccatcagtactgttaagctattgatatactacctcatccatcactgctttccataccattttcaccttccttaccatctaaacttcagattcaattaatttaagtttcttgcatacattcttaacttatctacctaccattaatttttttgtatctcttgatgaaaccagaactctggctaaagccatcagcttagttcctttgagtctccatggcagaatgtaaaccacactctaggatttactaatctctttaattgatgatcgataatcttaggtgggcccgaaatgctgcttggtaaccatattttatattatattactctagtccagtctctctctctcgctatatgagatgattatttgtcatttaatccatattccccaaagccactgtcttccctcctttcttcatcccagaaggtaacttcaattcctacttcattcagaaagtttacgttatcagtagaacttccacatacttctactaccacattctcctgcctgtttacatccagatctgacatactttaccttctttcctgtatcagtatctatcctaactaaggccaactatacacttcctttctcaccccctcaactattaatgggtattactgtggacaaaattgtatcttctctctccattagcaatattccctctcacaactgggtcattcctgtagcttataaccatgatattctaacctccaacttgggaaaaaaacaaaacaaatggaaaatgttatttagaccaatgttacctgtcagccacaaccatacttatgtccttccctttaagcaaaacttcttgaaagtgttgctccagtttctctcttccccttctttttgcccccactccaatcagaatttttcttgtacccctcatctgaaattgctctttccaagtttctcaggacttcaatgctaccaatgtagtggtcatttcttagtccccattgtaattgacctttctggagcatttgatacagtacttaatcaccctcggtcttccatacaacacattcttgattttacttataaaatattacacttaaatattttcttttgatgccattagccacatcttttcagtatctatttttggttcttcctttccccttaaattctcaatgttcaaaagtttggctcttggatctcctttccatatatacttgctccataaatgaccttgcaccttctcatgactgtagctcatatttataggctgatgcctcctaaatttatatcttcagtttcaacttctcctgaactctagacctatatataaaccctcttttcagtatttccactcaaatgcttaacaggcatctctgacttcgcatacctaaaattcatcttctgaaattctcctccaaacctgttgatcaggtcaaaaacattggagccatgctttgacttttcctctctcttctttcagctgcataactttctattagcaaatttattggttctgccttctaaataaatccaacacttaatcacttctcatcacctctgctgctgttacctggcccaaggtattattatttatagtctagattatctttgtagtctatgatttggtgttcctgtttctgaatatacctaccaatgaaatcctgtcataacctaagttcaatcatgtccgagcctacctaagacttcccaactcactctaattatctactctccctgctatctccctgaacctgtcttctgttatcctcccttttgctcactctgctttagctatactatctacctactcttcctagaatataccagccatgctctcacctcagggaattgcacccattctttcctttacctggaatgattttcccttggatttaaaaatgccctcatttctttcaggcctttactcaaaaatcacctctcatagaggtcttctaggtgtactctgtctaaaatttcaacaacacgtcacacggttctatccatcttcattggttatgtttttttctccataacacttatcagtattatttgcttttcatttgaatagtagtgtcctatagaactttctgtggtgatagaaatgttctataaatctgattgtctaatatatgttatccactagtcacatgtagctattaaacacttgaagctagtctgagaaaggaactgaatttttattgtattttactttaatttaaattttaaaaacctcccttggcaaatggttaccatactggacaatgtgtgtttagaatgtaaactttcagtcccccactggaatataaatatcatgagagcagagattttttttccttctgctttgttcattgctttattcctagacataccctggcatatagtagacaatatttttgaaggaatgaacaaactgatcattataaaaattattataataatgatcaaataagacattgaaagacaatcctagtccttgccctgccactcaataatgtggtgatttttcagaagttacttactttcttggaacccaagttccttcattcatatttttctctttcatttaataaacatgtattgagatcctcctgtgtgccaggaattatggtagatattgatgtacaaaggtgacaaagatgtagtgctaacaaagatttaattaggaataaagagaagtaaaatttattaaagcttcatgatacttttaaagacggagatgtgaattgctatgggagaagacagaagaaataaaagacagccttaatggtcaagggaataattgatgaaagggaaaatgcaagactttcttgaagataaaaaaggtttgaaatgtttagaaagaaacagcattttagtataaaggcaacatacagtatattcaaaattcactccttcctataacatgaaatgtggaaatgtgggatatttaggcataaggcattgcacaatgactctgtgtgctattattaggtcacagtgtaaatatgcacaaatactcttataagatctgaaaatccttcagctattttctattacaaaattctaaaacaatacgtatttgttttctactgttgttcccgtttatattgctttttttgtttccattgcctttttttcttccatgtgagaagtatattcccacttatagttagtgaatattttaccaattttcatcttttcattcttaaacaggcatgcaagttataaaaactcaaaatgaaaaatgtaattgtggcttaaaaaatatgtataatgtcgttggcctaccgattgatatatgtatagtatatgattttaatattttagatacctcaccagctccataatcagtcagatacactttccaagaaactttaaagcagagaagcctgaaggctgtgcaagtgcagagcagcttctgttagatcttcagcagaatacaggttttgtgtgtgtgtctcattctactgctgaggattaagtgacagtggaataaaaattactggtaatgtgataaagcagggcaacttttcacctttcacaccagccaaaggacatattgggtatctcccctgaaagctaagcttgttgtcatagtttaatacaacttttcaggtgtatactaaagaaagaagaaaataaattagtctgtaggtttttatgtcaatatagataataaaaaagaatgataattgaacttgctaatctgctgtattacttcaaagtaaaaacatgttgcaacatatatttctaagtaaatacatgttgcaaagtgcaaagtgcaacatgtatttacttggaagtaataccacagattagcaaattcaattataattctaagtaactattactacaggacttgctggaaccagttgggtgcttatgtatgagatatttgccaagctgcataaaagaaaagggctagagtttaaaacataaatgtgactttgtatttaattttacagagcatgattaactagtttatgatgtcactcggaatattatcattaaaattagatttaaagaaatggagggtttttatgtattttaagaataactttttaaaaattaggatgtatatggaatttctgcatttaagaggatgacattaaaagcaagtctctataaattctttatccttgaaatgaaggtaataatagaaaatttttggtttgtgaaaataccaataaattagatgaattatgcaaagtgtagtgtatttcctgccacgtaatgcatgctcaaaaatgatacctattgatattctttaccaaggaataatagtataattccaaaaatattgttgcatgaatgctttccctcaagaacacatccaaatttaatcacagagatactggaaatcattcattgctatgttcataactaaaagtatagaatactatttttgatgcgttcttaatgccattctacaggtatggtttgtcgttaaacagctagattccactttcaactccatagaacttaatattatctaaagaaatatttaccactttgaatcactattgtatgaattcatagatctttacaaagtgagggaaacttttctctactgctttactttacagattaagaaagttaggagttttctgaatgccattcagggagtgtcagtgcgaggtaggatgagggtgtctgcttccaacttccaggattttgtggcaccttctatcattcttttagaattatttatccttgttaggtcagtctccatttccctattaaaaatggttcatcagtttctttcattagaaataacttttctctgccaaattatttcatcacaaaaatagtattttatagattttaaatgacttctttactgcttaataacactctaagatagatgagatgtattttgaaaactatgctaaagaaaatgttgtatagtgttatcattattatcctacctggtgaataataaatgcttttacttttcaatatgtttgagcctttcaaaaaatatgaagttattccatcactgtccttagtattctttggccatgctactcatttttgttctcttaatcaccgctcataaattagttccttaggcttcagacatttcacttgtcttttcttgaacagcctcctacatgttcttattattgtaatttagtttttgagtgttgacagtttacttggcactgtttacagcataacatctttttttcagaggtgactaaaattgccacattgtgtttagtgtgttctcaggaagtcacagactgaactttaagtggactaagccattctaatcttgtatggaatatgaagaagcaatcaaaattcagtcagtggttagatttcagaagcattttttagtctcaatctcgtttctcctccaaccacgtttaaagctattttagttaaagtgatcagtgagtacacatctaatttaatttgtcttagacctgtaaattatcagaatgctactctgaattccagtggcgttcacactgaaattaaaagtgacgtgagactcttttgagaagggtcttgggaatataaagaatggctatttttaggtagccaaaatgtatgtttttaaagaatcaatatttttaaatctattgaaagcacagaataaagtttttagttgtagattagtggaaatattaagtgtatggctttcaagtagatcttccactttaaaaatagaaaaaaaatgaaggatagggtaaaagagaaagaaggggaagattggattgatttcaggtactatgacagacagctttgtttgtttcatacaatcttcgttttcttactgctcttggatattgaattatgtggtctaaaatcttattaaccagtttctgatccactagattataatgattgtgttagttgtgagcaagttagtaaataacattaaaaattaaaagggtacagaaccaaggaccaggagatctgatttctagtcttggattctccgtcttgggctgtcagagatgctggctgtggtgtttcaggtcacgtttttccttaccttcctgtcctgagacgttgcaacctcaactaagcccctccagaaactcaccacccagtaatcattatatacataatctgaaaaaaattaggaattgtatgggaaacaatacttgaaaatcagattgtctagagatttatgctttatgatcaatacataatagatcagaatagagatatgcaaagtcacctcagaaaattttaaaagcatctagattacaatagtaataatactaaattcatttacttatctaaagaaggatgacaatcaaaaggagtgatcatgaggcaaaacttgtcagtatctatccaaacactgaccggtgttggaggaactttagccaactgatattgagtattacaattctgtcagcaagatcattaaaaatatgagatggatatatatatatatattatatatatatatataatatatatatatgttgtatttagaaggagtaaaactacatattcagatagagtgaggtatttagtcatgaaaagatgagttagtccctggtgatgacgttaacagtttcatcataggctgacaatggagcagtggctacttatgaacagaggatagaggaaaaggtgtacaaaatctcagatactgtggaaagccaaattactagaaaattattttgcagcattgggacactgttgagattacatttgaagtttgatatcatgaaatttaaaggcaccagttagtatggttttgtgatctaatccagcaattttcaggtctttagtagagatgcacttgagatcatcctgggttaggtattttccagatacacatcatgaagagaggagtaaataattcagaaatgctttcaaaggagttgttgtaagaattagccatctaatttaagttctataacaaaggaacaaaaagtagggtaacttgataaataccggaggtttgagtgaagtaatagcatttgcatattgggaatcttggagaggctaaaaaactgttaatagtgagagtatttgagcaagtgaaatgaactgacagtagtttaagttggtgagggcgatgtttacattttaattgtgttggggggaggtagtgtcatattggttaatgacaaattttagtttatgaccatgcagtatgtaataaggtggaatatgacaaaaaagagagagacaaaaggtcaggggaaatttaaaaatgttgagaaacttaagaagccacatgtatactgatgtcactatgaaagatgattggaaatggaacagagatagagtcttagccataagccagtatgaagaggtgagtagagacccaggttccaatagataataacaacaaggaggttggagagggtgctatgagttgatggaaatagcttcaaaacatacagtaaaaaggcagaaattataaagcagagtattacatggtgggtttaatacagcaacctgaatgtttaaaaaaatcacttctgggggtgattaggatgaccatggatttgggacataatgggtctgggccaggtggaagagcatgggcactcactcactgctaattctctgagttcaaacacttcctttagtgacatcctggcatccagtgcatattctcttagctacacactggagtgaggccctattggctgtgagcagctctttaagcaagtaacaatttgcagataaatgataatgtcttgaactaagatggcaaatgatcaatatgagtttgcccctgggagatggatatgctttcagattactaacaaaaatagtattggagctttcaagtacaagaacctatcgtcatccaggtgtggtggctcatgcttgtaatcccagcactttggaagccaattagctgagcgtggtggagcatggctatagtcctagctactcaggaggctgaagtgggaggatcacttgagcccaggagtttgagtctgcagtaagctaagattgtgccactgcactccagcctggatgacagaacaagatcttttctcttaaaaaataaataagaaactatcatcaagcaatgtttagataatgaatgccattatgtgacacctatgggatgacaatcagctgttatttccccatgaaaagacatacacttttatactttgtagcgtactttttttcctagtagaggaaaataggaacctagaaattctgaaagtttattaacttcttaagtgggaaatatcaaataattaggtgtcctacctagatacttgtctgagatgatttttccaatttgtctcaactttcatgttgtaattcatttttgtcaatgaaaaattgcaaaataccttttcacttcaggttattagtggtgccattaagttgggtgaaagttgtgtcatctatatgatgtcactggatactcaacacattcttattaatcatatttatgtgtggtttgcataattgagttaataagtatgcacttttccttttagtcatttattcttcgtattaaggttactgttaaggcctatacaatttacacaatttcacagaatccataaacatcgaaggaatctattggtattataactcatcatgcggattaccatgctgcccaggtgggcattgtctttgcctttcctatcatctccttttgacttcatgcttcatgtaaatcttccgggacaaaagtagaaagtagcatgtctctctgtttcggtttccctgcctctctctctttattctgtctttattaaatgcctcattctaattcccaaatcattattttttgacattttcattcctatcatttggttataattttatagcttttaatcctttcattgcacctgtgtaaactaaagccttttatggttcatctttctctacaagaagcccaaccctttccctccccaccccttaattctagtataagttgcatagataggtgattttgtggttcttaaaaagattacatagcaaagggatggatcctcatcatgtaaacataatagtttcattaatttttggcttaaaataggtcttcatttgtcacttaaaattgacctatcaaaagtaagcatctgaatgtggaatgacgagttcaggaaaagctaaacacactgttcaatagcacaatgtggcttgctgacaatttagctgaccctacacctggaaagtgctatccagtcatgtgcctttgtggaaaagctaaaagtaagtttaggaagggattcattctttcaaataattaaaacttaatgagcatctcttattcttctactgagtagtctgcaagctttcacatttgcaagatagttctgtgtctacaaagaggtcagttatggccataccacttgtggaaatctagatttgaaatttcaggactcaggttcttcccaaaaattagttcaggatctaccaggaattattggagccttagcttgcaggtgtccacatcagttattgctaacatatttcctcactgtttgcagggttctttaggattcccaatacaaaagaaaaaaaaaaacacttctgactcatatttaggcacctctccgttagcactgtctaccaaaaataacttaattttctactcccgtccacatggatagtcttatgtccactctaaaagggtatgcttcctaaaattaaaaaaaaaaaaacagacaacacacctcctaaaatgatgacctactggaatttccaaaatggcacctatttcctatgttagtatattaatataactgtgggatatatgttagcatatgagtattaagttattgttacatagtatagttgcagctgagtacaaatattggtaaagcaaataataataataataataacgctatgtaatgaacaaaggaaatcaccgaaagacattgggattgacttagctaaggaggacaaggtaggtgaccatatgacagaggacattttatctgagtatctatgcaaagttcatatatttttctttttattttcctagtttattttgagagtcattcagatgccaaatggcatttgtatgctcaaaaactctttcttgaaatacttgcatttcagaatggaatggcccagtactattttcctccactaaagtattactttgttattagatttaagaaagtttcatggtctctgagagacttgctctcaagtctcttcaccacttgtgattatgtatagcagtgtttatcccgagacccatcaagatctttgcactaccgagtcaattggaaacaaaatgggggaggttgtcactctataaaataaattatcatgaaaatctaaagcatacatgtttgtttattaaatttctgccaagacaggtcctcaatgtgtttatgccaagtatcttttttttggtctggtataattccttttacctaataaatggtaaatattgtatactgctaataaaattaaatgtaaaatattcaagcttaaatatgtatatactttttaactttattcaaatgtttgttcaaaatttatgaatcaaataagaaactgctcttaagaccttttaagaaaatcatgagttaagtggtagaaaacagtgacattttacatttgtatggcattgtaaagtttatagcatccttttacatgtgttacctcatttgaatttcaaacaatttatcagttagagaaggatatgatcatcattttccaaattatagaaatgaagtacaaaaaggttaaatggtgaaagatcacaggactagttcctaggaaagcaagcctggtagccccaagctcagtgctttgaagtgcttgatagtaggataagaatcccagatagccctcccattaacttttctctgtatagcttcaattaattgagtttgctggctaagaactttgaatttaaaataaaaagaccaaattccagtcttcgttattttctagccatgtgattcttattcaaatgatgtaaactctctgagcctgacttctgtatctgcaacatggttatagtgcagctcctggatcttccacatagagctcatttggcccacaccaacaaggaaaaatgctctgaaaatgactgaatgccttttaaaaacataaacaaatattgtttcataccatcatggcattttgtaatgaggatttaacccagaggcaaaagatatagggtcaaacctcaactctaccactagaagctgtgtgactccagacaagtccttgaacctgtgtgagaatttgttttgttcacggtaaaataaggatttttgagtgatatttaagtcatttaaatagtgatatttatcaatgacaaattgctgtgagtggttgaatgggataaacaaaagtgtgaaggtctttatacaatgaaaaggagctatgcatatatattatatatatatttccatatatatagagaaaagcattatttgcatatagtatacttaaaaatgctaatttttggctgggcacagtggcgcatgcctgtaatcccagcactttgggaggccgaggtgggcagatcacctgaggtcagagttcgagaccagcctgaccaatatgaagaaaccctatctctactaaaaaaaaacacaaaattagcctggcatggtggcacatgcctgaaatcccagctacttgggaggctgaggcagaagaattgcttgaacctgggaggtggaggttgaagtgagccgagatcgcgccactgcactccagcctgggcgacaagagcaaaactccgtctcaaggggaaaaaaatgctatagttttagtactatgtcagaaaacataatggctcctgaatctttttggcttctaaaggaaatatgccaaagtaggtatatgagagggtgctgtgcacagaagatcatatgtgactgaagcctaatttgtgacttgtaactcactcatcttcacacttttgcctttctcagggagtttcaaactcctttcttcctgtattacttaaatttctcaaatacccaatgttcttaatttttgtaccacattctgagggacttcataagagttgaactgacattccatatagactcttcctttcatgcgtagttattcaccccactcatttattaaattgacagctttcttgagctaggtatagctagaggcctccttatcctctcactgccaacactaattttgcaaaagagaaggtgttatatgaagcgctgactgctatgaattgacagacaagatcacttttaaatgtctttatgggaagagtatgtaattcattctcattgatatgtgggggtaaaaaaaatccctgaagttgcaaacacacccaaaagggctcttgggaggtgagcaaacacatttaagtggtaactttacactctcaatgtgcaactcaacaaatatgagttgtcttaatacacactggatcttctgccctatagaggaaatcaacaggaagatttgggttagggtcatggcatccttaggggtgtcgcttcaccagcccaaaacctctgtgaccagcggcgcctttgtccaagttttgttcaagcctgctgggctcattcagcctacttggcccagtaggttgtgctcggcttgtgggatctgcccagatcccatacctgccaagggtgagcaaggtgcaaagcggcgaggggtgtgtgagtgagcactggggtctggccactgcacacagccaggcatgccggctgcagcagggtgggcagctccaggcgctggcaaaggcactggctttttgtggggtgggcagctccaggcgctggcaaaggcaccggctttgtgtgaggctgctggctggaccgggcataccacaaacggcttctactgtgggcactggggaatgcagtggtgcctggaagcttggcgatgccaggagacacagagccccaaagggtgtcacagccctggctcagggatcctagacctaagggcttcccaaagggccacagctcctctctccttctcatcacctgaacatggcaatcccggagtgtttcagccctggttatgttacaactgtttcagtcccgccattcagcaggtcccaagctcccatctcacctccaggaagaatgaagcacatggacaaccggagagcgagcaaggcagagaggagcttcactgagcaacataacaactcttaggagagccacagtgggcaccttctttctgcaggcaggtcgtcctgactagctgaggagacccaaagtgggtatctccttcccacagctggtaatcctgacgtctgtgtgagtctggcagagtctggggtttttaaggggtcagaagggaggaagtgcatgctgattggtctgtgggcagccatgggtgggcctggaaaaagctccataagttctcactttggtctacagactacccagaactgacagtctgacccccaggcctcaggctgtctctggattaaaggtggggtttcaccaaggatccacccctttctgcccaggaatctgtctgcctcccaccatcaacatgccctccatggcacccaggtaggggcacctgcagactcacactgagctgccctcagctcccctgccccagcctccctcccagagctcattgatgcacagagtttcagaggggttccaggcaggattggcatgtcaacactgccccaagcaggtgcatatggccagatcacaacagcacccaggctcggcttcaactttaaccttaaatctgggcaggcaccaggagtggggaaaggccagggagcaggagcaggcacttctgagcctgcaggggcaggggggcttcctgggccccagagagtgcagggatgtccaggtctggagccatggctaggcagcagcagcagcagctgcacctgcactgggaagtgtgggtctccaacccctttaacttggtagggggcggggctgccacctgttcctggcccctgccggctttgcacagtgtggggccctggccacacctgccccactgcagcatctgcctttgcagaggccacttcaggcagcctctgctgccattaggaccaaaaatagtaaaattcctctgagattatagttgagtggatttggggactttgatgatatacatcattgtcattctctatttcatttgtaactagatattattcagatgttaaattcaaaaaaatataaataacacattaaaagagtagtttcattaggtatatagctatattctttaaaatctcatccattgctataaattcatgcatttatgcattactctctagtttcttaacattcagcttgacatttccttttctattgacaccaataaagcccaatgcattttctgtataactaaatcatcttgaaaagagtttaaaacatgatacaaaaatgaaattgaaattgtcttttatagcttatgaataaattttgaatattccctttgtgctttgtgatttaggtgctgaacggctaaggtataaatagtacaccactactaggttcctaaaaagccgctttgatttgagatatatttaacttctacctcgaagacatagtttttatattggaagaaaatgttttttgctcctaggaaacttcagtattattctcatcacaagcttaacatgctatatctttcccaaagttggtgtatttcattgaatcattttaatgtgctctgactgaagaatatcaatatcactcttcagatgaaaggtggttccagtaatgcctgatgtctcagcatcatttgtaatacaaatgatggggagcctgtggcttaatggccactaatttattttgaatttatgatgcattgcagccattagtagtaagctgctttacatcagttcatggcgaataagagttctgtttgtggtaggttttatttcttgatgtcagatgagaaaatatgactatttcaaaaggaaaataaacccagtcctaaagtggaatcaggtcagaagtctaccagttctgtgtaacaatatatcatgcacttcactgtgccttatcataggtaactgtggggtatttttaaatgaaaaactgtagccctgctgcttttgcattatattaaaacataaatttaatatgcaatttccactggggttttttgaacactttattaatatatatttatcatgaaattttgcagaataagtaatatattataaattttatgttatgaagattgccatatatttaaaaacataccaacattagaataaaactaacctttcaaatggcccctaacagatataaattctctatgactttgataggaaaaaaggagaagcggaatgcatcattcaccctttaaagagatcaccatctacttgaggtaacaagattttggtagaaacattattttaatgtatggttttaataagaactcagggatatagttggtgagacaccatacaactgtgagagatttattcccatatctgagaataaaaggtatcagtggttggaaatatgagagcaagcctccagggacagaagcatcatggacatggctgagtttgagctggatcttaaagaaagagcaaaatattagcagaaacaacatgcacacaaagcacaatggaggcaaaataataaaaattgctagagagtgggtgttaaatcaaatggtttatctgagagaagagatttcataaatatgaaataatagaaaatagggagggcttgagtgaaatgctttaaatgaacaccaaaaacaaacaaaaacaaagtttttctaaaactaattttaaacaccatatccaaattactaactccagcagccactaaggtccattgtagggtgagttcttgtcttgagctaattttcactttggtcaggcatcactccaaggctggattggttcaggaggctacacttggtgactttccccactatcagctgctgcagatgctgtatttcccaccactgcagttaaatcattccttctaaacaacagactgggcagatgccactttaggaccctatcaaaataacttgaccacagatgaccagcctcgttggaactcactgcctaattctgcctagaaattaagacctcatcttaattatttagttcttcatctctttctagcctttgttactaaacaagtcctgatcatctgtcctccttatgcataacttcctccacatgctgaccaatgattctccaatgatttctagtcttgcattagcatgccttccaatccctcccactgagccctctgaaactgcttttccaagatatttcctgtcatctgttctctacaccctcagcctccatttcactgaacaattcctctgtttgcttatcctaagcaagccctgaggtcttctctgactgacttccaatatgcatattggagattgcatgttgttccacagcttttcaatggtgagtcacagacaccggctctcaagactcagataacatctgtgcttgtgctgtgaggcacagttgcagatggggaagggatctgcaaatgaggtacaaaggacatttagggtcagcatcaaacaggacatacaactcacctaatcctctccatgaggttatcttctttgagagaattttggcacacacctaaaagcctagataataataataaagaggctactcattatcttatgaaatcattgatgaattaaaattgaagatttataataagttaaaaatgccagtgtttgggttgattgcattgttgagaaagaggaatttcagaccagtttattagaattctaaggagtgatttttgcttagtaatggaccttttaaaatagtcagtccaatctctaaaacctctttcctcttgaaacatcattaaataattttactttaaactatgtcctcttaggcatttgattactaacaaaatgtttatgctccttaactgctttgactgcaataaaaagggagctgacttcctgagtaactgggtaaattgataggactttttctagattttctaatgtttaataccattgcttttatttgaaaagactggacttttggggggatgacttggactccctgtctttagattgtcctgactctagcctgtccctgttacacaattttccctagctctgaaccagtgttcctggccctagaagcacagttaaattaactgatacttggggtatggtcctgtttttatcctgtcaactcttataccaacccaacaaatggaatagttcctttcttctccaatggtttagcatatcagcttgcgcctgtaggtcactggtctaaactagagtacaccacacaaagagcttgtggattgcagagactgatactgctttgcctatacagtatgagataatgatccattctcctgttttatttcattatttggttgtttataagatttatattaaattatatccttaaagatctctaggctatgcattctcatggtgctttatcacagagatattgtacttataaaaaatgtattcacatcaactccacagcagatgtctggtctaaactattttgcccagcacgtataccacattggatttgggtggtttcagttttgatttggagaattgctttagcagtctatgtcacaccatcacaagaatgaaatctttctgccaaggaattattttatccataaaatatgcaactatactataagatttccaagatagaatacctcctaacaaaaacataattcttcaaagcgtatgtgtgaatgattgtgaaatacaagtacaaatctaaacttgtttccatatcaaactgagggctgggctgctatttctcgtggaccaataacaagatgcagatgaactggggaggaagagagtttttattttctgcaactggttatgggagaaggcctgtctattctgacatagaccaagtctctgtccttgtttccaaaatataaagtatttttcattcatcctaccctttgctggcatttcaacattttgcttgtcactaattttgactctttatcttaacaagggtttatggcagggaatagtattgacccacagatgagctttgcctcagagaaagaaaatgctaatgactgctcataggtgaaagactatgagcacacagattagctctcaggaaatttaacacttaggtacaaaagaatctcttgaggatactgatccttattaagagcagatttttgttttctatcctcaaagattctttttttttttagtttacatttttattaaggtcttcatgtttataaactattgctatttttaaatttatatcacttacccatttatctatggagaacttacagttctccaaatcaatttgtgcatggaatattatatattaggatgcaaactatttcactatggagctgggtgtaaatttttttttcatttatttatttatttattttattattattatactttaagttttagggtacatgtgcacaatgtgcaggtttagttacatgtgtatacctgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcggtgtttggttttttgttcttgagatagtttactgagaatgatgatttccaatttcatccatgtccctacaaaggacatgaactcatcattttttatggctgcatagtattctatggtgtatatgtgccacattttctgaatccagtctatcattgttggacatttgggttggttccaagtctttgctattgtgaatagtgctgcaataaatatacgtgtgcatgtgtctttatagcagcatgatttatagtcctttgggtatatacccagtaatcggatggctgggtcaaatggtatttctagttctagatccctgaggaatcgccacactgtcttccacaatggttgaactagtttacagtcccaccaacagtgtagaagtgtttctatttctccacatcctctccagcacctgttgtttcctgactttttaatgattgccattctaactggtgtgagatggtatctcattgtggttttgatttgcatttctctgatgaccagtgatggtgagcattttttcatgtgttttttggctgcataaatgtcttcttttgagaattgtctgttcatgtccttcacccactttttgatggggttgtttgtttttctcttgtatatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtgaattttggcttctgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtccaagatcagatagttgtagatatgcggcgttatttctgagggctctgttctgttccattgatctatatctctgttttggtaccagtaccatgctgttttggtgactgtagccttgtagtatagtttgaagtcaggtagcagatgcagaaaaggcctttgacaaaattcaacaatgcttcatgctaaaaactctcaataaattaggtattgatgggacgtatctcaaaataataagagctatctatgacaaacccacagccaatatcatactgaatgggcaaaaactggaagcattctctttgaaaactggcacaagacagggatgccctctctcaccactcctattcaacatagtgttggaagttctggccagggcaatcaggcaggagaaggaaataaagggtattcagttaggaaaagaggaaatcaaattgtccctgtttgcagatgacatgattgtatatctagaaaaccccaatgtctcagcccaaaatctccttaagctgataagcaacttcagcaaagtctcaggatacaaaatcaatgtacaaaaatcacaagcattcttatacaccaataacagacaaacagagagccaaatcatgtgtgaactccctttcacaattgcttcaaagaaaataaaatacctaggaatccaatttacaagggacgtgaaggacctcttcaaggagaactacaaaccactgctcaatgaaataaaagaggatacaaagaaatggaagaacattccatgctcatggttaggaagaatcaatatcatgaaaatggccatactgcccaaggtaatttatagattcaatgccatccccatcaagctaccgatgactttcttcacagaattggaaaaaactactttaaagttcatatggaacccaaaaagagcccgcatcgccaagtcaatcctaagcctatcctcaaagattcttatgcagttggtatcaaagtgccctttataccttggagcactttgagaaaccttacccagtgtgtttgtaaatgtggtgtcaggaggaacaaacttttcacagctgtcctggacagatgccagaaatttccccttctttgctcttagtgctggttagtcttaggaataacaggcttcctagggtttcttgtagatgctcattaaaaatagggcaaaaaatccagagatacagtgacgggttctgctcctttctttcagaaggaaatgaaaagcaagttatcgtagggatagcatgctaatacagtcaccgttttcagttaccaccattcttttcactcaattttagagttctttcaagaagcaaggaaacatcaatttgaatctgaagaaaattcacgggaatctctgaagccagccagtagttaaaagcaagaactttgtgctattggttagttgatttacagcttattttaggacagagaggaaaggagtgtgtgttcaatgttcactttgttgcctgccagtcctcctgttatggtagaagttatctgagttactggtggtgaatccatctgggtctgcagcaacctcaattcctgcctccccagaagaaataatttgactgaggggcataaggcagaaagagactgaggcaagtttcagagcaggagtggacgtttattaaaaagttttacagcaggaaagaacacttaaaagagatcctagcgggtgacttggggtgtttaactgtgatcctaggactttataggctggcatcttgcagccctttcccatgattcttcccttagggtgggctgctcacatgcacagtgccctccttgctcttgggaagtgagcatgagcagtctgtttaggaagttgcacacatgtgcatctgaggctttcttcccttttctggtagagtgcccctggaaagtcatattccaacattttgtctcttaatgctcatgtccaggaacttgcttctccctggcacttgcattctattaacactttaatgttaacagctctggatcatcaggaaattgtctctccctggtggcctaggtggggctgctgaattatcatttttaaagaggcagtgtgataattgtcaaaccaccacctaatattcctagtggatgtgggagaaaagcccactcttgccctgttcatgcctaacaacctgtaacactccacagtgtccctaaatgtcaacctaggaggaaagtgagaaatcacagtggagatgggaaaatcaagtgttctgcagtttaaagagaaattaaaggcaaggaaaaatatcctaatgaaagctgttgaaaatgtatagagaggtttgaaacaatcaggcatctgtagataatggtcctgatctaaaagataaacccaaagaagagaaacacttatcaaaatgaatttctctagagatattttaggctctgctgaaagtaaggatggggaattaatgatattcttgggctacatctttatcaatatctttatcagtcaatatattttgaagattctctttccttcagcatgtttttcctctctgtataaatccatgcacagttaattttcttcataatttcatgttttagtttggttttattactagagctacattattggaagtttaagaaaggatcttcccacccacaagaaattgcatgcatctgtaaattgtcaaaaaaagtagatgactcagtgcacagaaattattctgacaaagaagaaaccactctttcagaacttaattatgtataatgctaggctgcagaagaagcaatgcttgaggtaccagagggaaaatgcatatgaatatcagttactcaagggactcatcatgctgtttcactgataattagtcatactgtttaaaaagagaaatttaggatgccggcactaaagaaagaggctagagtaattactgaggagtcagaacaaaaggcaaactttgtaaattatttacctataaatcaaaacatcgtttttctacattaatatttttggacttaagaaaatacttgtaaaagttatattgacaaaagatcatttaaatgcctttgcatttaaaattcattctgataatttgccatctctaaattagagaaaaggatacaacatcataatcttacatgacatgctttgcatttttagcatttatataaatcctttaaaatataaactccttaaaggcaggcatcataactatcttgttcatcataatccctgcacatagcctgaaagatgctcagtaaatatgtggtgagtaaaggaatgaacaaattttttcacttgtattgttgtaaaaattgtctaaatcaattttcaagtaaattaagactttaacaaatttttattaaacaaattaaatatatttagaagctactacatccaaatattacatttaaatgtgtacaattgatacataaattttccaattacatatcaatttctaattttgaaaatgaggaatttttatactgaacttacaataatcttaagcacataggatttgcaatgaaaaagacttagattcaaagcctggctctgtaatttgttcagtcacaagaacttaacttttccaagcttccatttccaaatctgtagaatatgagttcaactatttaacttacagtcttactgagagaaaatgaaatactgaatgaaagtcacttagtggagtacttgtaattcactaaaactcactgttgaaagttattattaggatgttttctatatgagaaacaaaaaaagattcagtttaaacaaaatgcacatatattatcttgcgtaagattattgatagggactggaggcagggaaattctgagcagaagagggcgagtcccctggcaagtgccccaccctcaagcctggaacagcagcccaaaatgagaacatacatttcttttttcccactggaatgttgccttttccaaaaccacccataaccccccacccagcacccccatcccatacccataaaaaccctaggctctgctggcagagaagaggagaagcagctggacattagagattatggttggacgtcagagagaagcagcttgacttcagagtgacggcttgacaatgttgcttcaaagaggagtccagcggggaaggctggactctgggggaagcttatcttccagttccattccctttgcagctccccttcctgctgaaagccactttcattggcaacaaaatcctccatattcaccaaccctcaattcattcgtgcaacctgatttttcctggatgctaaacaagagctcgggtgccacaggtgcagatgctaaaggctatcacactgaccctctgccctcactggcagagagcacccacctcatgcaaaaaggcagagggcccactgagctataaatacttaagccgtctgtggacggcaaaagctaaaagagtgctgactgtaacacatgccctctgaggcttcggcgatagcaggcacctcctagacactgctgcagggccctggatggagattggtctggccagcacccaaaagcgcttgccccaactcctgtacccactcatctgtgcactccctcttgcgaggggtgaaatgtaatgggtcccagtgagtggagtttgcccctgccagtgctgaagtggccggctacatccagtgcccatgtactctagatccccccatcaaaggtgtcagggaaacttttctgcttcattatgagagcctcatctcattgaattgagaggtagggtagaccctaaggttagttgattctggagttcaaggatgtcatcagaaaccaggtatttacacccctcccctcatctccctcatcaccttcatccttagactgcttctctttatgattataaaatggctgccaggagcaatcagacaatatgctgtctttttcatatctgaagaaaacagaaacaaaatttgtcttccttaccctcaaagccctaaccaagtctattctcgcattttattcactcaaatgagtttaggtctaaccattcccataaagtattagcaaaagaatgaggtcattgtcactggcatagagtcctattgggttgggaatggatgttggagaatcaagcatagtatccactataatgatgataatgacaatggggatgatggataattgccctatgaattgatacaaaagtagtaaaatttcaagttaagatttaaatcaacaaataatagaagaaactctgtacataggcactgaagtagaaattcaatgggttggtcacaaaacacacaatgaatgacaaaaaataattcacattctacctcaggagacagaagtatcagaatcaaagtaacatgccataatatagaactgtggcaattatgatacacgcacacataaaaaaggagatattcttcctggaaggtttagaaggtgtacatagaggttatatttaagattaattttgaaattcttatagacatttcttatgtctgcaaaaaaggcatattcgtcagaattacactgaaagcactggaagactaggaagtttaattatcttttgttcattctgtatcatcagtgcctagagctatgtttaaaacatagtgggtactcaatatttataagaatatgaacaacattcacaaaggtaatcatgaaagaatggaaaacataaagtgaaaaattgtgaagttgaagacaggtcacatgatgaatgggacatgtcttattttaaagtatttagcctttattctggagctaatagtcaattacgggttttaaaaaggagaaccataatcaataatatgctttttgaaagatcactcttggttacttctttgtgtccagtaaaaggtcggatgaacttcaagtaaggaaacagcaacaaggagaaaagaaataactgtcttcgaagtatatttagaaaacagacttgtcagtactttgtaattaatttgatgtcaaatgtgaagcacaaggagtaatctaagatgatgtctggctttcaggcttgattgaatggatagtgatgtctaccaatgaaatcagcaatacaagagccaaagcaaattttatttcagggcatgaattaaacaatatatatgactcagtttattttgaggcatcagtgacatgagcacctgaaaatgctagaaaggtcttgtttgtcttgtcctacaatcagaaaagagttttaatctacaatttttaatttggtacccaccaggtagtcaaagtctaaagaaaacttagaaagtgagatgagaagatggcttcacatttaacgttgagctgagcaaaagtagactctgagttaatgttaactccctcaagaacatctttaatagtaccccagtttggttcaagctatgttagcattccaaataggctgtcctctcatgcatctgaacccagcagaaaattattttatcttttccttcaaagaatattgacaaagtaacagcaacataattaagaaatttatggatgaggatgtccttgcaatatgatccctaccccctcaaagtcagaaaggcaatagtgtgtttttttactgttgtttgtatgtatgtgtttttgcttttgtgacaggatctcactctgtcatgcaggctggagtgtagtgacgatcatagcttgctgcagtctcaaactcttgagctcaggcaatcctcctgcctcagcctaacgggtagctgggactacaggtgtgcacccccatgcctgtctaattattttattttagtagtgacagtgtctcaccgtattgcctaggctagtctctaaatcctgtgctcaagagatcctcctgcctcagactcccaaagagctggaattacaagtgtgagccagtgcacctggcctattgtgttctaaaacaaatgacattttactaccaagaactggacatgcatacatatatgtgtatacatctaatgatatagttatatgaaagaaaggcattaaaaattaagttactatttaagcagaaagttttacaattattagactattataataaagttattatgttgtacatttcaataaaatcattaaataactctaaacaacaacgaaattgttatttaatgcaaaattcaaaatatattgtacagaaaatagtataatgtattaagggtttcaaattaaaaaattataaaatatttttctaattaattgtttttaactcttttctaataaataaacatttgattgtatcattcttttcctgatccccaccacatatctagaacttgtgatcttaacttcttctttcaggccaaatggagggaaacaatccaggaagaggagcacataggaggcaccataagtgaaagggtgcaattgtctagctcacactttttaaagcaaacaatactgtcaaacaggttgaatccatttgcagactctaaccaattatttgagcagttctttctctctagccctagactaggtaatgggtagggtatgggttgtataaccggaagctgtgtaagcagaggcaaccttagtgtaagaagaaaaagtggatcttatttgtttaataattgcaaaactctttcccatatattacttcacttgatcctccaacacggatcctacaacaatctgtgaagtagtctagataccattaatcataaaaacagaatcataggccacgcgctgtggcacacacctgtaattccaatactttgggaggccgaggagggcagatcacctgaggtcaggagtttgagaccagcctggccaatatggtgaaaccccatctctactaaaaatacaaaaattagctgggcatggtggtgggtgcctgtaatcccagctactcggaaggctgaggcaggagaatcgcaagggttaatcgagggattggtagaagtggagaggcgtgggtcaaaggatacaaaattttagctagataggataggattttagctacaaatctattataaaaagttaaattttatcagaacttatgcacaggaacccttacagacgctacaggccaccatccacagtgcagaaaaatgtaaacaaacataaggacacggtataaaatcaagctgcctgaaattaactgtaatacatactgtactactgtaataattttgtagccatctcctgttgctactgtgctgggctaaagtgttgtgtcatgcctaaaacatgtgtgacacttatctctatgtgagcggttctttcctctagtaaattatcacaataaaaaatgggctctcagagttcttgcatattttgtatcatgtttcgtgcaataccataaaccttgaataacaccacgggacccatacaaagttgaattgcttgatatgtaccatagactgaagtcggctactgtagctgcctaccatttcaagataattgaatacagcaaaaatactactgtaagaaaataaaaggaaatttatgaaatttttgttgcagactctgccaacaggtgtgaaaaccttacactttttgcaaactacctttttatcttgtattgaaaatgcagcttttatgtaggttcgggattgctataagacttacctatagatatgcactttaatatgatttgagaacaagcaaatgacaacttaaagtaaaagctaaatgaaatatctaaatccagagtatttaataccagcaaactgtggtttgataattttaagtagagatttggctttaaaaaatgtcacgataacaggagaagcagcttctactgaccaaaaagcagcagatgacttccaagacatcactgaaaaaatcattgagaagaaatgacatctgcctgaacaggtttttaatgcagacaaaagtacactagtttggggaaaaaaatgccacaaaggaaatttattagtaaggaagagaaattagcattgagaatttaaggtaggaagggacaggctaactgtactgttttgagcaaatgcaatttatgattaggactgcccttatctacaaaggcgataactcctgagttttgaagggacaagatcaacaccagctgccagtctttttgctgtacaacaagaaggcctggacaatgagaaccctttttctgtattggtttcattgatgctttgtgcctcaattcaggaagtaccttgccagtaagggctgccatactggcagtttttttgatattggataatgaccttgaccacccaaaaccccacgaattcagtgccaaaggtgtcgaagtggtctacttgcccccatacacaaaatatctcattcagcctctagatcaggaggtgaggtcatagcacctttaaggctcattacacatggtactctatggaaaaaatggtcaacgctgtggaagagaacctctatatagagagtatcatggatgtttggaagaattacacccttgaagatgtcgttattgttatagaaaaagccatgaaagtcgccaagcttgaagcaataaatttctgctagagagaagatgttttgcaagacttcacaagatttatgatagagccaatcaaagaaatcatgaaagagattgtggatgtggcagaaaaggttggaatgtaaaggacttcaagatatggatcttggagaaattcaagagataataaaaatcacaccagagtaattagtagaagctgacttgatggagatgaaagtttccaaaccagcgccagacattgaggaagaacacatagaagaagcagggcaatggggaaagcattccctatttaacaaatggtgtggggaaaactggcaagccatatacagaaaactgaaactggacctcttctttacaccttatacaaaaattaactcaaggtgcattaaagacttaaatataagactttaaaccataaaaaccctaggagaaaacctggacagtaccattcaagacataggcataggcaaagacttcatgactaaaacaccaaaagcaatggaaacaaaagtcaaaattgacaaatgagatctaattaaactaaagagcttctgcacagcaaaagaaactatcatcagagtgaacaggccacctacagaatgggagaaagattttgcaatctatccatccgacaaagggctagtatccagaatctacaaagaatgtaaacaaatttacaagaaaaaaacaaccccatcaaaaagtgagcaaaggatatgaacagacacttctcaaaagaagacatttatgcagccaagaaacatgaaaaaaagctcattatcactggtcattagagaaatgcaaatcaaaaccacaatgagataccatctcatgccagttagaatgacgatcattaaaaagtcaggaaacaacagatgctggagaggatgtggagaaataggaacgcttttacaatgttggtggaagtgtaaattagttcaactgttgtggaagatggtatggcgattcctcaaggatctggaactagaaatacaatttgacccagcaatcccattactgggtatatacccaaaggattataaatcattctactctaaagacacatgcacttgtatgtttactgtagcactgttcacaatagcaaagacttgcaaccaacccaaatgcccatcaatgatagactggataaagaaaatgtggcgcatatacaccatggaatactatgtagccataaaaaaaggatgagttcatgtcctttgcagggacatggatgaagctggaaaccatcaatctcagcaaactaacacaggaacagaaaaccaaacaccacatgttctcactcacaagtgggagttgaacaataagaaaacatggacacagggaggggaacatcacacactgaggcctgtcggggggcggggggctaggggagggacagcattagaagaaatacctggatcgctggagccaagatttgctggagccaaataggaacagctccggtctacagctcccatcgtgagcgacgcagaagacgggtgatttctgcatttccatctgaggtactgggttcatctcactagggagtgccagacagtgggctcaggacagtgggtgcagcgcaccgtgtgcgagccgaagcagggcgaggcattgcctcactcgggaagcgcaaggggtcagggagttccctttcctagtcaaagaaaggtgtgacagaggcacctggaaaatcgggtcactcccaccccaatactgcgcttttccgacgagcttaaaaaacggtgcaccaggagattatatcctgcacctggctcgtagggtcttacgaccatggagccttgctgattgctagcacggcagtctgagatcaaactgcaaggcggcagcgaggctgggggaggtgcgcccgccattgcccaggcttgcttaggtaaacaaagcagccaggaagctccaactgggtggagcccaccacagctcaaggaagcctgcctgcctctgtaggctccacctctgggagcagggcacagacaaacaaaaaagacagcagtaacctctgcagacttaaatgtccctgtctgacagctttgaagagagcagtggttctcccagcatgcagctggagatctgagattgggcagactgcctcctcaagtgggtccctgacccctgacccccgagcagcctaactgggaggcaccccgcagttggggcagactgacacctcacacggccgggtactcctcttagacaaaacttccagaggaacgatcagacagcagcattagcggttcacgaaaatccgctgatctgcagccaccagtgctggtacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccataaagatggggaaaaaacagcagaaaaactggaaactctaaaaagcagagcacctctcctcctccaaaggaacgcagctcctcaccagcaatggaacaaagctggacggagaatgactttgacgagttgagagaagaaggattcagacgatcaaaccactctgagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacgtgaaaaatgcagaaacctcaggagcggatgtgatcaactggaagaaagggtatccgtgatggaagatgaaatgaatgaaatgaagcaagaagggaagtttagagaaaaaagaataaaaagaaaggagcaaagcctccaagaaatatgggactatgtgaaaagaccaaatctatgtctcattggtgtacctgaaagtgacagagagaatggaaccaagttggaaaacactctgcaggatattatccaggagaacttccccaatctagcaaggcaggccaacattcaggttcaggaaatacagagaacgccacaaagatattcctcgagaagagcaactccaagacacataattgtcagattcaccaaagttgaaatgaaggaaaaaatgttaagggcagccagagagaaagatcgggttacccacaaagggaagcccatcagactaacagcggatctctcggcagaaactctacaagccagaagagagtggaggccaatattcaacattcttaaagaaaagaattttcaacccagaatttcatatccagccaaactgagcttcataagtgaaagagaaataaaatactctacagacaagcaaatgctgagagattttgtcaccacaaggcctgccctaaaagacctcctgaaggaagcactaaacctggaaaggaacaaccagtaccagccactgcaaaatcatgccaaattgtaaagtccatcgaggctaggaagaaactgcatcaactaacgagcaaaataaccagctaacatcataatgacaggatcaaattcacacataacagtattaactttaaatgtaaatggactaaatgctccaattaaaagacacagactggcaaattggataaagagtcaagacccatcagtgtgctgtattcaggaaacccatttcatgtgcagagacacacataggctcaaaataaaaggatggaagaagatctaccaagccaatggaaaacaaaaaaaggcaggggttgcattcctagactctgataaaacagactttaaaccaacaaagatcaaaagagacaaagaagaccattacataatggtaaagggatcaattcaacaagaagagctaactatcctaaatatatatgcacccaatacaggagcacccagattcataaagcaagtcctgagtgacatacaaagagacttagactcccacacattaataatgggagactttaacaccccactgtcaacattagacagatcaacgagacagaaagttaacaaggatacccaggaattgaactcagctctgcaacaagcagacctgatagacatctgcagaactctccaccccaaatcaacagaatatacatttttttcagcaccacaccacacctattccaaaattgaccacatacttggaagtaaagctctcctcagcaaatgtaaaagatcagaaattataacaacctgtctctcagaacacagtgcaatcaaactagaactcaggattaagaaactcactcaaaaccactcaactacatggaaactgaacaacctgctcctgaatgactactgggcacataacgaaatgaaggcagaaataaagatgtcctttgaaaccaatgagaacaaagacgcaacataccagaatctctgggacacattcaaagcagtgtgtagagggaaatttatagcactaaatgcccacaagagaaagcaggaaagatcaaaaattgacaccctaacatatcaattaaaagaactagaaaagcaagagcaaatacattcaaaagctaggagaaggcaagaaataactaaaatcagagcagaactgaaggaaatagagaccaaaaaaacccttcaaaaaattaatgaatccaggagccggttttttgaaaggatcaacaaaattgatagactgctagcaagactaataaagaagaaaagagagaagaatcaaatagacgcaataaaaaatgataaaggggatatcaccaccaatcccacagaaatacaaactaccatcagagaatactacaaacacctctacgcaaataactagaaaatcttagagaatgggataattcctcgaacgtacaccctcccaagactaagcagggaagaggtgaggtctgcgaatagaccaatggcaggctgtggaatggtggcaataagcaaaggctggccaaccaaaaagagtccaggaccagatggattcacagccgaattctaccagagggacaaggaggaactggtaccattcttagggaaagtattccaatcaatacaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaaacgaatccaccagcacatcaaaaagtttatccaccatgatcaagtgggcttcatccctgggatgcaaggctggttcaatatacgcaaaccaataaatgtaatccagcatataaacagaaccaaagacaaaaaacacatgattatctcaatagatgtagaaaaggcctttgacaaaattcaacaacacttcatgctaaaaactctcaataaattaggtattgatgggacatatctcaaaataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggggaaggaaataaagggtattcaattaggaaaagaggaagttaaattgtccctgtttgcaaatgacatgattgtatacctagaaaaccccattgtctcagcccaaaatctccttaagctgataagcaacttcagcaaagtctcaggatagaaaattaatgtacaaaaatcacaagcattcttatataccaataacagacaaacagagagccaaatcatgagtgaactccctttcacaattgcttcaaagaggaataaaatacctaggaatccaccttacaagggatgagaaggacctcttcaaggagaactacaaaccactgctcaatgaaataaaagaggatacaaagaaatggaagaacattccatgctcatgggtaggaagaatcagtatcatgaaaatggccatactgcccaaggtaatttctagtttcaatgccatccccatcaagctaccaattactttcttcacagaattggaaaaagctactttcaagttcatatggaaccaaaaaggagccctcatcgccaagtcaatcctaagccaaaagaacaaagctggaggcatcacgctacctgacttcaaactatactacaaggctacagtcaccaaaacagcatggtactggtaccaaaacagagatatagatcaatggagcagaacagagccctcagaaataacgctgcatatctacaactatctgatcttggacaaacctgacaaaaacaagcaatggggaaaggattccctatttaataaacggtgctgggaaaactggctagccatatggagaaagctgaaactggatcccttccttacaccttatacaaaaattaattcaagatggattaaagtcttaaacgttagacctaaaaccataaaaagcctagaagaaaatctaggcattaccattcaggacatagtcatgggcaaggacttcatgtctaaaacaccaaagcaatggcaacaaaagccaaaattgacaaatgagatctaattaaactaaagagcttctgcagagcaaaacaaactaccatcagagtgaacaggcaacctacaaaatgggagaaaattttcccaacctactcatctgacaaagggctaatatccagaatctacaatgaactcaaacaaatatacaagagaaaaacaaacaaccccatcaaaaagtggacgaaggacatgaacagacacttctcaaaagaagacatttatgcagccaaaaaacacatgtaaaaatgctcaccatcactggtcatcagagaaatgcaaatcaaaaccacaatgagataccatctcacaccagttagaatggctatcattaaaagtcaggaaacaacaggtgctggagaggatgtggagaaatagaaacacttctacactgttggtgggactgtaaactagttcaaccattgtggaagacagtgtggcgattcctcagggatctagaactagaaataccatttgacccagccatcccattactgggtatatacccaaaggactataaatcatgctgctataaagacacatgcacacgtatatttattgcggcactattcacaatagcaaagacttggaaccaaccgaaatgtccaacaatgatagactggattcagaaaatgtggcacatatacaccatagaatactatgcagccataaaaaatgatgagttcatgtcctttgtagggacatggatgaaattggaaatcatcattctcagtaaactatctcaagaacaaaaaaccaaacaccgcatattctcactcataggtgggaattgaacaatgagaacacatggacacaggaaggggaacatcacactctggggactgttgtggggtggggggaggggggagggatagctttaggagatatacctaattctaaatgacgagttaatgggtgcagcacaccagcatggcacatgtatacatatgtaactaacctgcacattgtgcacatgtaccccaaaacttaaagtataataataataaaataaaataaaataaaaaaagaagaaatacctaatgtaggtgacgggttgatgggtgcagcaaaccaccatggcacgtgtatacctatgtaacaaacctgcacattctgcacatgtatcccagaactttaataataataaaaaaagaagacaaagtagttccagaaaacaaattgacattagataatctgacagagggttctaattattcaagactgcttttgatttttttcatgacttgcactcttctatgatacaggcactggaactaaagcaaaatggtggaagaagattagtactctatagaaacatttttagagaaatgaaagtgcaaaaatgtcagacagaaatttctgtgtattttcacaaagttacaccgtgtgcctgcctctcctgcctctcctgcctccccttccacctcctccacctcttccatctctggcacccctgagtcagccagaccaacttctcctcttcctcctcctcctcagcctacttaacatgaagataatgaggattaagacctttttgatagcccacttccactccattaatagtaaatatactttctcttccttatgattttcttaattgcattttctttttgctagcttcagttataagaagacagtatataatacatatacaaaatgtgcgttaatctattatttatgttatcagtaaagcttccagagtcagcagaaggctattagttttttagccattttagctattagttattttttgttaattgacaaataagtattacatacaattcacccttgaacaacacagggtccaacacaagggttagggggaccaatcctccatgcattcaaaactgcatacacagagtgtgttgttcaagggtcaattgtatgtaatttttatttgtcaattaacaaaaaaaaattagaaaaaaactataccatgctttactgtacacttaaaaatttgttgagactagatctcatgttaagtgttcttaccacagtaaaataaatttttcagaaagattttagaaaacttaggaataattattagattttaatttattaaaggatattctatattttccagcagatactgtattttctcatatgctacttcctctacaaaggaagatgggaacaatttacatttaaatgttaaaactttgtttttaatgaaactagcatgaggtatcctcaaaaaggggagtagaatctctacaacagatagcataattattatagggtatttattcaatcataataattcataacacaaatagaataaaatgataatattgatgtaaaaaaataaagcagggagaaacaaaaaaagagatagacccagcagaatgtgaatggaatcataatgattaccagtttatatgtacataatatgtatttgagaagaatgtgtaaaccactgtctcatatgattggcatttctataaatttaacaaatttcttaactatgataattatttattgttgctacagtaccacatgcacatctctgtgccactttgttttaagataagtctgtaattcacagtgaactggttcttgggcatcaatttatgacaaattcattttcatttgtcagatagctttaggataacattattttaatgcgtgtatgtattgtttcatctccaagtcttgttgccatttttaagggctgtcagctgtattacataatttgatatggaaaatattttgggtcaatcattagtcttttttatgagtcttctgtatggactttttttctatttaaggaaagacatgtacattctgaaactggacatatattattaatctactactacatatactaatctaatctgatgactactgagtattttaataataaccatgtaacttggaacttttatccttcagaattatgaaagtaagcatatattttatagtatttagggtagagtgtgacgaagtatctagcatagtagttgagttaaaatcaatccatctttctatgtgcctatctacatagctgcacttttatctgtctgttaaagtctgttctttatataccattggaaacattcgagggtcattaaaataggaccccattttcttgttcactgaataagatttacttcatatttatgggcatttttcttaaaacctcttgacaatagttagggatgcaaagaaacatggtaaattatatccttgaagttcttattttgtcggttatttgccagatacttttaattttatcatttgcctttagaatacagttttttatttacgtcccaatgtttctttacagattactgaactatgaaaaacaatatttatatttcaagaaaagtaacagtcttattaatgaatgtaaatagacatctttcttgtgatttatgttattaaggcacaatagtaaatattttataaaatatttgtaggctgtatttgagataaattcaggggaaaatattttatttcagaatgctctgatgctctgcctctgagatatagaacaatgcagtggtgtgtttaggataacttatgcaatattaaaggctatcttttctgtggaattatttttggtcagttcctataaacaatcttttttcttccttaaattgcacaattaactaatattagcatgacattttaaacctagcaattatgtttttctaatgagatttatgtgtagatcaaaaatagatggcctctgatcttcatggccatagagaaaataaatatgtttcttgtgaacaccctggaattttcccagttttatggatcacattaatttaaaaatctatcatagatcttagtgtctgagaaatacacagaaactatacccgttattacaagaacaaaacaattcaaactcggccttgtgaaactaaaataaatctaaacttgagacttttatgtagagtgcagacaaaaagcattggcatttccaggaataaatctagattttattccctctaaaaattataccatttgggaaaaactgtttgagaaagaaaaatatgaatgttgtcttacctttcaaattttattaagcttatgaccatgtgaacacatctctaggtcctcccaggtccttggaagtgacctataaaagtgcagggctctggagattaagctgcatttcatagtaaactcacaatcgcatattcagtaatctctccttatctgtgggagatatgttctaagaccctcagtgatgacctgaaatcacagataatactcaacactatatgcccttaaaataggcacaagaagagattaacaacaattcataaaaaagaacaataatatactttagtaaaagttacgtgaatgtggtttcttattctcaaaagatcttactgtactatacttgccttttttcttcttgcaatctgttaacctgataactaagagggctgctaagtaactaatgggcaggtaatctatacagcgtgaatacacagggcaaaggaaggattcacatcccaagcaggttgaagcaggacaacacgagattttatcatgctactcagaacagtgcacaatttaaaacttatgaattatttatttctggaattttccatttaatatttttggacctttgttgaccacaggtaactgaaacgctgaaagtgaaaccttgggtaagggggactactgaaataaaaagacatgaagcaaggagcagattggttaatcgtttcattgttgttagtgaaatatatcgtaacattgtgcatggattcttctgttaaatattaaaccacgtgtattttttaaacaactagtcttcaaatactttaaatatttaaaaaatcacgtcttgacaatatgatatttaattgaagaagttactgcaaaatgtacttgtgtttacaggtagaatatttgaaagctttttgatcttcacatccttgaggattcagtgcagctttactcaatcaggatcatgcctaggtacatgaaactgtattgttaaatacttggttgataagatttagatttcttttttcatcttctgttttagaagcatttatattctcttaaagtctgatggttaggtttctaacttttccagtatttggattggtaaatgtactacttaagttacataaatgctttattattggtaatggcacatataaaatctcaatgcatttatatgactctctagtaatttgttatacaaagagtacagaaaacagtgatttaccatagactattgtttacatctgaatctatttgttcaactcttttattaccattgccttgtttggctcatataaattttatttaatttttctttctaactaatcacaatgataccaaattgtagtatatagttttatttgtagcatagattgctctctaaaaatatgtaccatgagtacatgtgtaaatcaatgaacatcaacttaaacagtagctatttcatgtgaactacacacattcttgtcaagaaacaggagtaaatggctgaggcccaggcataattccttggaagtgacaatgccaaaatgcccaaggaagctcttggcagggctactcatttgttttcacatatttatctatttgttcccttggtttcaaggctttaaacagaaattcagagcattttcatggtatctgggcatcattacaatatttactaaaagagaagtcctaaacatggtcattttatgggagaaatcagtagcacatggtgtttatgcaatgttatatatgattttactcattatgccaactgtattaaggggattccatctttctttgggccctcatcaggctaccacgatatacaatgagtggtatacttaagctctggctgaattgttctgtaatgtaatctgactcaaggagaacaaatggagagggtctttgtcattctactgtgtcatgtgaattttctctgtttctggagtctaagttgttctgtttttcacctgctatttgagaaattttttacaattttcgtgtcataagccagaatgcaatgggatgaatatggagcctttctttttatacactctcttgaaactcttcatgaaaagctttcttattgaattgtttcattctagcttgaatatcgaaatggaatgtgttacgataaattcataagtacgtttctattattatactatttatatagttatgacacattgtgaattgaatgaaaggtcttataaaattctgaaaagctgtgctgttgcttgtgtattatttatttatatctctaaaattatccactgactgcaaattgtccgtaagggacatattcaatgtaaaacaatcattcccagaactaaaaaaggtctaaaaatttcttttgaattttctttctactacaaatttttgcataagaacagaaacagtaacttctttctaaaacaacaatggaatctcaatatcaaaattagtctggttaagtacagcatgactgtaggcctagctgcttgggaggctgaggtgggaggatcacttgaggctcagagtttgaggctgcagtgtactataatagtgcctaggaacagccactgtacttgaagctggtcagcataatgagaccacatctttctcaaaaaaaaaaaaatctgatgctcagtatcaatcatttaaaaataaatgaatgaatgatcatgggacagaaaaatgataaattctgtattcaatctacatttgaacttatatttttgttacatctctgcaaattattttcatgggtttaagtatttttaattcattttatttttatttgcaaaaacattgcacatacatctaatttttaaaaattttctgggatcataagactacatggttaaaatattctattatacttttatagcagattcaatcaaaataagataattactgaataaaatgtaaacattgactagaaatgtcccttttaatgaaatcaataggcatcctgtatatctatagatgaataatttttagtgctagttaagcagatacaggtttttgtctcaattatatttctttcttggtttttcttggtttttaattgaggtacgtgctgagtaacttgttcacataataaagtagatgacagtggaaagtattttattttcagtattagtcaattatttgaacttgccaaaaatcacataatgatttattatcaaaaattatttgtaatgatctgtggactgacaattcacttgaatcttccctcaatattgtgaagagcagaaaattggaaaccatctgattaacaaaaagattatttctagtcaataaacttagcatttctgagaagtgtctcaaaaacatttaccaaaacttaaaaaatgaaaataactatactgcctttttatcatttagaggcaaaaaatcaaaaaattaaaatacaggtatacttctacttattgcatttcactttattgcactttgcaaatactgcattaattacaaattgaaggtttgtggcaaccctgccttcagaaactctgttggcaccatttttcatgacagcatgtgctgactttgtgtcttgtgtcacattttggtaattctcacagtatttcaaactcttattgttattatatctgttatggttatctttgatgttgctattataattgtttttgggtgccatgaactgtgcccatataagagggtaagtttaatgttgtgtgcattatcactactccatagaccagctgttctgctatctctccccctctcctagggcctctctactgtctgagatacaacagtattgaaattaggccacttaataaacctacagtggcttctaagtgttcaagtgaaaggaagagttgcaagtctctcatttgaaatcaaaagctagaaatgattcaccttaatgagaaaggtgctgaaagcacaggctgaaagctaggtgtctagcactaaggttagccaagttgtgaatgcaaaggaaaagtgaagaaagttttagaagtttggatacaagatcaaaccacccacaacattccctaagccagagcctaatccagagcagggccctaactgtcttcaattctactgaaggtaaggaatctgcagaagagaagtttgaagctagtacatttttttgtttttgttttttattattattatactttaagttttagagtacatgtgcacaacgtgcaggtttgttacatatgtatacatgtgccatgttggtgtgctgcgcccattaactcgtcatttagcattaggtatatctcctaatgctatccctcccccctccccctccaccacaacagtccccggtgtgtgatgttccccttcctgtgtccatgtgttctcattgttcaattcccacctatgagtgagaacacgtggtgtttggttttttgtccttgcgatagtttgctgagaacgatggtttccagcttcatccatgtccctacaaaagacatgaactcatcattttctgtggctgtataatattccatggtgtatatgtgccatattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggattgctgggtcaaatggtatttctagttctagatccctgaggaatcgccacactgtcttccacaatggttgaactagtttacagtcccaccaacagtgtgaaagtgtttctgtttctccacatcctctccagcacctgttgtttcctgacttttaatgatagccattctaactggtgtgagatggtatctcattgtggttttgatttgcatttctctgatggccagtgatgaagagcattttttcatgtgttttttggctgcataaatgtcttcttttgagaagtgtctattcatatccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttgttttgctgtgcagaagctctttagtttaattagatctcatttgtcaattttggcttttgttgccgttgcttttggtgttttacacatgaagtccttgcccatgcctatgtcctgaatggtaatgcctaggttttcttctagggtttttatggttttaggtctaacatgtaagtctttaatatatcttgaattaatttttgtataagatgtaaggaagggatccagtttcagctttctacatatggctagccagttttcccagcaccatttattaaatagggaatcctttccccatttcttgattttgtcagttttgtcaaagatcagatagttgtagatatgtggcattatttctgagggctctgttctgttccgttggtctatatctctgttttggtaccagtatcatgccgttttggtgactgtagccttgtagtatagtttgaagtcaggtagcgtgatgcctcacagctgtgttcttttgacttaagattgacttggcaatgcgggctcttttttcgttccatatgaactttaaagtagttttttccaattctgtgaagaaagtaattggtagcttgatggggatggcattgaatctataaattaccttgggcagtatgcccattttcatgatattgatcttcctacccgtgagcatggaatgttcttccatttgtttgtatcctcttttatttccttgagcagtggtttgtagttctccttgaagaggtccttctcatcccttgtaagttggattcctaggtattttaattctctttgaagcaattgtgaatggaagttcactcatgatttagctctctgtttgttattggtgtataggaatgcttgtgatttttgcacattgattttgtatcctgagactttgctgaagttgcttatcagcttaaggagattttgggctgagacattggggttttctagatatacaatcatgtcatctgcaaacagggacaatttgacttcctcttttcctaattgaatgccgtttatttccttctcctgcctgattgccctggccagaacttccaacactatgttgaataggagtggtgagagagggcatccctgtcttgtgccagtttttaaagggaatgcttccagtttttgcccattcagtatgatattggctgtgggtttgtcatagatagctcttattattttgagatatgtcccatcaatacctaatttattgagagattttagcatgaaggattgttgaattttgtcaaaggccttttctgcatctattgagataatcatgtggtttttgtctttggttctgtttatatgctggattatgtttattggtttttgtatgttgacccagccttgcatcccaggcatgaagcccacttgatcatggtggataagctttttgatgtgctgctggattcgttttgccagtattttattgaggatttttgcatcaatgttcatcaaggatattggtctaaaattctcttttttggttgtgtctctgccaggctttggtatcaggatgatgctggcctcataaaatgagttagggaggattccctctttttctattgattggaatagcttcagaaggaatggtaccagttcctccttgtacctctggtagaattcagctgtgaatccatctggtcctgggctttttttggttggtaagctattaattattgcctcaaattcagagcctgttattgatctattcagagattcaacttcttcctggtttagtcttgcgagggtgtatgtgttgcggaatttatccatttcttctagattttctagtttattagcgagattgcttctttccttaaacgtcatgaatcaacatttactagcttctagtatgcaaataaactagaagctagtaaatgttgattcatgaggtttaaggaaagaagccatcttgctaacataaaagtgaaaggtgaagcaagaaatgctgattagaaactgcagcaagttatcctgaagatctagctaagatcattgataaaggtgactacactgaacaacagattgtcagtgttgatgaaatagccttctattggaagtagatgctatctaggactttcattggtagatagcagaagccaatgcttgtcttcaaagcttcaaaggacaagctgactctcttgttagggcccaatgaagctggtgactttaagttgaagcaaagctcatttactattctgcaaaatctgtggcccttaataattatgccaaatctgttctgcctgtgttttataaatggaatagcaaagtctgtataatagtacatttgtttacagcgtagtttgctgaatattttaagcccactgttgagacctgctgctaagaaaaaaagttcctttcaaaatattactgcttattgacaatgcacctgggtcacccaggagctctgatagagatgtacaaggaggttaatattgttttcatgcctgctaatacaacattcattctgcagctcatggatcaaggagtcatttcaagtttcaatttcagcaaactatcgcaaggacaaaaaaccaatcaccgcatgttctcactcataggtgggaattgaacaatgagaacacttggacacaggaaggggaacatcacacactggggcctgtcgtggggtggggggaggggggagggatagcattaggagatatacctaatgtaaatgaggagttaatggatgcagcacaccaacatggcccatgtatacatatgtaacaaacctgcacgttgtgcacatgtaccctagaacttaaagcataataaaaaaatttaaatacattttgtaagcttacagctgccgtacataatgactcctctgatgaatctgggaaaaggagatggaaaatcttctggaaaggatttgctattctagataacatcacgatcattcactgttatgggaggaggtcaaaataccaacattaacagaagtttggaagaagtttatttcaatcctcatgggtgactttaagaggctcaggacttcagtgaagtaagtaactgcagatgtggtagaaatagcaagagaactagaattagaagtggagcctgaaggtgtgactagattgctgcaatcttataaaacttgaatcaaggagagttgcttcttatggatgagccaagaaagtggtttcttgaaatataatttacttctgatgaaaatgctgtatatattgttgatataactacaaaagtttagaatagtacataaacttagttgataaagcagtggaaaggtttgagagaattgactccagtttagaaagaagttctactgtgggtaaaatgctgtcaaatgacatcgcatgctacaaagaaatctagcatgaaaggaagaatcaactgatgcaacaaacttgtttgtcttattttaagcaattgccagccaggtgcaatggctcacacttataatcccagcatttagggaggctgaggtggtagtatcacttgagcccaggaattcaagaccagcctgggcaacatagcaaggccccgtctctatgaaaaaaattaaaaagaatagccaggcatggtggcacacacctgtggtcccagctactagggagacttagttgggaggatctcgagtctagggggtcaaggcttcagtgagctatgatcgatccactgcactccagcctgggtgacagagcaagactctgtctcaacaacaacaacaaaagattgccatagctaccccagcctttagcaactgccaaccctgatcagtcagcagccatcaacatcaaaacaggaccctccaccagcaaaaagactgaaaatcactgaaggctgagatgatcattaacattttttagcaataaaatatttttaattgttatgcacactttttagatataattcaatgcacacttaatatagtgtgtaaagtgtaaacgtaacttttatatgcactgagaaaccaaaaaatttgtgactcactttattgcaatattcactttatcaaggttctctggaacctcacctgcagtgtctctgaggtatgtcttatataatatgtgttatatatattctccacgtgtataatttattttcttcagctcttcaggtgaactttaccatgttagggacagaattatattctttttatacaacttgtacaattttcttttagttcttccctccaaaccctgttgtttttatagagcattctttcatgtggcctttttaaagttttatgttgcttgctattataaatgcaaacttttgtattctgtgtttgagttatctctttctgaaattgtgttattaccaatattctttcaaaagatattgtggagttaatagtattaggcactgaagtttaattttaaatttttttgcagaataaaaataataattatatttgtataaaaggatatgagtgcattgataagtgaatctcaatgtgttttatatatgatccatgtaaaaattctcaaatacaatacacttggaaattcttaataccatagtattagctgaaaaattatgttttttaggccaaatattggattgaaaattctgacctaacctagtatttatttcctccaaatagtgtccctagtttcagatgaaatacaattttaatttaagaatgaaatatgaaagcaagccatttatacattgacaagtcccataaagtactatggaatttaatcaagtctaagatagtctcaattgttaagttacactgttattttatagtacaccaagaaagaaaataatgctgtcactgaagtaaaacacagtttcttaacatttagaatttttataactactaaaagaacttttttagacttaaatgcagattattttaataattttaatcacttgtgaatattttatgtatatacacacacagacatacattggaaaatatacattaaaaaattggtaaggcattcctaaaccttcttccctttcactaccggactcttctaaattactttggagtctgagttttcaacattcacatctcacacctaagcttattctgtcagtgtgcaatatattttaacagagagatccaccatttttccagtgatttcatctaaagagctacacccaatctttaagttttgatgttgctatttactccaccttactagaacgtgtcaacagaagattttcctgtcaaaaatcaggatttatatttatattcatttttcaaatgctccttaaaaggttctactgaaatgtgattaagcattgtccaatcaagccacaggaaataataaccaaattcagacatgcatagtccatgataacaacattactacctatgactgcctcttgatgaacctatattggaaaaagtcattaggtgtaagacatcctttatgctaatatgataggatgtgaaaacaataggtgtcttagaatcaataaattatagtattaaagaaaaatcactgttgaagataattttaaaaaacaatttcagctctaattaatggcatatgtatgtgaatacagacacattattctagaaaataaaattttaacagacaagtcatttatgtaattcctagatttttttgttacataaatttacttgcatcttttaagatgttttggatattttaggtatgttctattgaaaaacttttccatcaagatttgaatgattatggttacaacgaaatatatgttcaacacttctaatttattatttcatgtgcttttatacatatgactgaaaataacctgtcaaactgatcatttgtgaagtattgaaaagttctcattatgtttcatgtgaactagtatttctcctctgaccattaaaatgtgctttcttgcctttccaaatgattggatgttaaagataaacaaataaatgacaagagcaactgagtatttctttatctcctctctgctgtaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtaagccatttagtcttcagcttattcttaactcttctgttattttcaaagctctatgagaagaatgaacaacagaaaattcttattttctttgaatttatttttttataaacaatgcagttttaaagtattttcatctagtacattgaaattcaagctatataatgggcaaacatttcatttttaaaaaaataaaaaattatcagacaagttacatgttatcatataaatttaaaaagaaaacagctttagtttgctttttttccttttttgcttttttctcttcagccaatggagatggtgttgttggacacagactttctgatgtaaataaataccttcgttattataaaacttattttcatgacttatctgcatttgcagtatctgactttccactcataatatgttaaaacgatgccagagagatattttctggatgcactgatttagctttaacaataaaattattgttacttgttctgattagtggtagagctcattaaccgtgttccttctttttcttactgaaatgatcctgtttaaaagctcagtgagccacactttcttctaacacaaatattaaaaatgacctactgtcacttgatgatagttgtttctcatgcacatatctattgactcaaaatgaccacaatatgtacacccggaaagcactatttttattagtctaaataaaaaattgcattacaaatttatattcaacatattaggaaaaattggacttcaatatataaagagactgaatcttttctttctgcccagagataaaaaggcaaacatatttacactcatgtaatcttacactcatgcatcatttgatgaaaaacatgtattgaagcttacagtaatagtgatgttaaaatctttctctttacaatctatccacatctctctccttttttgatataacaaaatgcatttaatattgtaaatgaaaaccgtcttatatgtaagcattatcatagtgaagagagtgccttttcttttgtgtagagaaattgactactgcatttgactgtagaagtcgggatgcgcctacaagtagggaaaagatgattttgttatttccttcactacagatatcaatggcattattggtgtttcaacttagaattgtattcctttggctcttaaatactttgatgcccccaaattcaattattaagtccatctatgagggatttactttaaatcattatcagcaaatactttgactttggtttccaaaagtagacagatctagcatttaaacttgacacatatgatctgtgtgatcatgggtacgttaacctccttatactttcgttgtctataaaattagataaataatagctctttttaaaggagttattagaaaaatgtaaaaaatgaatacgtagtactttagagtacccagaattttgatgatcataaataaatatttgcaaataatcataataccatttatataatatcttacagttctaaaacttactttattttggcaaaatctttttgtgttgttaggtgaagtcaagctcaggaagtctaagtgttttgcccagtaatataaaataggtacctatttggagtagatcagttctattgatttcaagcctatgtttgtttaaccatgccagaatgagaaagagatggcaactatttccaaatgaaaatatggattaagatttgaaggcaaaagttccaggcgacagaatggggaaaatgattgatataagattaaaaaaaaaaaaaccttaagctctgaaacataatacctggattttaatttgggttcttctacttacaagctacttgaccataggctggtcagttttgttatttataaatcggatttaattacactcattctgcatatctcacaggtatggctgaggtatagcgttagagaacatgctgtcctgttactctccaaagcatgttcttgttccttcttgtcagcttttaggggtcctcttacttatagaaaatgtctgtattaaagggttggagtatttgtacacagacctgtgtatttcacaactggaatacttaaccaccttacagaactgtttcaatctaggtaaattagttaatatagaagaactcttacctctctagcccctaaaataaatatagagtaattcctagtttaagggaaaacaagagatagtttatataagcccaattttatataaaccaatgtactttttttttttttgagacagaatcttgctctgtcgccaggctggagtgcagtggcatgatctcggctcactgcaatctccgcctcctcagtccaagcgattctcttgcctcagcctaccaagtagctgggattacaggcatgtgccaccacacccggctaatttttgtatttttagtagagacggggtttcaccatgttggccaggatggtctcgatctcctgacctcatgatccatctgccctggcctcccaaagtgctgggattacaggcatgaaccaccactcccggcctaaatcaatgtactttttaaaggatcttatttattacaattgctcagtagtgccttagtgagctacaagaggtaatttattttccaaaggtgatactcaacactgccaaggaactccctagacagtgggactttggctcatataaacaatcagtgttaatccctgaattaaaactatgtttcaagcaaaaacctcctttttacttagcacacaagtgcatctatatacattaaatgtggactgtgagggatgtacagcatgaaatttttgttatttgcatagtattgaaacaaatgtttgtggggagacataagattgttacaaattacgacctttttagtctgtttataattcttcaatgccgaaaggaaagtattcatttttatattgccctcttgctcacaaggaagaaatctattctatatatgtgtatataagtatatgtcaagaggaaaggatctgaggaattaaatgattttaattgagaactaataattttgtcctagtttcaacctattgtacgactgttgatatatcagtagaaattctcaatttcatttttgtgctttaaaattaaaggaattaaacttgaaatgaaactgtcgtttcaagtgttcagttatgaaaaccttattgttttgtgcaattacatttataataatcaaaatgtactatatgatattgcgtttttaattctgcctttcccacttgaatgtacattttgaggagtaatttcttttgtgagtgccataatgtgtttgtgttttcccccacttttgttttgttctttttaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaagaacatttttcatcaaggaaaatgtaaagcataaaattaatatccattaacggagactttatatacagatgtttaaatgtgttttataataatactaatagcctgaaggaatatgggcaggttaattttaggttttattataaactttaaaatttcataattagtcaattttagaactaaatttgtttcagaacctggacctgtgaacttaagaacttatgttagactgataattagtaacataatcttcaggatttttatctacttcagttgttttggtctcttaaaaatatatcagaaaaaaatgctattttatctttatcattggtgaacagatctctcgtctgtttatattgaaatgagccaaaattgtaaaatattctctcaaaaggtcagaatctattttttagttgagtacattggatatattaatttgaaatttgttacatgctgagaaaatacatttataatatcactgataagaatatattcatgtatctattccatatagagaaagacagggatgaccgaaaatttattcacagtttttttgagggccactcatgttccatgtttataaattggaaagattaccttcagattttaagatctgaaatattttcaaagatgccaataaaagtgtctgtgctaaattattcagtaaaaagatgcagtacatgtttagagcatgaccaaagaataccctcacaaattgagaagctggtctaatacttgagagagagagagagaaatagataaaatgtacattacagaagcattagatttttgttggaattgcttgtggttattttatagtttccttctgaattacagtggtgaatgcttttagaagtaaattatgccttctgaacttatggtttaaagacatgtatcagagcattttgaagttaaaactttgtttagtcttagactttaaatgttataaatattacattctgtttgtgcaccagcctttgccagcaaccaatgtatattgttttggttaataccggacttaagtattcacttagactcttggcctgctctctcatggtcagagtcattgccaggctaaatgtaaatttttccattatttagtcagtttttaaactgttttctacatgacatcaaggaaccattctgaaagtgtgaaaagttatgtttaatttgttaattttaatgacatcattgaccttttgtctcttcatttttttttcacttggttaggaatgtatcagtcggctctaagacctaggtggtgtggttgttgtctttctctgtccaccagggctatcctatggtatctagcacaggtgttttaggtggtatatctctcaatataaatataccatgacatcaaaacaattgtcaaaagagagtgaaagccagtaggtcttgttatttatcaggcagttgattttgttacataagataagcacaattggtccttcttttcatacggaattagtttgatcaactgagttttagagcctattcttatccacacaattcttagtgtaaacagagaagttaccatgcatgaggggatgaaaaaagaatcaagtccaaatacatagtggggatagactctaagaattaaaataaaggaatcttatttggccactcccacctgagcagataatgtgcattaatatttttaaaaaacagtttcaatatttttgaatgcttattgtgttaacattgccaaaccatgtgccactggcagcaaatggcaataattgattttagacctattgttgaaactctcagactgtagccattatatatccattttttcattccatgtctgccatctgctacccgtaatatttcttgacttttagattggcttcttctctatagtatttgattatcgctagaactgctggcccatagtaggcactgagttaatatttttgaatgattgaatattattgctgttacgtcttacatagttgcagcacagcagtgaaaagtagggagtgtgtggtttctatttcatatttgtttttttcagactgaactttcactgctcctctcagaaagaattgaagctttagttctggaaagcatatctggtttcttgatgatgctaaaaaattcttttttttttcttattagaggtattaggctaattattatttaatccttaaaatatttcttttattattttttattttattattattagactttaagttttagggtatatgtgcacaatgtgcaggttagttacatatgtatgcatgtgccatgctggtgtgctgtacccattaactcgtcatttagcattaggtatatctcctaaagctatccctccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccagtttcatccatgtccctacagaggacatgaactcatcattttttatggctgcatagtattccatggtgtatatgtgccccattttcttaatccaatctatcattgttggacatttgggttggttccaagtctttgctattgtgaatagtgccgcaataaaaaattcttaaaacatttagaaagtatgctgatgtggcagcccaaagtggtattaactctgatgggccatggacctaatgcttttatatttagaagtataataatcattgtagaaatagaaatatttgactcaagttaagaaggcaaattaaaattatgccatttttgttatgtttatgactatgtcatgcttacttaaataaacccattataccatctacctgattaaaacagaaaattttgtttaaataggtaatatattacaagtagccaaatttaatgttgagccactgactagattctagggagaatgctatggattctgactaaacagactggtttgaaagttgtatatcagaatcacttggaatgcatatgctaatttatatagatttgtatacactaaattttgctgctgttaataattacgaagaattagatgcctgcataagcaagagacaaaactaaatataagctgacaaaattttaaaagtcaattaaccttcatattaaatggcaccaggctagattttaaatggtctcaataatcaagtggaatagtttttttactgattagtttcaccttaataatttagactcagataaagtgaaaaactaggattagctcaaatagtgacatggcacttaaacaacaggttaggtgaagccattctgcagagtagttaagaatgagtacagacagacctcagttaagagtctagattctaccactaactagctacataaccatgcccagattacttcacagtactccttgtaaggatcaagtgagctattacagataaaattcttaggctagtatggggcatagagaaagcacttagtaaatattagacactgttaggaaccatgtaaaagcctttgggtttctcctaaagaaagtaatttttctctattgaagagaaaaggaagcatggaaagggtgaagcaatcctaacgtgtgctgtaaatagagatatctatattcacatgtatagatataaaaatatacctcactcatgtatgtattaatatatacacacaaaaaatgcctagtttgtcttgtttgtatattttactgagagaaataatttttagtaaatttaatgtactagtaatataatactgtaagtgtctctgcatacctttactaagcatatgtagaagtcataatctagatttttttatttttaaagtcttatttgacattaatttaaataagaggaatatactttgaagaataatttatttgaatttttatcattatatgactgttttattatgccaacttaaaagatgttctttgtcttctaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatggagaattctgaatcccaaacccctggtttaagtaggtagaaggaggatgcctaatcctacaaagtgaccctttatacatttcattttttatttgatattaaagtatgagatagagttgagagacaattaattatcccctcttacacacaaacacacatactcccacatacttacccacatgtacacagagtatctggagaataaaacccaaattcaaaaaaaaaaatgataatttatttttaaggtaaaaataatccatgaagataaaagaaacatatgtctgcgtgctactttacaatgttggttttaaagataagcacatgggtaaaaatgagggtgatccttattcaaaaataacatctgactactataaaaatatttgcatatataagtttgacaaagaaaagaaaatcaatgttaaaccattaaatctgagcactgttagacttgattaatccatgcacatgattttttttgagtagggagcattagtacctggtgctagagaatagaaccctcaaataatttttagaattcttacctaatatgtaaaagtctgcatgactcttaacaatgagtcacatccattgattttacagggattttagttcgtaatccagaaagtaataatcagggattttattttaatcaggcatcaatccagattcactgttatactgaaatatcaaagtaaaatcctagttggcaggattgtaagtagaccgaattctaatttttcccaacacatagtggtaattggaggttactgttatgaatactccatctgactacgactaagagagtgaggggtggttttaatgaaccctctaagctctctcagttccttcccttccacaaaatgcaagagcaaaagcaaactacaaacaggccttgtgctcaaccactggaaatgcctcctgggataagaatggcagcacttgaaaattctgccctctactgatgagacttcctgctgcctttggacataactaagccaggaaactttaaaagccttctagaaatagaggcactgtatgacttgcaatcgtaggtatagtttataacctgatagcaaaaaacttgaaatattgcagcccagtttaattcagcactttcccattttcataactatgtgaaaacatctgggaatttgaatcactcctgaatacagaggcatattctttttaaactataaataccattttgagtgagaaagtacttttaaacaagaaagaaattgtacattatgactaaagttataaatacaatatttatatctataaatctgaagtttaacatgattaatttaaaaagtatttagtgcttgacaaagtagtgtcactcttaagatgtcaaagggaattagccattttttttattgtaataaaggcaggtgctatttttttctggtgagattgcacctggataccaggcttttgtaatagttaacattaaacatttgattcataaagttaattcactgcttaagcatgtggctcatatttaggaagctatataaaattcagtttttcatttaacatttgctcttttgcatatgaagagatatttgtatttttcaaatgttaagtaaaacaagatgtgccaatatcataggtaaataaattagggaaaatgtgggactttatggctgtttttaatttagtttcacccgatcttgattcttgaattagctatgtttatatttttagttcttttttattcaactcagatttgtcaagaaatgtaacctctaaattgtgtagtacctctccaatcataaattttcaaaaaaaaattctactttccaaaaagtgtcttgaattctctgaaaaggcacattaaactaatatgaacatcagataccagggggaaataaatggcaaagtaataatcatgaggttttaggtcaaagactacattatatatattttttattaccttctagtagagacatcctcctgggtgcatttcagtggccttctccagggaggaggtttatttacttactgatgagtttctcgtcacgtcaaaaccagttcacatttgtctggctgctctttggttgtcttcattcgttatttatttctaacactgtattaaattgttagaaaagaaagtaaaacttgcacattcaaagcacatgatttgtacagtcacacctggcagtagcactgcacagttacaaatatgcacacacgttaactgctatgcataaatattgacagttaaacc

SEQ ID NO: 16337 - DNA, 8824 bp, Human
ccttctcccagagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccctaagtgttgtctctggagagtccttgggaaggtgtgggggtggagaccctctcctttttcacattgaccttcaattccagaacttcagagctagctgactggcacagagcctgatagagttgcagtggggaatgagggagtaaggagcagagaggtaaactgtgggagattcttttattttaattttttttagagacaggccctctctctgttgcctaggctggagtgcagtggtacaatcataactcactgcagccttgacctcccgggctcatgtaatccacctcagcctctcaaggcactacaggcatacgccaccatgcctggctaatttttgtattttttgtagagacagttccactatgttgcccaggctggtctcagactcctgagctcaagcagtctgcccaccttagcctcccaaagtgttgggattacagtcatgagctgccgtgcccagcctaatttttaaacttcttctgtagagacagtcttgctatgttgctcaagcttgtctcaacctcctggcctcatgccatcctcctgcctcagcctcccaaagtgctgggattataggcatgagccaccacaggattctgaggctaaaagtagaaaggagctgctaaccagaaagccccccagaggagaccgagtcagctggggaattagaacatccacatccatttagctcctctaacaccccacagacaatctctgaacttaactaatgtacaaaaagtttcatttctgcttctcaagccccaaattcccatgtctggaaggagggggcttgtatacccaagagacccccttatcctcaagaaagaaagatggaggttctaggagccattttagcccattaacccacctgccatctgcccagtatatgttaggtacaggaggagggggaggtgtggctagtgcaggaaaataatgcagagaagatacaacccactaagccaagaatgtggggacagttacagctgtgcctcccctgcttcccttcctggaggagctgaaagatggggaattcctgaggatgggcctaaaggggctgggctcactggtagaagtgggaatatcagagactgactagtgtagcttggtcacctagtccctactaaaaagccttatagcctttcctaggatgagactttgaggctcctagacaaaggcactctcccaggaggaaaatcttaggccctccctcccatgagggtcattgcaacatgagacccaagggagttgtgaagtcagccccagccccgcctactgttcctgggtgctaatccccagcacagaccactcaggaggagggattggctgaggagcttggagagggggcgtcatcacctcacccaaaggttaaataggggttgagatatgatgctcaggagaagcgctttctttcgcgagcaccctgaaccagaccatgacccagaccctcaagtacgcctccagagtgttccatcgcgtccgctgggcgcccgagttgggcgcctccctaggctaccgagagtaccactcagcacgccggagcttggcagacatcccaggcccctctacgcccagctttctggccgaacttttctgcaagggggggctgtcgaggctacacgagctgcaggtaggaagggacgcctttcccgagacagagtgctggggaaactggttttgacagcgtcagaaaggactgactagtgcagagcaaatgtgggacagccagagagaacggatgcccatgaaataaggaaaaggcgagttgaggctgggggcggtgtggctacactcgggcagagcccgtcccgactcttagcagagggcgctgcgaaagcgccttctcgctgtcctgaggtgtggagatcctgcagataaagtacaagtgcgcgggagggggaggccggagtgggcagtaccctccgcctgcttgcggcttaaagctacatgggttccttttcattcactgaggactcgtcctgagatggacagtccagacatggaacttttagagatttctcctcgaccgagatgatcagagaggtcctgaatgtctgccttgcacaaagttccggttttgcccatcacactcaaactttctagggatgggaaatgagagaggaggagtttgcagtatcaaaggcatacactagttgggcacccgagaaagagcagaagctccctattcccaagcccagtcaacgcccttggcgtgggcacaggtcaagctgaaagtccccgcccaggtatccaagtgtccgctgtgtccgctcccccaggtgcagggcgccgcgcacttcgggccggtgtggctagccagctttgggacagtgcgcaccgtgtacgtggctgcccctgcactcgtcgaggagctgctgcgacaggagggaccccggcccgagcgctgcagcttctcgccctggacggagcaccgccgctgccgccagcgggcttgcggactgctcactgcgtgagtcttctctgcccccagaagcccagacgccctgcagcggccctctcctgctgcgggtcccgaaactatcaatctgggggcatggtgggaggtcggctgtcccactctaccattgggcatcttggggttcccatcccagtctgcttcacccacactcaggttgagccccaacctcactccccgcctacctccttatcctttgaggcccgaatcctgggaactgggggaaccggaggaattgggctagggtacaaggatctggatggaatgaatgtaaggttctgtgactcaagttacccgggaaccccggcccctgagggcaggaaatgagtaaagaggaagggggctggaagacaggcgcaggccggtgcaggtttccgtaccccaagggggcagacgcaatccctctcctggccaccgcagccgaacgcgctccttcactgcagccagtcccgtcgagccgtccccaccttcccgatgcgcactctctcctcaaccctgcagggaaggcgaagaatggcaaaggctccgcagtctcctggccccgctcctcctccggcctcaagcggccgcccgctacgccggaaccctgaacaacgtagtctgcgaccttgtgcggcgtctgaggcgccagcggggacgtggcacggggccgcccgccctggttcgggacgtggcgggggaattttacaagttcggactggaaggtgagtcccaggacagagctgggcaggcgtcgggggcgccctaccagagcctcccggaaccctgacggcgccccctcccgacaaggcatcgccgcggttctgctcggctcgcgcttgggctgcctggaggctcaagtgccacccgacacggagaccttcatccgcgctgtgggctcggtgtttgtgtccacgctgttgaccatggcgatgccccactggctgcgccaccttgtgcctgggccctggggccgcctctgccgagactgggaccagatgtttgcatttggtaaggcacaggtcgaggtggaaatgggggaatgtaaagctgtccaggggtagcgaggtattcacgtgccttctacccacgcagctcagaggcacgtggagcggcgagaggcagaggcagccatgaggaacggaggacagcccgagaaggacctggagtctggggcgcacctgacccacttcctgttccgggaagagttgcctgcccagtccatcctgggaaatgtgacagagttgctattggcgggagtggacacggtgaggttctccctccgtgctgtgagccggttccagggcttagcctccgcagactccggctccatttttctgttgcaggggatccattatggccacgtagaccagcttggcttagcaccctgtagccccagactcttccataatctgcaccctctgctgggttctcacacccaacacctctcttgctttcacatgtttttcaggtgtccaacacgctctcttgggctctgtatgagctctcccggcaccccgaagtccagacagcactccactcagagatcacagctgccctgagccctggctccagtgcctacccctcagccactgttctgtcccagctgcccctgctgaaggcggtggtcaaggaagtgctaaggtgagggggaaggagaggaggaacaagaggaaatgccaaggaagggctggggaagcaactagtggatggaagcagggagatagcagagaaaaatggccctctactcctggccaaaaagggtttggaagttggaaacaatgagaagggggctgcagcccctagcctcatcttgttgtctccattttgtgctttgcaacctagactgtaccctgtggtacctggaaattctcgtgtcccagacaaagacattcatgtgggtgactatattatccccaaaaatgtgagtaaagcctatgcaccctttctactgagccattcctcactatcttgggccccaaccctgttctcaaacactctcctaaaagcccttcaaacactccccttgacccctctctaggatatgcctttctaggatgtaatggaacagtggggagatccttccaaaagtagccccagaaaacttccccatcacccaccaggacctgcctttgtccctgtctgaatatcctcttcttcatgcctgccctattctgagcccaaactgacaagtttgttttcctttgcaccagacgctggtcactctgtgtcactatgccacttcaagggaccctgcccagttcccagagccaaattcttttcgtccagctcgctggctgggggagggtcccaccccccacccatttgcatctcttccctttggctttggcaagcgcagctgtatggggagacgcctggcagagcttgaattgcaaatggctttggcccaggtgagtgctctagattttataccttccccagactggagagaccctaaccctctaaagttgtgagctctttcccctgacaagcataggaaatcatataagacctggtagaatgaatcttctgaaatatgataagcccattataggcctggagtgtaagtgagggtattcaaactattttttccctaccataatccctcacccttattaaccaagaagtcccctactggccacaggtgccacccaatcattgaccattctaacactaataatgcatgccctttaccaattggattaccaatgaatccccccattatagatatctttcatagtaatgctcaccttcttccctttccagatcctaacacattttgaggtgcagcctgagccaggtgcggccccagttagacccaagacccggactgtcctggtacctgaaaggagcatcaacctacagtttttggacagatagtcccatggaaagagactgtcatcatcaccctttcattcatcatagggataagattttttgtaggcacaagaccaaggtatacatcttcccctaatgcctatctgaccaaactggatagaaccaccatagtgaagtgtgaggcggccctgaccaatgtgtgaagtatgcacttggcctgactcaggaagccaggtgagaaaaccatggtctctctgcttgcttggcccttctgatcatgtatgcatcccccaaggatgaaatcagattttaactaataatgctggatggcctgaggaaagattcaactgcctctctttttgggctttcatagtgttcattgatgctgctggctaagcatttatcaaagcataagctcagtaactgtgcatctggtctgtacctggttggtccttcgtctttgcatgtaagctctttgagaggaagggtgaagccttatttgttttttatgtcccctgccagggcctgtctctgactaggtgtcaccatacacattcttagattgaatctgaaccatgtggcagaagggataagcagcttacttagtaggctctgtctacccccttccttctttgtcttgcccctaggaaggtgaatctgccctagcctggtttacggtttcttataactctcctttgctctctggccactattaagtgggtttgccccatcacttagttctcaggcagagacatctttgggcctgtccctgcccaggcctctggctttttatattgaaaatttttaaatattcacaaattttagaataaatcaaatattccattcttgattttgacttatttctctcatattcccacttcctacaagacctggaggcaagactctaaccctcccatctcccaccttggtttctcaggtcctgggggtgacccccataacaatgggaggtctggacgcctggaagagtagtttgtaacacaaacccagacatgtttctgtctgtagtgggaacatccaagtctagtctggcttcctgtaagagattaagggggtggggggtgaaaagtaacggcaggggctaagctgtaaaatgggcccggagctagggatttgcagacatgggcagaggttgctgactctggtaaggaaagtgcttttggactgccaggattgaaggaagtcctagattggtcactttgccctctctggaaaagttgttccaagataatttccttcagaggaagggatacaagcagagaagtggaatcagacagacagaatgaaagctgagtgtgggggtggccagaagccctggggcactgaggcaggataagggcggtgggcagagggagactgtttccctaagtcagcattctctggccccccagaggctgggcacagctctcctcttgtgatgtatacagattaactcatcttccatccaaataaatctctcagcacactgcacagttccttctgcatcccagattacccttcccatgtcaggacttgccccccttcccctaccgctcaccctattccaattagctgggtgtagatggagatttcacttcacacttcttcctcctccacaccttggcctcctggcctagacatggctccctgaccgcagaaactccagtagccaccaggccttttgcaggggcatctaattatgcaagatctacagaggggcagggcagacccaaagcctcgtacaaagatcaaggtttctgtgcattttctgcccttctcaactccttccctactgtatactcagtctccacccctattcctctatcactgaactcaatttgaacctaaatgaccaaattttcagcagatttgatctttgagggagaataaagcccagcttgtcagaccctttaccctggaatcagtgatgagaattctgcccatccgtactccctattttccactgggcaagtaggaatgcccacttgaagagggcagcagttcccatgaccctttcctggacaatgatctttttaagttggaaaaaggaagaagaggagaccatactgattgctggccccaactcccataccaagacttccattagtgctgaaggagaggggaaagtgtcccacttggcctcattttaggacccagagtgtaaatggatacagtgtgtttgtgtgtgagtatgtctattttctttggtatgtctaaccttccctgcagagccatcacagaggacagctcaggcttggcacaggaagctccacatgtgtcctatctacctgagccctatctgctggtatagatattagtagtcactctgatttgcaatcccccatttggtccccaccagctcttctgagaatggcaaatcagtaaagtctggcctttctgtctcccaagatgggggatatagagggttctctctctggggaaacagtttcctactgagcagacggagggttcagtctcagttccctatccactctactccctcaaaaattggaagttatatacttccacactttgaaattacttgaaccgcagtccagcttttgttcctacatcccaaggctggtctggatgccagcaccatggacagcaaccaagaccccctttgggagaggggaggggacaaggtttcctgggcaaggatgtgtgtgggcctttgcaagggaagcattttctccaaaacatccccagggaggaaggaggcaaagcagaaccttccctgatagaaggatcaataataagaaaggcctccagatctgactttagccgtgaatgaaggaattatttaattgctgttgaatggtttacttaaaaacagcatcattcatat

SEQ ID NO: 16338 - DNA, 9030 bp, Human
agaaaaagaaaaagaaaaaaaaaaagaaattctaagtgataaagcattgtgtaacagtttgaggctgggcacagtggctcatgcctgtaatctcacactttgggagaccgattgggaagattgcttgagcccaggagttggagaccagccagagcgacatagtgggaccttctctctacaaaaacatttaaaaattagccaggtacagtggtgcacccctgtagtcccagctatttgggaggtggcaagaggatctctcgagcctagaagttggaggtggcagtgagtagtcatcttgccactgcactccagcctgggtgtcaaagggagactcccctctctagaaaataataaaaaaaaaagtttgacagttttcttgcttgtgctacataaaataatggtacatattacaattgaaggcatcttataatagaaatgccctttcctgttcccttttaaggctgacccagtgctttaagaggctgatacagaagggtaaagttaagtctccacaaaatccagggaagagactgtgaaactcatcttagaaccttgtatggagtcacagctgaactaggaaaaaaaaaaaaaaaaaaaaaaggaaagaaaggcattccagagataaagaatagactaaggagaggagatatttgaagccataatgattgagaatatgtcagacttgaaatgaatcttcagttccctcaacaagacaaataaaactaactccatacctagatacatggtagaaaaactaaagaattctgctgaccaaggtattaaaagtaactaaagagaagtggtgtgaagaaagcaagagagaaacaacaaatcctgtccatcctgtaacaattgaaaatttctggctgggcgtggtggctcacgcctgtaatcccagcactttgagaggccgaggcaggtggatcacctcaggtcaggtgttcaagaccagcctggccaacatggtgaaaccccgtctctactaaaaaaaaataataataataatacaaaaattagccgggggtggtggtaggcacctgtaatcccagatactcgggaggctgaggcaggagactcacttgaacctgggaggcggaggttgcaatgagctgagatcgcgccactgtactccagcctggatgacagagcaggactccatctcaaaaagaaaggaaaagaaaagaaaaaatattaaatgtgtacgctctttgactcagctgtattacttcaaggagttgatatcaccaaaattgcctaagtgctcaaaggtgtttgtagttaaacaacaggagattgataaattatgttatatacatgtgatgctatgttttaaagaggtactgatatgataaaagatgtacgtggcataaaattaaatgtactttattaagtacttttccaagtgtttacggaatgagtgcatttttgaaaaaaaaaaagtgtattcgaacttttaaaaaagctttaaaagctttatacaatgaacgattgagtgattataagagctggcgggggaatgttaagaggatgatagggagctaagtttaacagaacaattcacctctttatcttgtgacacctacgagcgcatcaattctgtaattgaaaaataaagtgcatatttgcagcagctgtactctcttcaggctgcaaggaggcttttcctcccggtaggcttgatttgcatttcactttcactttcgtggctggaaactttctacccacgtagtgggaggctgaggagccaccataaagctggggcttgacgagccgggaccgggacccgatctccacatatgcccggacttgttctgcggccgggttcaggagtcaaagaggcggggagacctgcgcgacgctgccccgccctgcgcccgcttcctccaatgtatgctctagggggcgggcctcgcggggagcatggacacgattggccctaaagtcttccccgcaaggccgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccaggtgagcctcgcggccccgggaagccggccccggcccgcctgcacctccggtgcttggcgggagcgctttcgagcctagccctcattggctggcgtgggccatccgcgccttctcattggcctgccacgcagtggggtggggcccagctgagcgcgcggttcggaaaagcccgcgctggctgctgcgcgaacctgctttttcgcgccaaagtcacaaagcgggtggtggcgggaaaatcaagggtttttccgcagtgccaggaacactgttccagggctctttgctcactaaatcctgttggccttgaatggacgctttagctgtggctttcttgtttctgagacggtctcggtgtgttgcccgggctggtctccaacttctgggctcaagcgatcctcccggctcagtcgcggttgactttaaatgctttataatgcccttgcgagaaatgtggcagcctgtcatcctacttagtggcaggagattgtttctatccagaagggacactgctggtggtattttagtataaatactgccagatgcgtcccaaaacgtctgcattaataatggcatcctccagcagtccgtttaccctccaccagttctgagacggcctgatgggtgagagtggtaaccccttctaaccgcgttcgaaatacagcccttcagcagacggcgttgattttaaagcatgtgtctcctgtcttctagtatgtccaaaatactaaaatgcgccggcaatgaagatatcattacactaagggccgaagataacgcggataccttggcgctagtatttgaagcaccaagtaagtcgtacctttttaccgagtcacgaagctacagaaaatcaaaactctgtgtcagtatttctcaaaagcatctgctttcttttggtagaccaggagaaagtttcagactatgaaatgaagttgatggatttagatgttgaacaacttggaattccagtgagtatcagtttctcattgtagagagtgctgtacacaggcacgatagttatgtcatagaatgtttgtttatttttacagacagggtcttggctctgttgcccaggctggagtgcagtagtgccatatagctctctctaacctgggattcctgggctcaagcagtcctcttgccttagtctcctaagtggctaggaaggactacgggcctgtcccaccacacctggctaattttttcatttttgtgtgtgggcgtgggggcagtcttgcccaggctggtctggaactcctggcctcaagtgatcctcctccgtcaagatatgttaatataatttaagcctacttcataacaactttttctagaaatatatctactggtgcatgtttcaaagagagattttagtatttggatagttgttcaccacaagtctaaaactcacaggttaaatttattgtttactgccagttgtctatttgcattaacttccatgaacctcttttaaaatttgtttccttctagaatgcttgctttttattaagtggattttaaagctgacttggaagaaatttatccaggttaggtttataaacaccaaaggagagaagaaatgtttgaatgttgaaaatgcctaatatattctcttgctttcttttagaaagtagttaggcctgcttgcgccatcatgatttctgtgccatactctaatgttctcttactttatccctggaggatgaggaggaggaggctcttgttccctggatggtgcatttaatagccatttatttttttgagtggagtttgttaagaaattacgcaagtcatattttaaagtaatcagaaaatattgattctgagttgtttaggtgttgccttttaagaaagtgagggtgccaaatcattaaatttctaacaattaacttttggaaaattttgttcttaataggaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgtaagtagtttttaagtaaaaagaaaatagtttgaagagaattataatactgcttattaggttaattgctaaaattaaaagtagacagaattggatcccaagtaatttctgaaaattgagatactgttgaaatctgcgaatgatttataagtgtcatccaatttagaattatatttgcaagaagggaatacaaattcagcacgtgtacataccacagaacagtggtttatggatcaagtccacaccggctcttaagggtaggattgggaagttaggcgtataacctttagctttctggagatacttactctcttaccaaataattgagcataggacagcagctcaatagaaggatatggttaggagtaaaagtctacctgtttggagcacttatgtaatcctaatattagcttacatgttgtgggtccaattggtagcccattttaaaggtggagaagcaggctgagcaaccttaagtgacaatttagccaaagtcacaggctgtaggaatcaaaggttaaacaggaaggagacttctcactaaggctagaaagcagactccatgcaactttgagagtacctagagagcccttgtttaaccaaaatagaaagaacatggcaaaaccccatctctactaaaaatataaaaattagccgggtgtggtggcgcacacctgtaatcccagctacttggaatgctgagatgggagaatgacttgaaccgaggaggcggaggttgcagtgagcccagatcatgccactcccctccagcctgggtgacagagcaagattccatcttaaacaaacaaaaaaaactcgctaacctgggcataaattaaaactttgtaaatcaaggacaaaggtcctaacctcataaccttgttaggattaaatacggtagcattaaagagcttagcatatgctgtgtgtggcatattataagcttacaataaatactatatattgctctcttgtcccttgaatgggtagtcaacatttagtttaaataaaggtaaaattcagttgaaaggtttttttttaaattaataaagtctaggagctgattctttatctgtttcctgaatcacatttccactcctgccaacctcgtttttttctttttctgtttttctttgtttttgagacagggtcttgctctgtccacccaggctggagtgcggtggtgcagtcggttcactacagcctcaaactccagggcttaagtgatcctcctgcctcagtttcccaagtagctgggactacaggtgtgtgccaacacacctagcctggtttcccctaatttcattttcccccttccattacaatctatttgttgaagaaattagatcatttattaagttttccagagtttggattttgctgattgcattcctgtgtatacataaattcctctaccctgtgtgtcctacagactggtagctatagccctggagccttgatattcagggtgttttgtttcgggggtgagagagcaagaatataggtggtggtgtgtgcctctagtaggaggcacagggtgtctggatgtgtttgcaatgttagcagctataatagtcattgtctagatccattaagtcattaattagagtttgcagagctgaaattaatacgttttattcacttattggctgcttattagaaaaacttccataaagaaaagctttcccatattatataatttggttatctaaattatagctataggaaagacaagctagataatcgagtcttttgctttatgtatcagtcttcaaaattttcatagctccctccaaagtgaccaatacaagtgtttgtgggtttttataaatatataatgagctaatagattgcaactttcttgatgtttttcaatgatgaatcttttgttttgtaggttaccatagagatgaatgaaccagttcaactaacttttgcactgaggtacctgaacttctttacaaaagccactccactctcttcaacggtgacactcagtatgtctgcagatgtaccccttggtaagataataaatttgaaccttgttttgtaggtagtcatatgtgatacatactcctcagtaattaaccatcttcctgtctttcagttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctccaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatcacagggcagtgtcttcattttgaccaggactgttggaagtatcctactgaattcccagctacagctaccctttcgtttaaatggtttttcagtttagagcagcctgatggagatcaaaaggatttcaaatacagtaggttactagatattttaggggattcacttgtcaaacttgttattccaatttgagctcaaggaacaagtgagagagtagtacaaatcctgtgtatttcattttatttggcaaaaattaatactcttcagaagcttaatgtacccaaagtcgtgtgggctttataagatgttaatggagtgtttctttttagcctggggaatcttacaagagtcttggatgtttcagtagagctgtaatggggcccaaggagtatggttgtacaaaatttctctagtataagtacactttgcaacttcactcaaaggatgaagatgtcttaaattccacggatgttggatccaaccaagaaagtgaaaaagccctgaagttgtgaagaaagacttaaaaacattcccactaatagctacaagttcactgtgtgctgtgtattaagaattttttgccaggcacggtgcctcacacctgtaatcccagcactttgggaggtaggcggatcaactaaagtcaggagttcgagaccagcctggtcaacatggtgaaaccccatttctactaaaaatgcaaaaaaaaaattagccaggcatggtggcacatgcctgtagtcccagctacttgggaggctgaggcagaagaatcacttaaacccaggaggtggaggttgcagtgagccaagatcatgccactgcactccagcctggtcaacagagtgagactccatctcaaaaaaaattattggctggtttaatagtagtaggttatcagaacttactaacattagtatcactaaagtaggtatacaacccctgctgctcaatttggctttagaaaaaacatttttaaaaactgctttatcataatccttttttccagtgcatttttgtgtttggtagattaaatgactgatttctttcttaaattacttggactgagttctagttactggacatgagaattaaccatgtccagtagtaagttcattttcctacagtgtgcctgtgagtggagaaggaaataggctgcaaaagagcccgatggaactttggggtgatggatatatttccatctagattggtgatggttctaggaccgtatgtattttcagagctcatctatttgtacttgtgtataaatacttcaataaacctaactttttaaaaagcttcatttgccgcaaaatgtcccttgtgggcaggccttttacctggacaagccctaaagataagcacaagtttgtggggctattcaagggaagtatagtggggtgctgacagcacagacaagtgtgctattcaagggaagtgtggtagtggggtgttgacggcgcgcgcccatggaaggctggcgccttgcagcggatatctggccgctctgactgctggtcctgaggctcgacggactcggcttctgcctccctgggaagccacggcggtctctagcctggcccctgtactgaggaggggagaaaccacgtagccggcttgccctggacctgactgtgacccaggtaggtgaggaccctaggtgctcgcccgccacagcggaggtagccggcggcaggcacaggtcgcggctgcttaaacaaaacccacgaagaagcattcgggccgtgcagccccggagtcccggtgcctcctgcaggtgacactcggtaagggttagcccgggaagctgggtaaagagacaaacgcttccggagacgcaacttccgacgcgcctgtttccggcacgccacttccggcgcactgatcccgcctggggccggctgagtggcacttaagcgggccatgccatgcaaccttgggcgctgccaaccgtgggcgagctctgggtgtgcgggcggcctggcgcggcgctccggtaag

SEQ ID NO: 16339 - DNA, 79578 bp, Human
atgaccaagctggagtaagtcccatagacgtgcttctgtgtgggctttgctgtctctgctatatgcatgttccgagtgtatcccttggaggacctgatcttgtccttaggattaacatggcacatctgggatgccatccttgggaggagggaagtgtctttaaatgaagatttctcaatctcagccctcctgaaatcttggtgtgggatctgtcctgtgcattgaaggatgttcagcagcacacctggcctctatttactagatgttaatagctctccccgagttgtgatggccaaagacatctccagacattgccagatgtcccctgcagggcaaaattactctggattgagaaccactgctttaaatgaatgtggatagtacgtgaatgaaaatgcaaatgtgcatgaatatgcaaacaagaacgaccaccccggaagaatttgatgtgtgtacctagctctccgtattccactcatggaacttcacgttctggcagcagtttctttgttttcctttttggccttctgatttctgaactctaaaatttgtgtaattctttctcttttttatttctttacattttgtttttcccctggctcatccaaagtgtttattgaatgaagtgtcccatgaagagttcctcaaacagcaagttctgtacttgtatttccaaacttattgcagtcctgtcctcacatttgcagggcagcttggttggattctttattcctagtgggaagataattggtggtaagatctgatgtcaccctaattggagtaccaggggatgcactctgcccttcccacccttacctgtttgcattatctttttctttataaaaattcaggcatagctaggcatatttcattgtatgtatgccattccttggagggatcctctgtgccctctcattttttttttcttttgagactgaatttcacttactctatcatccgggctagagtgcagtgatgcgatcttggctcactgcaacctccgccttccaggttcaagtgattctcctgcctcagcctcctgagtagctgggattacaggcgtgcaccaccactcctggctgatttttgtattattattatttttttttttagtagagacggggtttcactatgttggccaggctggtctcaaactcctgacctcaagtgatccacctatctcccaaaatcttagcttcccaaagtgctgggagtataggtatgagccactgcgcctggcaacctcctctttttactgcttttgagtatcttcccctgcttttaattgggcacatgtagggaatgtagaattattttaatgcccatctaatcatgattaattggctgtatccgcattgcccagtatagtagccacaagctacaagtatcttaaatttctatttaaattagatacaattaaaattcagttactcatttgcactaagcacatttcaggttctcagtagccacatgactctgttggataggacagatatataacatctccctcattgcagaaagttctattaggtagtgctgggttatgagatataaaccatatgcatatcaaagaagtaccttagctattttttttctccctagtattgtgatatttttgatagtttggtttagtggtccccctctctagtgggcaattcagaatcagtaggtgactataaataaagaaggtgttgggtgcctgaaaactgtaattaggtaaagtattttttggatgcttgggtataatgtgtagtgtgacttttttactgtgcaagaaactcagtgactgcatggcctgtgttgttttcatgctttggggtgatttggctgtgctcttcttttctaggtgctaagagatgccgtttgcaggcctcatctctgcttgagaatcgggggctccaggcactagaagagccggctgatcctgggctcctagcttgaataagccttcacttccagctgctctccccaacggctgtgtaaactactcgtttctcttaatgatgggtattggtaagaataccacatccaaatcaatggaggctggaagttcaacagaaggcaaatacgaagacgaggcaaagcacccagctttcttcactcttccggtaatcatattccccatcttcctttcttaaatctcttgaaagtagtttccgtatggaatcaacataggattggctttaatgctcatgttttcagtgaaggttaaggcatttgcaaaccaaatactttatatgtgagatagtctttgggctaactcttgggttttagctgtgctctcagcctggagtcatctgctgggattaactccaggaaggaagtatgcattgctgttaacattttaaatctagcccagtgcttactgtgtcctggaggatgttgaagacttaattttatcttcaaaaggtgtactcttaggaaataatgtgcaacccaacatcacactcatattgcaagctgggaggatgaatgacttactgcttggaaccccactgtccatatgtattatggcagcagtgtccagcgtagaggtagttttatccaaataagtgatagcagtcagataaggctgattacacacattcatttatattcagtaagaacatttttttcccagatgtaggacgatgacttgatttgtataaagttacctataatgtgttggtttaaaaacagaaaaatgctctttagagaggtcttgcctcaagatgttttcctcttaatactggagatgtggttaatggcaagaatagtattctaggatttttttctttccttttttcttttttttgagacaaggcctcgctctgttgcccaggctggagtgcagtggcacccttaaagctcactgcagccttgacttcccaggcttgaactatcttcccatctcagtctcccgagtagctgggactataggtgtgtgcagcctgtagtctaccacagctggctaattttttctactttttgtagagatggggtctcactgtgttgcgtagtctggtcttgaactccagggctcaagtgatgctctcgcctcagcctcctaaagcactgggattataagcatgagccaccacacctggtttcaagattagttattattatcaatgttgcatctgaaactgttggcatgccccatagcctgatgataaagagactcaacagtaagacatttgagggtagatggatctacagaggtgtcagtattattttttaagactgggtctcactgtgtcacccgagttggaatgcagtggcacaattaagactcactgtagccttgacctcctgggctcaggcagtcctcccaccacagcctcccaagtagctgggatcacagatgcctgccaccatgctcagctaatattttttattacttttgtagagacagggtctccttatgttgcccaggctggttttgaacttgagagcttgagctcaagcaatcctccggccttggaggattcttttttttttttttttttttttttcttaaaaaaataacagttattttaagaaaaatatattttaagaaaaaaataaaagttattttaagaaaataacttttcttaaaaaaaaaaaaatagactgagtctcactcttgcctatgctggagggcagtcgtacaatcataatggagctttgaattccagggctcaagccaactgacttagactcttgagtagttggtattatggatgcatgccaccaaccctaacttgaacatggcatcttttttttttgagaccgtcttgctctgtcacccatgctggagtgcagtggcaccatcttggctcactgcaacctctgcctcccaagttcaagcgattctcccgcctcagcctcccgagtagctgggactacaggcatgtgccaccacgcccagctaatttttgtatttttagtagagatggggttttgccatattggccaggctggtctcgaactcctgacctcaggtgatccacctgccttggcctcccaaaatgctgggattacaggtgtgagccactgtgcccagctgaacatggcattttttaagtacattgattgactgctttcgttcacactttattcgtttatttttttaaattgtattaattctcagagagctgtttaactaattttacaactggcattaccattttcttttttcctataatgaaaaattttgaaactggattttcttcactgttgaaagcttaaggttgacacagattttctaggggaagaggcatcagtccagttgttcaagattaaattagatgaacttgaagagtgaatgggaaggtttcatgcatgggggttgcctcatctctttggtggctttattttatcttacagcccaggagatgattcactctcacttcccttcactttcgggacaagaacttgaacatgtctcaaccacctgccttgtcattatggtccagaatttaagatttacttattctaggttaaacttgtagtattttatcgttagcagttgaattcatcattgtatgttgtcagcttcctcattccttgttattttttgcgttcttcttcttccctcttagtttgcttttcatttaagatacactgatggtctgtggatggtcaccatcttagtctttgtacatctggaaataattgtagtttgccctccactattacacagacttctgtgaatgatacggcccagccttccagcctgtcctcatttctctttagctgctttctctaatgatttgggtatcctcttccagcactgccttctggatgagtccttcagtattttccggtttacttattttttgtatacagtcatgtatttgtgttgaattcttattgcaataattatacttcttctaaaatttttatttggttaacttctgcctatttttggtccttaatttcttatatatatgtgtttcttttaaatgtgacttcatttaaatcattgggaaccctgatatactatatgaagtccctccctagttctctttccatctggaatcttccaggaatttcatctctttctctgtgcttctgtggggtttgtgtcttctcattatggatccagtccagaggcagaccctagggtggagccctcgttgtcttccccagggttgccaaccatggcatggaagagtggggaagcctgcctggcctggttcagcccccaccttgttcccctgctggagccgaggctgcctggcttagggcttccaggctcagcccagcaggtcccagtgtcagccccatttttttccataagtgttttttttttctttttcttttctttttttttttacacagggtctcattctgttgcccaggctggagtgcagtggagcaatcacagctcactgcagtctcgacctccttggctcaggtgatcctcccacctcagcctcctgagtagttaggactgcaggtacgtgctactgggcctggctacatttttgtgtatatatatattttttaaatttagagatggcatttctgcatgttgccaggctagtctggaactcctgagatcaagtgacccacctgtctcagcctcccaaagtgttgggattacaggcgtgagccaccgtgcccagcccatacatgtttcttgcgtacggaaatgtttgtctttttaagcttgcctattttgaggtttttccctctatccctgttacattttttagggcagggttgggaaggaatactgctcacagcattaatttccagatccaacctaagtaggagtccctgtgagagcatgggagctgggaatgtggacgtaagccatagttgggtgtaaatatgatgttaattataaagttgatttaacagtagagccatttaattaaggatgttatggaatttttatcccagtctagggctataaaaggaagccttaaaaggggaagaaaatagtttttaaaattatgctaaattgaactacaaagagtaggaatagagctggaatcatgggatggagctgctgggaggggagaaatgccaaggatagagatggcagagagtccaaacatgagctcccaggatgatttggtgtcagggatgccaagatgaaccttagtctgaactcccaaagctcaagataaagtagattacataaaagaaggaaaacacgaaaacaaaacctcatcaaagaatgtttacaaaggaatagtttgtgggatggagttttgggttgtggatagttttgttagaaaacatgttataggctgggtgcggatgctcaggcctgtaatctcagcactctgggaggccaaggtgggaggatcacttgcagccaggagttcaagaccagccatggcaacatagcgagaccctcattcataccaaaaatttaaaaattagctggacgtggtggtgcatgcctgtagtcctacctacttgggagactgagatgggaggattctttgagcccagaggtttgaggctgcagtgagttagcagttgtgtcattgcatgccatccttggtgacagagcaagaccctgtctccaaaatatatataaaataagaacaggaacacagtactgcccgtatttaatcactagtgaaattgctaccctaagtcaacttttaaagtagaagaccattttgaatgatttgcccattgacagggaaaaagtgaggggactaagttacagtgggtcgcttcccattgcctgatggatgggattagtgtgggggcagctggttggaggcaggggcagtggggtagcacaggaagaattggtgggtctgggagataccaaaggcatgggaatagtaagaacagaggtgaggctgatagaagaggtgataggaggttttgagggccaaagaaggagatgtttcggattctcatcaagattttatacagaagaacctgattgggtatatgttggctttggagaaaatatgaagtctagggaaaaccataagtttggagggtggggaagatggaagatgatgggttttatttgagaagttgtggatttgaactgcggtgctcctagagcctgcaggcagtgggggtgtgggacttgacacacatagagatcaggagagctgtaaagactcactgtgatggctcatgtgggtggtgactgacccgtgtgagagggtgctgctggcaggcagagctggcagaggaagatagggttgagggtctcaccgttgggtatacccacacatgagtgacagggaggatcatgccaggacattgctgcatgctagtgccttgtttcattctggcctttgcaaatgtaaatattgaagaatagccagcatggcagctctgggttttatctttttgtctggatctgtactgtccagcatcatggctgctagtcacatgtgacgtttacatttaaattaaatactattcaataaaacctgaaattcacttcgttagttgcactcgtcaagtactccatagccacacgtggctagtggctagcccatctctgcttgctggttagggccttgcgaggctgaaatgttggctcttattttctcatttgcctcagaatccaaagctgggctttaggctgtcagctgttaaggcatctagagaaaggtgtgctggagtgcagcgtggttgggcaccagtaaccaaatctggccgttgctgagaaccaggcttgtggggtgtctcctggaaagggaggtggggtgtgtggctgataaggatcttatctttagagattctcttaggcatcctgtgttggatgagtgcttcccagatctttaaacaaaataaaacaaaacacccacacaaacattttacaaagaaaaagaacaaatccatacttagaagtagaatgtccactaggtcaaagtaagaacaagagatgtgccaggccccaggactcatggaaattagatcatgtggtcagagttgatatcaaatagggggaacatagcaaaagatcttcttcttatcccacaggactctagttaggcaaattcttatgttttaaagccagctaggaaatgcgtaaataggggtgaatgcccatggcaagaaacaggaatcaggaaaaaaaaaaaaaaaaaaaaagcaaaaaaaattctgatgaacgatcgtaccctagggacattgatcccaaagtacagacaggaagcacggccagaaaaaggctgtgtgtttgctcagcagttcttggaccacctaaacctggaagcccagttaacagcccaaacttcctgttggcacaggcacggctgtgacacacacagcctgttgtttcagtgcgtcatcattcagagtcagggaaagcgtttaagcttccttaagcttttatttcttttaacagcctttgtgagaatatttgggtatcaagagtagattattctgtctggagatattagcggcatggaccgacgagtaactttatgaggtttagtcttaccagagagtgggagaaatactcctgggtgttcataagaaccgaccacttctcatcttaccttggtgtgtgttcttcagaacatgtaatgggaagagcccacagcctcacgttcctccattgattaaatgtgtctggtgcacatacctggtaaccagctgcttacagcccagtgggggacatatggcaagacagccagcataccatcagtgttagggtttgaattctgcacgggtgctgtgatagtgtccacgtgagacccttgcccagtcgtgttgtagggtgggccttgccggtcagatgaaggttcccaggggagataacatggaactcctaaaaaatgtctaggtatagtaggtcaagaggagggagactgaaggcctctcagctgagggtgtgcatggcagtgtcctgcttggggcgcaagtttagtgcagagtacagtggaggtggagatgagcagcagggatgctgaggagaggtcatagtaaatttgctcgttttggggtaggaaattcctgcggtgggtgccggggcaggaagggtctggagataggaaggcaagttagggtgcttacgcagtccaggtgtgagccgacagtgacctgacctggaaagtgcggaggaaaggaattcttccattcagcagatggttattgggcacctgctttgcgtgaggctctgtcctggaattggcctcctagtgatggtgggaggagaaaaacagtaaagaaacaagcaaatacgtcaatcttgtggcagctggtcactaattctgtgaagaaaaataaatcagggaggggaatagtgagaaatagaatgtgaggtcagacagtgatcatacaggacctgcaagccattcattaatttgtccttttaaaaataggaactgtgtgccactcacaggtctgggctctagagaacagcaatgaacagacagacaaaaatccatgagtttccatcctttttttttttttttttgacagagtcttgctctatcattcaggctgaagtgcagtgtcatcatcatggctcactgcagcctcaacctcctgggtttaagccatcctcccacctcagcctcctgagtagctgaaatatggcacatgccactgtgctcagctgatttttaattttttttttttgtagagacaaggtcttaactatgtcactgatctcaaactcctgagctcaagcaatccttctgcctcagcctcccaaagtgctgggattacaggtgggagccactttgcctggccacagggctttcattctggtgtgggagacaggcaatccacaatagaaataagtcaaatgtgtagatgttagatattgacaaacactagggaaaaaaataaggtagaggtatggatgctgaaaattcaggcggccaggaaaggctgcaccaagaaggcggcctttgagtaaagtcctggaggagttgtgggaagcctgcatgtgggcctcaagggcaaaggccccacagcaggggggtgcctggtgttgctccaccaggatgggcattgaccagagattccataggccttgtgggcctcaccagggtgttggcctgaaaaaaacctttggaggcctttgagcagagatgtgacatgctctgcctagtggggagtaggctgaaaggaaaagcaggaggccaggcaggagctggtggccctaggacaggtgtgctgacagcagctgcatcctgggtgcttgccatgtggaggtgggagaagccaccaggctctggagcagacctagtttctgtgcttttgggctggatgagggtgggggcaagtcccttcagaaagagacacccattccaggcgttgaaaagtatgtcaggagaaactctgactccagagggaggacggggaggagccacagtggaggaagggttggctggaggtgtggccgagagctttgaaaagaaggggcaagttgctgtcctggaagagactcctggaaggagcttcaggaggagacctggggcctgtggggctgtgtcctgatgggtgtgcctagcaggcaggaggtgagcaggacagagtggcgatgcggctcagagctgtgctgtgcaaggatgcagggatgtgaggatgccccagagcggaggggaggagggcagccaccaggatcagggacccatgctcctttctttccttttctgtttccttcccatcccttctttaagacaagtggccttggcagaaagatgtagggaggtacagtgaagaaaccatttaatggctgcttcagttcctctaaacccctgactatgtgatgacagatttgaacatgccccttttcagcagtgaaaagaaggcaaaaaggctttttggtgcaactaccttcattctaaaaaccaagcaaagaagcccagaacatgtccttgttcttgtgactttcgtaccaggtgctgtgaagttcctttttgtacatccctaaatagagagtttggagtacttagatcttaaaacgaaaagtctcagttggatggtaataatagttgtctgggaaaatgttctttctgtaagaataatagattttggaattgactatgattccaagaagggcctgaggatgaagagagactgtttcctggagtcggcccagggaattggtttaattctcctatttctgtaagatgagagttttaatatactgcataatggccatgatttaggcaggggatgcccttaacagcttgaagtggaacaaccaagatgagcacccttttctgttttaaaatttgtaagttggggggaaaaagtgttagaaaaggaatatgccaatatatgctttgaaatgaaaacatcaaaacgatgggatgcaagtgaagatttttgtgcatggtaagatgttcttttccttatccatcctcctccctccctccctccctccctccctgcctccctcccttcaagatggggtctcgctacattgcccaggctggtctcgaactcctgggctcaagcagtcttcccaccttggcctcccaaagtgctgggattacaggcataagccaccacacccagtcctagatttttaacttaaaaattaattttttttcctctggttttgaggtttcagataagtttatcatattgcaatatacttttaatttgaacagagttttggtagttttaaatgaaatgagagatgttagtaatacaaagtacacatctaatagttgggagacacacaatttgttacgaatgaaaatagtaagaggttcttgctacagtctcttactatagcaggcttacgaagttgatcagcattctggccatctcttacttgtgtgtgtgtgtgtgtgtgcttttttttttttaaagacacggtcttgctgtcacccaggctggagtgcagtggcgtgatcttggctcactgcagcctctgcctcccgggttcaagcagttcttgtgcctcagcctcccaagtagctagctgggactacaggcatgcacgaccatgcccagctaattttcgtattttttggtagagactggattttaccatgttggccaggatggtctcaaacttctgacctcaagtgatcctcctgcctcggcctcccaaagtgctgggataaaggcgtgagccactgtgcccggcctctcacctcttaatttctgtgaggtcaggtttatggaatcttggtcatggaaaaggccttagaggacctcttgtttgttctgctcttgctaaatgctgtgacaggaatgcatcagaagtagttgacaagcttccttcctttcctaccccatgtgatccccctgccttcatcctgctgtctccgctttctgtgggtcagcatcagttcttcctgggatcatcgtgacaacctctgtgtgatctccctgccccacagccttggtctcttctgacccctgattgctattcctgcctgtgccttttgcacttccaggactacttcagatttcctttcttctaggtgaatccccacttctaaattcctaatccccacccccactaacttttatttgcctaagctaggtaggcaggcttcttagttttaatgattagagataaaatatttcagattgatttctttaccataatctaagcccataattctattggagaaaaagttcattcttgctaggatttgataaagtacttgaggaggaagatatgatattggaggtttcgaggcagtaatcactcagttgtcacattccccaccctcttaaattgcccttaaaatggatgtttttaagcatccatagttctccctaggttttacggtacaaactacattgttggggtgaaatggaagaagcaagaatgctgatatgttcttctgcctcttttttgtagttctcatatgtgtattttctgtccctttttcattatttgtgtaactttcttcatttacaagagaaataagttcactgcagaaaatgcagaatggtaaaatgaggaaaacaaataatttaaaatctcactagccagaaaaacaccactttctgttattttggtagtaacagaaaatattttactgatattttgggtgtatttcttttttttttttttttggttgtgattgttgtttgagacagggtctcactctgtcacccaggctggagtgcagtgacatgatcatagcttcctgcagccttgacctcctgggctcaagtgatcctcccacttcagcctcttgggtagctgggactacaggcatgcaccaccacgcccagctagttgttattgttgtttttagtaggaatggggttttgccatgttgcctaggctggtctcgaatttctgagctcaagtgattggtctcccaaagtgctgagattacaggcatgagccactgtgcccagccttgatgtatttctttccagagatttaagacaagtatttgagtgttcttttataaaattctcatcaacacacaatctgctttataaagactttaactttgtatcatatcgtggcatctcaatgttattagaaacagaacttgtaattgtgacatatagcaaatcatggatctaacttttccacttgcattgggactttggattgtttctaatgctttgctataataaataacagcctagtttatattgaccttattgtatctgattgctttaattttgagtttcagtgaagccaaacacttctgccagcattccttggccatttatattctttcattgtgcctattcttctccctagcccctttattcctgcggagtaatactggtgatcaaagatactgcatcatacagaacaattacagagaagatccctggatctgatagcactttgagggaatagagggagaaccagccgcaccaccagccagatctgtgcctgtcattactgatagccctaggatagggggatgtttactctgtctctgtttagggggagcagtttttgttgtagaaggaagtgtctgtatctacagatctgtgtctgtagctccgttcttgctcttttcactttctgatatacagatgatgttctgtatacctgtgtcagtgtataaggattatcttcattgttttttataactgcaaagtgatccatggtatagatacaccataatttatttaattactgcagatagacatctagactgtttctaatgttttgctattacaaatagcactaccctgaataacctggcacataagttgtttcactcaggtgtaattgaaggatagatttccaagagtgagatttttgagtcagaggggatgtgccttggtaagctgagggggctactcaccaaattgccctctgttgaggaatttcgtcagcaatgtgtaaatgcctgttttcttgcatgcttggcagcagaatatgtggtcagactgggctcttgtcccgattagtaggtagaaagaggtttctcattatagtttggtggagtctcgttctgttgcccaggctggagtgcagtgtcatgttctcggctcattgcaacctctgcctcccaggttcaagcaattctcctgcctcagtctcccaagtagctaggattacaggcgcgagcctccatgcccagctaacttttgtatttttagtggagatggggtttcaccatgttggccaggctggtctcgaactcctgacctcaagtgatccacccgtcttggcctcccagagtgctgggattacaggcgtgagccaccgcacccggcctctcatcatagttttaatgtatatcttcttatgagtaaggttgagcatctttttactgttcaagaagcatgtttatttccttagttattttcctgttgggatgttagcccttttcttgttgggtttgtgtcccttccatatttacattttagagacatgggtttgttatctgtaatgtgttagcacctggaaagaatgggagaggacggtccgttttgggtggagtgctgtaatgtgctgcgtggcctcaggatctgttcttgaatccatctggggacaggatccccagggacatctcttagaaacctcacctagcagggaagatgtttgaagtgcccaacctagtgccaggcatgaatatgtgccaggcagacagtagcagtcaccagcaccacctgcctggggtgtgggaggagcacacactgcagagtgtttcagtgtggaccttggcagacacatcacccgcccgagctctgctgtgggccggcatggggagaggtaaggctccttctggctcctcttgtcgccctactgggggacaggtgagatgcagctggaatccccggggtgcttctggctgccacagccttagccttctggagaaggcagccctaagaagaccaggctgggccaggcgagtggtggaggctgagccatccagcagcatcacctgcactggggagttacaggagccatcctgtgggaagaggcagtgaaagcaaaattagaggctttgcggcatcagccagattcaaggtcgctagtgtcatgttagatctatcggctgctgcatctttttgagatgatgtaatctagattgacaagctttgggtgtttagaatatgttgtactgtactcacttgaatttatttttcatagtggttaattttgaaatttctaataatattgaaagtaggtggaaagttttcatgttcatagtaaaggagcttgcagtaaaggctgggaaacacgaatctattatcttctgtattcaaaacacattttaattgtggagtagatttggatacaagaggaaataacggtgtgtgcacacattgaggagggggattaataactgtgtgttacctttcttttaaaagaatagaaagcagaaatttggggaactttattactattctgaaagcgattggtttagtataaagtggttctcttagcggccagacacgatatagtaagtgggaaattgagttctgaacactctcattggaggtgtggggttttgcaggtgctagtgccctccgcttgacaggtgtcacgaagcagcacatgcactgtcacttctgcttgagaaatgtgggcacacacagctgtcagtttcgcctggcactgctgtgatactgacacctctaggcaatgacttctgtcactcctgcttcctacacctctgaccatctcaggagaactgtttagaaataagtactttaataccattgtcttagcttagtaaaaataaaacacaagcaaaaagacaagtgtaagacttgactttgagtgtggaaatgtgtccgttgctcagtaaatacaatgcaaatgcaattgcatattggagacaaaatcatctggttaggcagagaaaacctcctttcatagctgattgattgtacaatgttagtttaggagacaaaacttaaggccacgagtttagtttaagatagttttggagaagaaaggacatcttgttcccaaaaggggtatactaatctgctgatatttttataaaaacttgatcaatttcctgaggtgaacgatgccaagattcttctgttatctattagttacccaaaagaaaaccagactttattaagtttagaaagcttcccaagacatgttttatttcccagttaaaataatatttaaaagttccaaaatatgaagctttgctactatcatcagcattttaatccttttcccataaaaaattcagtcctcaagaactgatttttaccatttgatttttaaaattaaattttgcattaaaaataggccattagagtatctattttaataagccaaaggaaaaaatgttggtaaggtagactagtacttccagtagaactcttcatctgtaagaaccatttaggcaagaactatttaggcagccccctgcacgtaaatagatcagagacgagccagtcagacaagagcatttccagctggtgtccccgtcttattacaggcttccttagaggatgggggtagcatggagaggagagctacatctcagctgggcaacaggagggtagcagggggaagctgggctctgaggtccccagggacagacagctggacctgtgcaaatcataggttttctaggtcagtagtatttacagttaaataaacttcctggactagcctggcaaagtaaaccttccttttttggatgatttctgtgggtcaaacacattttgaattggcttacaaacattccacccctacctcctgccagtctctttgggactggcacctccatccacccagcttcccagctgagaaacccagcctggacactttactcccgtgccccctgctgtgctgtgatggcatctccccgctgtactcaccacagagctcccatccagacaatcttcagggggcattaagtccacatcattgctctctcctgaagctgactgtctttcccagaccactgttaacacctttgcccagctcctgtctcctcgtgtgccaaagggtcattcctttaccccacccatccactctcctgctgcacccagaatggctgtccagtgctagcatctgattgtggcactcctgttcttggcatttctttgtggctactgactgcctcctgtgtaacagcggaattccttggcggggcactcagtctggactgagctcctgcagggaggcaggactgcattctcattgcctgggatacaaccacaatttgttgaatgaatgaatatgtgagctttttttctaggcttaggagtgtctgcattttataatacagatgttccttgacttatgacagagttacacccctaaaatgcatttaatacacctaacctactggcaattcatagcttaaccccgcctacctcacatgtgctcagaacccttacattagcctgtagttaggcaaaagcatctaacacaaagcctattttatggtgaagtgttgaatatctcttgcagtttcttgaatactgaagtgaagagcagaggggttgtatgggtacttgacagtttctacggaatacatatcacttttgtaccactgtaaagtcaaaaaatcctaagtttaaccatttaagttggggatcattatacttatttgtgtatgtataagtagtgagtggaatgtgtcaggggagcagtaggaattgctaactcatttcaaaatctatcttcttagtgccatgtatacagatgattttttttaatgtatcgaggtgaagtttgcataacatgaaattaaagtgaacaattcagtgatattttaatacactcacagtgttatacagcctcgtccatttggttccaaaacattttcatctcctgcaaaggaaaccccttactggtaaagttgctgttccctgcagcaacccgagataaatgcaggtgaaggttagtttggctagagtcagactttcaatcatatctaggtttctctaatgatttagtaactgatccgtgttttaggagagttcatcctgagagcgtgttgctcttggcttctcagtgggttgagcactgctgcgatatgacttggagcacagttctctctgtaagttaagagtttcatctcgtggacctgaacttggccaggaatgtgtatcctcccagcagccagtttttataggtaaaccagctccacaaactcagttggcttgtgtaaaaaactataacatgtttgagaaataattttaaaagcaggtctttatttgaagtaatgtaagagaattctgctctgtaggagtatgtactaattaattgagatctctggcatagtttttatttttattttattttattttttatttgttgagatggagtctcgctctgttgaccagggtggagtacagtggcacaatctcggctcactgcaacctccacctcctggattcaagcgattctcctgcctcatcctctcaagtagctgggattagaggcgcccatcaccacgcccagctaatttttgtatttttagtagagatggggttttgccatgttggccaggctggtctcgaactcgtgatctcgggtgatctgcctgccacggcctcccaaagtgctgggattacaggcatgagccactgcgcctggcctctctggcatacttaaaaacccacttcagacctaggttataatctgtatgaccttgaatgagaaacctaatttttcactgccctgatttccttgactacaaaaacacatgaattgggaatctctctggacctcctcaatccaagctgtactgctaggattttagtcttaaatttcttccctattatcaaaataaattgtacttactcattttaggaaatgaccaaaatataaaaaggggaaaaagttggcaaaaatggccctaccaattaaggacaaccactgttagcattttggagtatgtctttttttttaaattatccatttttaaaaaagcagtatacaaataacacaaatacatcctgatcataaaagatccaaacacttacaaagggttgtgagtaaaaagatgaaaggtgtctgctattgccgttcttgtccctaaggcagcacccttcctactggttgtgattttcctgtatgcttttctgtcctttttagacaagtggtggggtcattacaattttcttttttagctcagttgggataattctaggcttattgttttataactttttaaaaacagtatttcttggagtttttttttaattagtacatcagctagctatttatttatttatgtatttatttagagtcgatgtcttgctcggtcacccaggctggagtgcaacccccacctttcatgttccagcagttctcctgcctcagcctcctgagtagctgggactacagatgtgcaacgccatgcctggcttatttttgtatttttagtagagacggggtttcactgtgttggccagctggtctcgaactcccgacctcaggtgatctgcctgcctcagccttccaaagtgccaggattacagtcctgagccaccgtgtccagtgctttattatttttaatggctgattatctcctctaaatgagtgtataataatgtaactgtgtctttttgatggacatttatgttgtccccaagtattcagtatttcataaattacagcagtgatcaaccttgaatatatatattacctgcatggatatttctagaggataagcttctatgagtataattgctggatccacagaaatacctgttttaaatcccattgccaaatttccctccatgaaggccattccaccaagagcatgttctctccaagaacacaggagagtaactctcccccataccttggtcaatacctggttcagttttttaagtttccctctaagtttgttttttttaaaataaaattttaataattatttccataatttaaaatgatatggaacagcttttcatgtgttttattgtatatatgtttttcttctatgaatgatatattcctagcccttgcccatttcctttccatcctttttccttaggcctctcagggatgaattggatcgtttggttttattattggtttgaggtgttctttacgcatattgatactgaccctttttatatctgctgcactgtattttctcctaggccatcacttgtcttctgcttgcttttagtgtatttcacaatgccagaatttgaacttttaatatactttttaaatctgtagtttttaaatgtagttgcactgttaaccatatatacagttaccttaatatttattacatgtgcattttccttgatattactctgtgtaaaaatcttttcccttgtagtattctgggtgtcagtggcctataactagttatttgagccatgtgtggtggctcatgcctataatcccagcactttgggaggctgaggtgagtggatcacctgaggttaggagttcgagaccagcctgaccaacatggtgaaaccccgtctctactaataatataaaaattagccaggtgttgtggtgggcacctgtaattccagctactcgggaggctgaggcaggagaatcgcttgaacctgggaggcggaggttgcagtgagccgagatcacgccattgcattccagcctgggcgacagagcgcgacatcgtctcaaaaacaaaacgaaacaacaacaacaacaacaacaaaacctaaaaaaacaaaaactagttatttgttattataaacagtgattactttctttgggttaaagcttttgttctcattattgttctccagtatagattcctagaagtggaaccgtttggctaaaaagtaaaaatattttatggctcttgctactggctggcagaacccgggacgatggtgtggccccttaccgaggagtgttctccagtgggctggtttacttaggtgaacagcaaagcttgagttcctccagctagaacatttccccttctaggtgcaggaagtcggcctcaggtggttatgtgggcagggatcttaaccgaggcagctcagggtactctcacctgttcagcctgggcctcgtccacaaacagcatgggcctctgagccaaacttcccttcccctgaaggatgtgggggtgcccctgctgaggttgccctgggattttatttcttttctccccggctgagccttctgctaaggcagcctccccatacggtacatggagtatgtttctccatcaaaaccatgcctggtcatgcactcaccaggagaattacaaatggctttcggggggaggaaaatgtggttcacgctgaaacagcctctaagtggattgtctctgcaggtggtgataaatggaggcgccacctccagcggtgagcaggacaatgaggacactgagctcatggcgatctacactacggaaaacggcattgcagaaaaggtaccccttccgtcaccccgtgtccccactcccaccgccatcccctcccacaagtgctgccccggatctggatccggatccctttcagacacttgcatgtccttcgtctggggcttggtctctgactcccaaggggctgtgttctcttcataagggaagtaggaggagccatagggaatagaagttactagttttttttttttttttttttttgattgttttaatggcatttaaggtgagaaccatagaggaggatccaggtatttaaaaaggcctcagccaagatggcagagggaagtggttaagagcttgaggtctggcatcaggtctgggtgcaaatatgagtcagactgaggaaattatagaagttctctgggcctcagttccctgtctctaaaatgggaataaaaatgtcaacatctggttgttttgtggattgaatgaaatgatatgtgaagttattagcatcgtgcctgttacagatacatgtgcagtaaataagagaataagggaaatcagcaagtggtttatgcagcctatgaaaatgcctttgagttttgaccgtagcacctttggcaccttagtgtgccaatggaaatggcacactaaggtggggagaatcgtgtttgtggtttttttgtttatttttgttttgctctgtgcctcgttccatctccttgaatggtcagactttgtgaccatagaggtcaggataaagttgcccaaagcggctccaatctgggctcagtggctcacacctataatcccaatactttgggaggctgaggcgggaagattgcttgaggccaggagtttgagaccagcctgggcaacgtagcaagatcctgtctctacaaaaaaaaaaaaaaagaaataattatccaggtgtggtgatgtgtgcctatagtagcagctactcaggggcaggagaattgcttgagcctaagagtttgaggctacagtgagctaagatcatgcttctgtactccaactgggaagacagagtaagaccctgtctctaaaaaaaataaataaataaattcataaataaaaataaaataaagtaggtccagatatcccgatttctttttttctttgtatctgccatgatgtctaacatatgagaagttagataatctgatatctccaaattgtatcgcagctctgaggctttcatttgagttttacttgatagattttaaacacaggttttatttatactatgaaaatttactaattttcagctgacataataagaaactaaacaatttatgtaatgagaaattctattctggaaccactgtattatactgtagacagtgtatactatgtattctaataacagaccacccagaagttgacacatacaaatatagtacctgagttgggtattagcatggtgagttcacagtgtaatcactaaagtgattaagaacaaataaattgtattgaaattctgaaataaccaaattttatgcccttttaaacaaaattccagtctgggatatggaaatttcatttttgcctctcaaccaatattgttattattttcctgctgcttggagctattataaattttatggaggttaattaaagtagattcaggcagagatactgaaattccagaagtgcggggttccaagctgctccccaaaggttagtgcagtggtgtttggcatgtggattggtgcctgtggtctgcagctgaggcacatcccacactgccgggccgcagctttcacacggtccatcttgtaacaaagggcttcttcacagacttggtgggccacatataatcctctatgccatgattccaggctgtcatgttttcagacttcctccttctctgtctggagatcgtctttagaaataaatagtgatgagcattaacactttggggcttagctttaccttttactgatgggagggatccagttgtaggaaaaatgtctctagcacatttatgctagatgttcattttcctgtttgggtgaacattttttcattgtctaaacattgatacatttgtatttccttgaataccaatgaaatggagtatcttaatattttcctggccatttttcttactttatgaaatgaggagggcagtgagaagagctgctacatattaaatagtgctagttgggctgggcgtggtggctcatgcctgcaatcacagcactttgggaggccgagatgggtggatcacttgaggtcaggagttcaagaccagcctggccaacatggcgaaaccccgtctctactaaagacacaaaaattagccaggaggggtgtcacacgcctgtggttgggttgcagctatttgggaggctgaggcaggagaatcacctgaacccaggaggcagaggttgcagtgagctgagatggcaccactgccctccagcctgtatgacagagtgagactctgtctcaaaaaaagtaaataaataaaatgctagtcattaagccagaccctcagcgggctgtttttttttttttttcttgagacagagtctcactctgtcacccaggctgaagtggagtggcccagtctctgctcgctacaatctctgcctccctggttcaagcgattctcctacctcagcctcctgagtagctgggaccagaggcgcacgccatcataccaggctaatttttttttgtatttttagtaaagttggggatttaccatgttggtcaggctggtctcaaactcctgacctcaggtgatttatccgccttggcctcccaaagtgctcagattacaggcgtgagccaccatacccggccaaaagtagtggaaggctctcaggaagccggattgccccagtgtgagcagagtggcatgtaagctggttattaaagagcctgcactggatgtgctgccctgtgtgccactgggccttttgctgcccgttgtttcaaatgcttagttgcaattatcatattaaatacaagataaaataaacttgtcttctataactttgagatctacttttttttgttagagaccttttctgacttggtccaggtgggtggctcatgcatgtaatgccagcactttgggaggccaaggtgggtggattgcctgagctcaggagtttgagactagcctgggcaacatggtgaaaccccgtctctactaaaaatacaaaaaaatttagccgggcttcatgacattcgcctgtaatcccagctacttgggaggctgaggcaagagaattgcttgaatccaggaggcagaggttgtagtgagccaagatagcactactgcactccaacctgagtgacaaagtgagactgtctcaaaacaaaagagaccttttctgacttgatccctgtggattctctttaagctatcttttgttaaaggactagttgttccaaaaaaaaaatgacattcattttaacatgattgtctaatagtaaacagtccaaaaaatggagaaagttgaaaatgtgccccctacgttctttatatattctacgtaaccagcggctggcaacctgatgtagagtaaccgtcctaaaactgagatctgaaatctgcaatgttccaatatctgaaattttttgagcaccgacatgatgctcaaaggaaatgcttgctcattggagcattttggatttgagttttgggattgtgatgcgcaaccagtaagtatttcaaaatcccaaaaaaatctgaaatccaaaacatttgggttccaagcattttcaacctgtatgtatattccataccactttccacataggtacacacaaacagatgccccagatgttaacattttactgtattttcttcatccttcttgtaggcatattattatttttgagctgttcaaatctcacagacataatgcctctttatttagggaaaatactgcatgtgtatttccttaaaacaaagacattctctttgttttataacttcagtacaatgttttttgagatagtcttgctctgtcattcaggctggaatgcagtggcacaatctcagctcactgcaacctccgccccccagtttcaagcaattctcatacctcagcctgagcctcccaagtagctgggatcacaggcgtgcaccaccacacctggctaatttttctatttttagtagagacggggttttgccatgttgaccaggctggcctggaactctggcttcaaggaatctacctgcttcggcctcccaaagtgctgggattacaggcatgagccaccacacccggtccctacagtacaattcttaacactgatgaattaaattattagtcatacaatacctaattgattttattacttaatcccaattttaaaatatttaatatctacaagctttattcacatttcctcagttgtccaaataatgttcattattgtaaaataaataaataagttaattaattttaaaagttttggtccaggaatcaaatcaggggctgttgaggcatttactttttaggtatatctttagtctcctttaatctggaacaatttttcgttgttaatgtaacatggtacaagccagtttactttgtagaatctctctcagcttaggttcgtcactgtagttttatcctgatttttcattagtgaggctgcatctctttacacatgctcaagacccatgtgtatatccttttctgggccagtttttcctggcattttcaatatttagctttgaggctgctattatctcaggaattgtatctttaaatattaattccagtctattcttttggtttctgatttgggagctgcaattatgcatgttttgtttgttctttgcctgcctcctccagctatcagttctctttaatcttttttttcctcttagcacggagctttttcattctagtctctgacacttactctgttttgcagcttatctgttcttccttgtgctcctcacactttcatagttttttgtattttttttcctttccatctggccaaattatgtaaactcatgtttatttccagtttcccttaaatgtctgtttgaattttaaggccttccttagtaagaatgattgttttattttcaaaatgcattttttcattaatccattgaatactgtagtatccttctaatttgttaacatgtcctttatttcttaaatttttcttatttctttggttaatttctatattcttttttccttgttctgacatttaacacttaactcttacctatatttgtctttttcttatttttgagagctacctttgacttccagcccttctgttgagttttaaaaaactatcctgtgcttaatttctgagacctcttttattgttttttggttttgtttactggttaaagtctttaaaaagcattctttgtctcccacaattgaagtaactttatttttctgaagatagtttttttttaagctttttaaaaaatactacattgattatattttctgtttctttgccttcatttttttagtctttcttcactgttccaggataggaggcaataaaagataggattgtgaggtctttgtgtgtgatgaagtttatctaatcgtgggcctgcccttgagtgaccaggtggaaagccgtgttgtctctgtgggatctatagatgtcactatcttgtctttggggctgatcaactttctctagaaaggaatcgtgtggtctcctgtgggtataagtctggcttctgtgacctggtttctggcattctggaagcagatgagtatcctgctgctgctgttttccttgatcgctgtgtggtattcctcagcctgagggctttccaatttatattcttcaaaccatacatatttgtttcttgaaggaggaggatagcagtagttaacacactgtctgaccagtttgcggagttaagacctgtcctctccccattgctactctgtctagtgcttccaagcatagcactttctggggtcctgctggtcagccagcccacctcttcacagcatccttctatgagcacccagcttgtgcattccttccctctcccaaattggtcacaaatcatccaaacaatttccatattaaaaaaaatattaatctctttttcttgatctcctctttgctttgtccttgttgatgagtatcatatttattcctcctgtttttaggacttagaagaaaagacacatgtggtcaatctaccatgcttaactagaactcaaaagctggcttgttgaaaagaataatgaaattgatctttttgggttttttgttttttggttttttgttgttttgttttgtttttttgagacagagtgtcactctgtcacccaggctggagtgcagtggcacgatcttggctcactgcagcctccgcctcctgggttgaagcgattctcctgcctcagcctcccaagtagctgggactacaggtgtacgccaccacacccagccaatttttgtattttcagtagagacagggtttcagggtttcaccatgttggccaggctgacctcaagtgattggcctgccttggcctcccaaagtgctgggattacagacgtgagctaccagcctgttctgttttttttgagacaagatctctgttgcctaggctggagtgcagtggcatgatcacagctcactgcagccgcaacctctcaggctcaagtgatgctcctacctcagactcctgagcgggtgatcactggcatgtgccaccacacccagctaatttttgtttgtttgtttttggagacagggtctctgtctgttgcccagactggtctcgaactcctgagctcaagcagtctgccgaccttggtctcccaaagtgctggaattatagacatgagccaccatgcctggccaaaactgatctgttgtggccctgatcaagagaaaaaaaatagaaagcacacatatacattagtatagtaaaaaggagaaatgtacaagagaataatacatgctactttatgataatcagtttgaaacgctacagcgggggttggcaagccaaatttggtttaatatctgttcttctcagtagagttttgctggaacacagccacatttcttcgtttacctattgcctaaggctgcatccatgctacagtgacagaaccatgtggctcccaaagcttgaaatatttactgtatggtcctttataaaaaatatgtgctgactgtgctgcagaagaaatgatttcctagagaaagagactacaatcgaccccaaaggtgctagactagataaataaccgcagaggagatagcaaaggttattaaaaatgttaagaaggctccaggcagagaacagcgttctgagttcactctagtctttggagcacaggcagtttttttgttctttagattattttggaccatagaataagatggaaagtctttgtaaagtgacgtaattatttatgtagtcatcttttacagaaaccttattagaggtttttgtttttgcagtatttaaaatagctcatagtttacagtgatcactgagtgtggcgccacagtgcgtagagtgcacaatggccagagtggtccttctgtcatcaggagggggggcacagcgtctgcctcacagtgttgtctgatcctcttgaccacacagccccctcctgtatcattttagtaccagttgtggacctttacactagttttgtttctgagttgtagggctaccctcattactaagaaaagcttgtgtgtgtgcatgtgcatacatgcgcctgtgtgtacatcttaacctctgcctggatgcgaaaagtcttgcttttttttttttttttttttgtgacagaatctctctctgttgcccaggccagagtgcagtggtgtgatcttggcttactgcaacctctgtctcctaggttcaagcaattctcctgcctcagcctccggaatagctgggattacaggtgcacgccaccacgcccagctaatttttgtatttttagtagagacagggtttcaccatgttggctaggctaatcttgaactcctgacctcaggtgatctacctgccttggcaggtgctggaattacagatgtgagccactgcacctagccaaaaagtcttttcatctgccttataattaacactagtggttttggaattgttagaaaaatgttgcttacattactgtataacaggttgtactagtctatgatagggttatgtattctgtcttcagacatttctctttgttatgaaatactttgtcatgttactttgtgagcagcagcaccacctgtgtggctgtagctgacgcggtgctgttgagctgacctttgtgtagtgagccccaggtctgtaattccatcacgttagcaaaatggtgccctcagttcagaagttcccaaatcaggttctgtgatttatgagaaagactcagagaattcagcagagctgttttactcacagttaagggtttttttttttggttgtttttttcttcagagaaaggatacagattaaaatcaacaatggaaaaaggcacataggcagggtctaggagacaccaggcacaggcttgcagccatcctctcccagtggagtcatgcaggcagtgttcagttttcccagcagtgatatgtgataacacccattcagccagggaagctcatccaagccttggtgtccagggtttttaattggggatctgtcgtataggtatggctgactgcctatgtggctaactttaattactcaccagcccctccagaggtcaagctgacactgtgtggccaagtttcaggtaaaaaaatatgtataaactagagaagaggcctcactatgttgcccaggctgttcttgaaccctggtctcaagtgatcctcacaccttagcatcccatggtgctgggaccacaggtgtgagccactgcactgggcctaaaaagacatgtttaagaggcagaaaccccaagagctcaggttatcccccacgtaccaggcaagactcaaccctttctttgaaatgtgcggggtttggacaacccagacctgctgagttaatctttattgtacatcactacatgctacacccctcagacacatacgtactttttctaccatttctcccaacaagtttttaaagacatccataatccattgtaacaaattcaacacaatgtaaatttgccagtatcccttgttaggacggaagagaaagttttacccaaaaggtcatattcagttacatttggattagatgagatgtcagcttccatcagacatttaccttctggctgtgaaaggtgagggtgaactgtgtcccttcttttgtttaagggtattgggccccaaaccccaaacccctgttgcctccatgtgggtggaacacatggaatcagcatttttccatgtggatatctcttcattttgtttcctgttaaacactttgtttgctaggttataaaacatttcttaaaatgagatacatatcttggattccaagaaatgattgtagaaattccaaggaaagattatttgtgtggtgtttgaaaccagagcagttttgaggttctcctggggaactcggggctaccttgagttttctgtttggctcagatactgcatgagttcagaactgatgctgggggtgattggaagaggctggactctaacctaaagtgactggtctttatgatgatttttgcttaaaaaaccatgccacacttaatgttttaaaatattttttttactagtgttaggagaaaaagaagaaaaaacctgtcacctaaactatgaatacatttttaatgttttgttttttaaacagaattcaaatcaccgtgtttatatactttagaattactcttttcacctaacgttatctgagcaatagtgtttggataggagggtgtagaattttaaagtacaaagatcctttttacttgcagggatgaagtgggctgggaggggcagatcagtgtgctgtctctttgaaagtggttaaaattttctaagatttttttcatctggggtctcacgcaaggactgctcgtgccaaggtatcattttgtggtctcaacctgggaacatctctgtccatgcaggaggatccccaggcctggggagaagctctgagcaagtttggtgttctcagggatgagatgttgcccaaggacgctgaccccccaaattctgaggattgaccatcccggtgggcgactgtacttgagccaaagagaatacttggcttcaaagatagccaaggctcaaaactgcaggaagatggcaaccacttgataaagttgtttttctgtaatagtggcctgtacatggccgagctaacactggtcttcacgtttaatgagcaccttcttttctccttctggctcgcagagctctctcgctgagaccctggatagcactggcagtctggacccccagcgatcagacatgatttataccatagaagatgttcctccctggtacctgtgtatatttctggggctacaggtaagatggttcctgtaggatgtgtaactaccagcaggtgtttgcattgtctaccatctggaattgtttaaaaattccactttggtttttgtttattgaagacttttataaattcctcttttaagagtgatgagtaggggctgagcacagtggctgatgcctgtaatcctagcagttttggaggctgaggtgggcagatcactggagcctaggagctcaagaccagcctgggtaacatggcaaaagtccatctctacaaaaaatacaaaaattagccatgtgtggtggtgtgtgcccacagtcccagctactcaagaggctgaggcaggaggatcgcttgaggttgaggttgcagtgagctgtgatcacaccactccacttcagcctggttgacatagtgagaccctgtctcaaaaaacaaatgatgaatgggaattgttgacatcacagcaggaggaagaaaagaacaggtagaatggattaccagggaaaagaaagaagatgttcagggcacaagcaagagcagtgacataaaggaagggaaaggaaatagagttatagaaagaaggaagaatagagaaaggagaaaagttgaagaatagagaaaagagaaattaattttcatctcccattcctggcctagttaacccacccacaatcatggtaacctctgccatgaaacaggagctacccggaaaagtgccatgttggccaggacctaaatggtaggttttcagtcttattttttaaaggaagggaaacttgccatggtagcagcagctttgtctgctgcagcttccagtgggaggggagggcagccgggctcagggacaaggtgggtggtgacatagctgatggaggcctccggcgtctttgatacttccctcctctgtcttcagcacccttttccctttcataggatgaacgcgggacgttttggagaaaggggacaacgtggggagggtcttttcttaaatgcacactcctggactgaatatgctttggttttaacttggactctgttctgaggtcggacttagcatttttcccttctcaagtttgtgtggtcagttcaacctaaggtatctcaggtgccgagaaaatccatctcattgtccagagaggttcattcaccctggggtggggctgccaacagctgggtactttggttgagtttccagttgccccgcccttccctcaccccgtttcaggtatcacagcccatggtaaccccgactggcaggtgtctgttgagtaggggaggagtcagagcaaaaggagctgagtggcctcggcaactagtctaccttgggctgagcattctgaaccagattcaggaaggacactttttggaatgtttatcttataaatgttcccagcagtcttccctggtcagataggagtgggaaaccctgcctgcatcatgcccttcctgacgattcagagtacataaagttgtgagcagccctgagacatcctgaacaggagtatttcaccccaggaaactcctttacagtcgggcttcatgggctgcatgtggcatgtttggctaacgtgggcaggaatgggaagctgctggaagaaaagtaggaagtttgcagaacagaaataagaactggtcaacaggggaagggagggaagtgagtcgtgagtgctgggactatcctaccagggctacaggtgtggcggggggttggggggactcccaaaggaaagtgggatggggttctttctggaagattcccatggctactgtacgcccttaaccctgccctgactggaacagacgaattctttgttttcgaaaacaatgccagctcacagaaaaagacagaaaacactccatgcgtatgtaacttatgaagcttatgtaactttaatccccagacatgaaagaacttttttaaagaaatagactaattaacctagaaatgtagatgcaaaattctgtataaaatattagcaaatcaaatcccagaagaaaaatacagtatgactaactagggtttgtttcaagcatgcaagaatagttcagcacatcacaattcatgataacagattagaggagaaaggccttatggttttagcaatttatgccagaaaagcattttggggaagaaacccaaatatttctaataagaattacataagtaaaatatcaccagtgctgatattgactgtttcctttgtgaggcatggattcatccaagtaataagtaataatgacagtgaatagtaagacaataaaatgtaatgaaaaggagaaatgcagctgggcgtggtggctcacgcctgtaatcccagcactttggagagggagaggcaggcggatcgcttgagcccaggtgtttgacaccagctttgccaacacggtgaaaacccatcgctacaaaaaatacaaaaataagctgggcgtggtggtgcgcccctgtaatcccagctatttgggaggttgaagcaggagaattgcttgagcctgggaggtggaggtcacagtgagccaagatcgcaccattgcactccgtcgagggcaatgggagtgaaactgtcttaacaacaaaggagaaatactgaaaaagaaggaaaaaagtatggcttggtcgaaaaaccaaggagattctttatgtgggctattttttaacgacaataagagagaagaattaggatgaaatcaagaataaatgaggaagggtttactgtttctcctctgacccttttcctgcccacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggtgagattggggtactaatgggggatgccaaagcccccagaaggcattgagctgcgccgtttgcctagggctgttggcaaggacagaatggaggcacgggaatgtcctagtggccgttggtccccacccctcagtgttcctcccagtcatttcctctcttggtgaatggcaccaccgccaccttcccctacccagttgtccaagctggaaactcagcctcactctccttcccctgcccccttggcaagtcatgctcgctccccagcacccctctgtgcccctattccttacgttcagaccagagtgtcccaccaggctccccgttggcttccctgcctccagggcaccgctcttggactcactttgtgccccacacccagtgccatctttctacttccacaccctcctcagggtgagccacactgcagctctcctccctttttacacaccaggctgcacccagcatttaggcttgcccttgctctctgccccacttccatctccagccatgcctctgagccctgtctcctgccttccctggcctcactcccaagggcccgctgtctaccttcttgtgtgtcttccctcaacccgcctggcacacaacagctcatcctccaggcccagcttgtcctgccctcccgactctgtggagcccttcattgttctctgaattcccaccttgttttcatccttccagtgtggcctttattccagtttgtcctttttgtttctatgtctttttcccacggtgcttcctccttgatgccagggctttggcttgttcacttctgcatttccagccaccagcttaaatggacgtggagctggcacaggaaggaagagaaacatccttatctaccttcctacctcctcctgcaagcttgccttttcctctcctttcctgctcctctcccctcttcgcagtgcagcctcttgctttaccccagggcactgctcaggaagtggagcctgctctggcaggactgtcctaagttcacggccagctgtctcttgctctgtcagagacaggctgagtaaggcctggccctccctgcggtgggaggtgggtgtgagctgaagtcagggactgcattctgatgagtcagaatccttcgggacctcagggttgccctaacgcggcacggggataggggagccttggagggcggtgagccatgtgcaggtgttctggttgccagggtaggccacaccctgggagggtaggctgcaggtctgctgatggaaagaagctatgtggactaaaggctttggggctggcaagctctgatggttcccagatcccagcccttgctagtctgcccacaaccaccaagctgggctgaagggaggagggtctcctcaaaccccccagggggcagggcagggatatcactgaccgactaggggaaggagatgtggtctgggccttccaagaagggctcaacctgactagcaccctctttcattctttgggtacagtgttcagggctctgtgcttcaagtccagaatgcacggcagagctttttttggctcactcaggatccttaccttgcccatggagcactggttctctggggagatgttctttttctaaaccgctgacttatccgtggatttgtaggcataatccctctgtgaatttggtcagtgtctctagctgagcattattggttgacctgaataggggatgaaagctgtgtttattgcagtgaagtgtgtaccgtgtgcagctctgccccagctcatgccaaggaggccaggcctggccagcagctgagcctgatgggcaaagttgctaatgggacacagaagggagggcctgggggaacttggggtaaatacttttggtcacagagggcatcatcttgcccactgttggggcacaagacctaaacagaactacctgggtcagcgtggttcacctccctgctggcctgggaagcagtttgagcggagtaagaacaggagagggatttgacaccctactgggatggctcagggacccaaaatgcagagctgtggcctggaggagggtgcgtgtctgtgcgccccatgcccacaaggctgggtgaaagcagcctttcttgctgtgtttgtgaggagtcagagtgagtcccccatgacctttggctgtgcaaggaatggcagccccacccctgcttccatcctccccacagtgtggccatttgcttagtcataaatcaggtggtgctgactctaatcacgtcagcaactgtgtgctgctgggcaggtgcaggtgtgctggggactttggtggggtgttgggcttgtgataggggttttctatggttgtcggggtgtgggtggtgcccgttctcttaacctgggcaaagagaaagagtactggctcagccctgcagatattcagtgactggtctatgtggcaggtgcggggcctggccattgtggggcgcaatggtgacatcgaagcacatggcttgcagcacgaagggcagcgccatcagggagacacagtgcatcctccaggggacttggtgggagccctggaggaggtggtgtttgagacaggccctgcaggctccaagggctctgcccaggagggctgagggagcagcttccatcccagcaggggcaggagcaaaggcaggaagtcacagcctggcatgatccccctgcccaggcacacagaggccagagcttgggacttatcaacaggcacagggagcattcaatggctttgttagcaggggactcgcccccggggctgtgccttgaaggacgttacttggttacttagtatagggggtgaggaccatcccaggggatcagtgacatccatgagaaaggtgatgggggcctaggcaagcctcaggggtgtgggataggaaggtgactgtgctaggactgaactcattccccagtctcactctttctcgtcctgggggtcccttcctgctttgaatccttagctggaaagagaagcagcacggaatggaatgtgcttcatgtgtcctgattaaagaatctttccagtggagcggcttagagagagcctttgggatgggggaggggagcgcccctgccagcaccttgtgggcagtctgggcctcccaggctgaggggggcttttgctgtgaatctgagcctgcagtgctgtgtgttgcctgcaccccttgcttcctctccgaccagcaggtgggcagtgagctggggctccggtgggggctcctgctccgcacggcctcagaccctgtctgcagaccttcttccgtgtgggtccttagcacacttgggggcctgctgtgcagggggctgcgtgtctgaggcagcgaaggggcactgaggcaacgagagaggccgctggttccccccttgactggccagtcaccgtggggggcacgtttgctgcaccccatgttcgtgtgtctcctcttctctcatcccccccacgtctctccaccctccatcccttcctgttgggatgcagactcctccacccttcctgttcccatctttgcgctaggccagacgaggccaggctaccttgtcagccgcaccacctctcacagccttgcctcaggtttcctgtggggttagtgagggaagagcagaaatccccaaatggccaactcctccgtgagcatatgcgctgttcccatccagcagagcaaggttggcagccagacctcagtagggtgaggccccctctggtacttggacacccagatctcactcaggacagcatctgttctaggggtgctcaccaagatcaatactgccagagctggacgcatggccattgcaagtgaaagtcagattttgggatacttttatggaattctaaccccttgggtatcaaacctacatttctgaggatagagatatgtttacagcatgtggcattatgaccttggacaagtgacccctcgagccccgtttcctttgtgaaaatgaaagaaggcttctccctcaggtgtcctgggaatgatatatttcgcctaattttaatgaatctattgtgtttttgtagattattatgtttcctaaaatactttttgggagtttttgcatatgaaaatgtgaactcatattttagacttttagttctgctagttgcttagatagatccatcataggctgtgaattatcatttcttttagacttctgtgtttattttctgcagttggggtagagagactgtgagcagggagcaaggtggagaggaaaggcagatgcagccgggcgtgcaggcctgactcccagcagcactgccggaaggatggcagatggcctctgtgggcttttttgggttgtgtttttgctttggagaagctcaccactcatttccttaggcttagggcagcagaaggaaaagtttttcgtgtccagctttcgtgatttctaagacacagtgtcagacttctccagctccgaagtggttcccctgttgtgtttcggttctgtatcctgcattgtgcatttgactgcctcttgctgagtacccagtatttctgtcacgctggatgttgtgggtgaagggagcctgaggacaaaccatggcctgtgcccttgaggggtgggccctctattgtgcagaagtgtctagattacaggaaggaacaaggtgctgtggtcaagtcgtccccctcatttcacatgggctcttgatctgagtggaatgctatcctggaaacctgtttcattctataaaaatgatcagagttgatgggaaacccatgaaggtgaaacagatgtgtgtctttgcagaagacacagtgaaacagatgtgtgtctttgcagaagacacagtgaaacagatgtgtgtctttgcagacgaaagggagggcctgggggaacttggggtaaatacttttggtcacagagggcatcaccttgcccactgttgtgtcacaagacctaaatagaactacccaggtcagcaggcagcatggttcccctccctgctggcttgggaagcagtttgagcagagtaagaacaggaggccgattgtagatgccacagcatgggggtacatttcccaaggctgactggctgagaccacgtgaagcatgtctgagttgtgcaggctgcagacccttcttccttcactgcacatctctcccctggcatgaaagttttccttttcttccaggggccgttgtctttttgcattggaggttgtgggccttagccccagttgttgaggactttaggaggctttggtgctttccaagcctttgcttagggaaaggcagcttcctcacggcccttcctcatggcattccctctccctctccctcttcctccctaccttttcctcctccctcctctcctttgaccttgatcccctgagctttgtgtcaaggaggtcttcattaccgagttttcccctgagcgaggtttcaacagttctcattctggttggtctgtgatgtcaattccagctaacccttgttccgggaattagtacaaagcctttaaaatccagagaaatcaggtcagggttttgagagtcccctagccagcctgcagccgtcattcttttgtggcacctctgagcttcccagagttcccacccctgacccttggtgtctctagggccctccaagaccctgccccgccgtcaccacactgactttcccgcaggctggtgggaggagagtcttacggcatctgtggggccaccctcagcctttcactccaggcccctcttagaagcatcactctgacctctccagcaaaatgaaaggtaggatgccccctctgagagagccctcctggccgttctcaggcctgctgtaggcacacagcatgttcatgtgctgagaaaaggtagggtttggccaagagagtcattgtagctggtttaggaacctggcctctaaccagattgtctgccctaaggagagagagttcctctgtcttctatcctgtcaggttcctggggcccgtaatggaaccttgtccatgatatgtgctcattgagtacaaggggtggctccaggagacttgaaggtcttaaatctggggacttcgaactcatgattgtttataaaacttagaagcatggagggatgcggtgatcagattggggcaagggagagaccccacttctctttctgtatatgtatgttggggtacaagtgtaatttttttgatttttgagccacttgaaagtaaagttgcaggctgagcaaggcggttcagggctgtaatcccagcactttgggagtctgaggcgggaggattgcttaagcccaggagtttgagaccagcctggacaacatagtgagaccttgtctctacaaataataaaaataattagctgggtgtggtggcgtgcacctgtggtcccagctacttgagaggctgaagtgggagggtcgcttgagcccaggagatgaggcttcactgagccatgatcacgccactgcattccagcctgggagacagagcgagatcctgtctaaaaaaaaaaaaagtaaagttgcagatagcatgatggctcacccctacatactctcctagcaatgacggtgtctcttgtgtatcacaggagaccatttgtcacacctaagaacattaacaatcattctgtttcatcatctcatatgcagttcgtatttaacttcccagttgttcctaaaatacctttccccattattccctctctaaaccagtctccttcgtgtggtgcatttgtttgttgtgtctctttgctgtctccacctttttcctccccacgtcatcatctttttaaaaagattccagacctggtgtctcgtgtctgattttgtcttgattgtgtccctgtcatattgtttgatttgtcccacaatccctctgatttgttgtcaaccagaagatggggctggaggcatggttgatttagggtaaacattgttgccaaaattactgtgtaggtgatgtcaaatcctttgtattttgtcatgtcaagcaggcacataatggcagattatagggttttgtgcccaaataaaaaaatttgttaccatccacttaactaaaaaggaatttaaaatcatacattaatatgggagaccaggctgggcacggtggctcatgcctgtaatcccagcactttgggaggctgaggcgggcggatcacctgaggtcaggagttggagatcagcttggccaacatggtgaaacctcatctctactaaaagtacagaaattagctgggcatggtggtgggtgcctatatcccaggtactcgggaggctgaggcaaggacaatcccttgaacccgagaggcagaggttgcagtgagccgagataaggtagaccggtgagaacgtggaggtgatgaccttggctaagggtctctgccctgtccccactgccagctgcactgagtccttggatgcagaggcggctgggctccctttccatcatttaatagtcacgtgactttggacaagctctctccaagccctgtttcctcaatggtaaactaaccataagactgttagtgagcaggacaccatggctcatgcctgcattcccagcactttgggaggccaaagtgggaggatcacttgagccccgaagttcaagaccagcctgggcaacataaggagaccttgtctctacaaaaacataaaaaaaaattagccaggtgtggtggtgcacacctgtggtcccagcttctcgggaggctgaggtgggagaattgcttaagcccaggaggtcaaggctacagtgagctgtgatttgcgccactacactccagcctgagtgacagagcgataccctgtctcaaaagaaagattgttagcgagcatcaggtgagctgatgcctggtacctgtccacactcagtggctgactctgtttatcttagttttccccactgggagggaaggaggcaggtagtgcagcgggtgcacagcgagcaagggctggacagccttgtgtagcaacgcagacctgatgagtgtagcagggcttggggttggccacactgccagtgtccccagccagggtgggccccactgaccctggaatctatggcagaggccatcagaaagctgtaagggcatttgatccagcccctcctgaggccggagaccctcttgcctcagccaagcttgttctctaaggcgggtctactcgcttttgttcctgcaactctagcttttctgggtggtctcccttcagttactccacccttcctctgttagctggtatttgtgatgtttcaagggcctaggagtctgattgagtcctcttgttacatgaaagtttaatgaatttggttttctacaacctttcttcttcaactgtcaggtccttcttgccccaaacatttccctgggctctgaattgctcatcctcctcctcatggccttctgcttcccctacctcccctcccctaacccccattcttcctttttaggcaggtgactgccctggcaaaagcagctctacacaggagtgaacagtacttatcaccaaataaggatggaagctcttttcctgttttaaatttggggagttttttcaatatttggcatgactctggtgttttaaggaatgtgttgtcatctccctgcctctgctacccccatcctcctaagtccccactccctgaaaacacttgttagattgatagacataggtttttaaaatgtcagctctgtcgaggggcaatagatatgcagcagaattcacccttaagctgtatagttagatgagcttatacccatgtgtacaatcacatcaccatcaccacgaatagatagaacagtgcaggctgctttccaaaagttcagcaggtcgatggatggatggatggatggatacagtaaatgatagaacatgtcatcaattaagaaaaagttttctttgacacattatgtctttcttttttttttgagatggagtctcgctctgttgcccagactggagtgcagtggtgtgatctaggctcacttgcaacctccaccttccgggttcaagagattcctctgcctcagcctcccaagtagctgggatataggtacctgccaccatgcctggctagtttttgtgtttttagtagagatggggtttctccatgttggccaggctggtctcgaactcatgacctcaggttatcctcctgccttggcctcccgaagtactgggattacaggcatgagccaccacgcctggccttgcttttctttaaaagtacttggtacacacactcctagtggtagattcaataaagaacctatggctcctcaaagccaaacctgttacatctcttaaggattatttttcaaaaatttttcctgcagtttagactcttgagtgttcatttgacaatgcagggttttgtaccaactttggttgttgtcttggtagatgaaggaagccaggcacagagtatatatgctctgtgttggtgaattttgtttctgttttattcattttcattaacagtttagttctgggcagatacattttgtatcttcatggtgtttcccataggaaccattggcttttaaagtttctctgatggcaccagaggaggactgcaagccgcccggcatctggaggcttatctggttgaatcatgaaaacccatgcacatttcacccccaactctgagtacttttaatctaatcaccactctcttccaaatgtgcagtcaaaaccaacttgccacaaagacttaacctcttatttttagtttaatagaagtcctttctgagaatataaatagctccttcatttcattaagtattcattggtgctgaggatacatggtgggtcaagatggtgggtgaagccaatccacttcctagtatcgggggatgcccgcctcaaggttgagatgggcaggacagcttgtggggagtgcaccagcacagacagcagcagcccgaggaagggagcagatagaggctggacacaggcggagatctgattcaggctggctcgtcatgtgagcggatgccaaagggaattaaaaagcaaagatgacacacagagccatgccacagcctattgggatgtcctctgtggcttggttccttcaagactgagaatagcttcagggctaaggtcacctctcccagttctcctacggtggtcctttcagagcaggtccttcactcatttccctcttgctgcaggaagaacgcggggcatttgtcatctggtccccactgaccttcatcatatgagctccctgtgctttcgctcaagtggagaatctgcagtcctctgagggttcctgggtccgtcctgtggctcttgttttgcacctcccctctctctgcccggaatacccataatcccccacacacgtggcgaagcacttctcgttctttaagactcgctcaagcgactgcacctgcagagtcccacagcatttcacaccgtcacatcacggtcccttatatgtgaccatgattagtgtcttcttcacgcagcagaaacagaagggctcaggaagtgttttccatcgtcgtatctgcttataattgtgctggtgtcaagcagatatccaagaatcatttatcaggtgacaaaatgataaatcccttaacctggcacaggggttgtcagtctcagccacctctagaaggcattgttgaaaatgcagatttggtgccacccacccctgaatctggctaaccaggacgagatgcagaaatctccacatttaaccagcactcccagagaatcctgaagcagcttcctggtaacttgggaggtgacttgcagaaatcttgacaaaaagtcctaagttgtaggggaacacattacagattcaaaggagatcctggaatatttgctggaggaggtgatattttctctgtgccttaaatgacaaatgaaagatgaactcgtatgaaggagctggtgagagataccaggctgggagtggggttcaggttacctgggcaccaagctggacatggggggcctctggcagggttttgaataaagtaaggactgtgggagtttgcttaggttctcctgctgtcctgaggctggagcccgacatgggatctcgtcatgtcaaagttgctggtctgctcaggattttgttttttaaactaatgtctagtgaccactattaactgtgagaatttctagctgcagaaacccactgcctcttcacatatttaagatatattttccctgtagacaggtcagaaaaacttcttttgtaaaaggccaacagtaaatagcctaggctttgcgtgtctctgttaatgctgctgagctccaccgtgatagcgtgaaagcagccttagaccgtgagtaaataaatggctgtcctttgttccagtacaactttacttacagaacaggtagcaccccaggtttggcccactggctggtttggccgcccctggtgtaaagaaaagcacagtttaatgtatttcctttccagtctttagtacaaaataaaagagcaggcagtcttctcggcctagggagacccacctgggtgcctgaggtttacctggtcacatgagtacgacaggggccgtgccttgggtgcagagagaagagctgagaattgaccgtcttcacactgggcaagcacctaaaaaagccactctcatcaccttcagccgttttcttggaaaattggctttgttaattgtgatctagggaagctctcgtttaacgtgtgcatatgctcttgttgcaactttccctaagaacgtttcagtcaagccagtgacagagcccacacttagtgctggcgtcttaacagcttgtgtcaggcggtgttgcctggctagacgtgaacacataatgctggcatgagcagccctttccagatcatctcgggagactttttctatcgtcatctatttcaggggaactcagggtcccagcagcttgcaaatgagcgagtatctttacagcagcactctcgggacctttagtcctagttaagccaccaaatgctcaccctgaaaggtgcccaggtcggatgccaaggtcaggttcaggctgaggtctgactgaagagtggaagccagatccagtctttccttttgccatttccagtggatcaccaacacagtgtgatgtgtgatggccacattcctaaggataaaatctctaaacgcaattcaccatttgtattccactgccctaggatgcactggttgaagtctgaaaccatggtaaaccagatggcatttggaccattccatacagcatccgtccctaattacacgctgtcctttcagtacagtcctgaaaatttgtgcttatggaatacctagaagtcaaacagtgttttccctttgacgtacattcccacttcaggtgtccttcacttccgctatcctctgggcccctctggcaggtaattataactggatggttgttgaagggcatgcctgtgggagtggtcaacagcaatgcatctggtttgtatggtgtagcctgcgtctgtgccttaaagccagcacccttcctactctggattgatgtcattgcatgattaaacagccaggagagcatctgtaacaaggaagtcttgacctcactggctcagaatggtgtgtgctgggctctggacttgcaacgagactgcttgtcctttagctagagccagtttgatttctcagtccagttcctgtttcactgtgggtaggacttgctgccagacagctcaaagggaaggatgctgggtccctgtctcgctggccaggccactgactaggctctctggggcatttcaggatttggatgtgtgagagttcccagccctgcaaacaggaggagtcagtttaatattttaccctcaaaattatattaaaaatagtgattaagttctcatgctaacccataaagtcactttaatgtgacttagctgaaatgctgtacatttccattaaaaaatggtagtctttttgaatagctaaagtgttcatgaagtcaatatgaagtatctaaaatataatcaaatcatgtcatttgaggatctctgcatttagtttgaggatgtgggcagcaaatttaatggagattctgcaagttttctgggccctttaaaatatattagaatgcctttaagtatttttatgattaagcagaatatttattttatctgctgtcacgttgtaacttacagctctgtagatctagatcactattatgatttatctgtaatcggtgattagggcagtttttgatttacaaaatgaaacaacggagggaaatttgttcctgtgataaccaataagaattttaaagggaggaggagggaggtaaaaaagcagaaatacactgatgtttaaaaaggagtttataagctcagcaggaaagagggaacctcaaatgcccgcagtctcccgcctgcaagaggaaaggtggtgatggcaggggccggtgttggggtgttggcactgaccacggggcccaccctggagctgcctgggtgggaggagagtggcaatggggaggatgaagaagccactggctgtggctgcatggcacaggaaacctttgcaaactggggctttttcttctaggtgtgcctgcatttactcatgtgctgtatgtctatggaaaagactgttaagctgtcaaatagtgaactacctcggtagttcccgatgccgtgatcatggttttggtctcgtttcttttaggttacccctgtttcaggccagtgcttttgcatttttggcccctgctcgagccatcctgtctttagataaatggaaatgtaacaccacaggtaattgcagttatttccacatatgtcattggggtcctttaatgcaggtgtaaagggaggcctggacgtgctgccctcagcagcgctaaatcctttcaagaattagggacaaagcacacaaacccacaaacagcttagaatgctccatctgtggatcgtgtctgtctctctctttctgtccacttgttcatccctaaccctagagcaagaaaggatcagaattgacctcatttctctatgttaatgaaattgacaaatatgggaacggaatagaaaaatatttgtgctatttttctgcctctctctttcagtggattttatgacccaccagtaatcactctctttgctgcgtcagcatcccttctctgaaacatctttgctttttaaggatctggctactgtggtttgctgcaaatgactttcattccccttctttagtgattgcaaagatccttaaggaacccgataaggtcaggaaaagatagggaatttaagaaaattagagtcagacctgtactctcaaaaatacaattacattttgaccttctaggagcaaagttttccagccttcatttccttccttgctcctaggagttactttgtgaccactgatttgatctgggaactggaaaaggccctctgttttatctaagtttttcaaacctcagtccagcaaccttgctgtcgggcatttcaatgagctgtgtgcaaaggttggtttttttgtgtgaggctggtgctagtaacgtgtatcaccacttcagttagcttttgacaatttggggagctcttagtcgatgaattcatttggttaaattagcatttgaggatccacctttcagtgagataagctatactgttggaggttgaattttagggatggggattgaaacagatgtaataaaaacagggagaaaattcttcttaaaaggtaaaatgaatatgtcatgtgagacatcagtgtcactccaagaaaaactttgtttttgttttcaagatgtttcagttgccaatggaacagcagagctgttgcacacagaacacatctggtatccccggatccgagaggtaaaagacaagcgttgtctgcttttggcttcttcatgtttcttctcagcttcaatgttggttgacccaagaaatagcagttacttttactgagcccttcttttctttttcaattactgatagtttatttctcttgtttaagtaaatgtagttaagcaatactctaaaataaagcatatggaaatgctctgggcaaccttaaggaatggtttcctccctcctgcacacccacagacctgtccactcacacccgccagcacagctagctgaggttcgtggctcactggatggagctacagaggctcatcatcgacagatagcagaattgttcgctctggcctcagtgtttgcctgtgttcattgaaagaactaaagatatttgtctgccaaagtgcaattgaacagaagcagacatgaagtacggctgacagtgtattaatattttccaaaacgtgtgagataattcaccatcagttcagaatgagcacagatgtggccattctgcacactaaaaacatccctttagaatttctgtcaacaacattgtcttgtcgatgtcctggggggctcactctttaaagctgagagtctttatgctgcagtgttcctctaaggctggtctttaaatgttgtgtttcttaaaagggaattataaatttttgcctgcatcgtttaacagtgaaaaaggcatgtgggccgtgtgtccaggacctatttctgtaatacacctgcatcatgaatgcaggccccagttagtgccccctgaagtttcttgtcgggtcctggggaattttctagctatctctcccaagttagatgatgtaataagttattgccttgcagaattatcagttgtggttgtaggtgacattctgagtgtgcagtgtacaagcagctcactctcatgtctgtgccatctcttgttgcagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgtaagtggaaacatctcccctcatcccaccactgcggggcagcctttaggaacattcacacagacttcaggagataatgtttttcaataataagaatggtctgacagtttcaactttatttgcttcgtgctggggaatagttgaagggtttttgacccagagtttgggaagtgacatatagttgacgtattacaaagacagacttagcagcaatatgaagagggtggattgtaagtttttaagctttggtagtggggtaaggtagtggcgccatttgtttttgacttttgaggtcttgccaagtctcatgttcatgagttgacatactgagaagccaaatttttatatcatgagactcaaaaatattccagagtggcaggaatctggagtatttccagagaagtcgtgggaaaggtctgttgccattgatgatgtgactcttctccccaggccacactgagctctgcactcctgacgggtgggtggttgggggagggacatggtttctgccagggtcctgctagtcagtgcctgtccttttgtacagaatgtcacatccattaaagatgtcccttgccctttaagtaaagttaacattttgtgttaatgaagtcacaggggagtttgataatattactgatgattagagtcacagaactctttgtaacacagagcccacattctctatgtgtctgcagagcatgtttaagagttgattatgtgtaggtatatggttccattactctggaatttaaccagccagtacaactcctaaaacaaaataagtcatcacataagagaatttttcatttgctctgttttgtgaaatagtctgcagttatttaataacaggtggtatttattgatcttttactatgcatcagtcctttatataacacttgtatatagtatcagataaggcacatcctagtgttatcccatttaacagcagaggacactgagcaccacgacgtaatgtgatttgcccagagtcatacagtgaattaagtggccaccgtgggtttcaaaacccaggtggtggacatgggcccgaacccatcatactcaatcctgttctgtgtattagaacatgacgtacaaataaaagggaaccatagcagaattgttatctacactttacaaattaaattaaggtgtgtgaaaatatcaagtttttttttttctttaaacaaggtttgaaggagacacatctcacacatgagcatgaatacccatcatcatgctttcccaaaattgttctttttttgcaatggagtctcgctctgttgcccaggctggagtgcagtggtgcgatcttggctcactgcaacctccacctcccgagtttaagcaattctcctgcctcagcctcccgagtagctgggattacaagcacccaccaccacacccggctagtttttgtatttttagtagagacggtttcaccatgttggccaggctggtctcaaactcctgacttcaggtgatctgcccaccttggcctcccgaaatgctgggattacaggcatgagccaccgtgcccagcccaaaattgttcttactattctcatttcaccaaaggttggtcaaaacattcttcacaccagcagagatgggaagatggcatgtgagaatagtctttcagcgaaatgtaattaatgccaaaatggataaattgtaggtatagtacagtaaaatttgaaaccagtaacaaaaggatgaacaaaacccacaaagcacttacaagcttaaaaaaaaaagtgttaaaaatcactctcagagaggaaattgaaactttgcaattaatttctgatagtttaggaaatgatggcaagaacagcaccagtcacacttagtagccagaggtgttctcaagaaaattcacaacctttaaagcagatacagcacatgaagaatttcagtaactaagaaaacaggacaaaaaaatgaacctagtaaaagcagggggaacgaattaataaagatacagaaaatgtgacacaaatagaagtggtaaatctaaaagctgatctcttgagggggaaacaaaacccaatgtagacaaacttctggcaaagctaagcaggataagaggaagcctgtgcacatagatctgccacagatcccgtcagagggagcaaaactgttacctccccccaaattaaaacaaaaagtaagaaaatagtggttttcagaaaacttaagtaaccaaaattgactcctcctcactcttatctctaagtatgggggtgcctccacacttgatcctggcccccttctctccatgcacttcccccaaggaaatcgcatttctttgatggtggatagttccatggaaacctgtagttcagacctgtaaactcgatacttacagatccagcccctattttgcccctccacttactgttacacaagacatctccatctgtaaatgaaaaagccccagacttttgattcctttcctgcccctgaaaccagtttcttctgctttcctcctttcggtgaatggcacaaccgtgcccctagttgcttcagccagaaatgtctatctgttcttcagtcttcctttcgcctcatcccccacacagcccatcctgcccttcctcctccggaacaaattctgaacccgttctcttttgcaggccttcactgccgccaccctctgcgagccttgctcgcccttggccattgattcctcactgtccccagcttctccctcatgtctcccaggggtcctcctctctcccctccttttgaaacatcagttagacacaagctagaattctggaagctttggggttttcttactgttccaatgtctggagcctcacgtgctgccctcggtgggtctgcttgcgtctcttggcctggatacctggagcccctttgctctgagcacccaggcatgcagaggtgggacatgatcttgaattatctagatgccttcctccactccacccttacttgtctctttctggaacctcttcctgaagcctcctggactcttcctgtttcctctcctgttttctatctctttgtcttttttctctattcgtgagaattctcctttgctttatctcttattccttctgccaagattgtcatttatgctctggtgttttttcagtttccaagagctcttctgtatccttgggctgtcagctctgtgagagcagggcctacgctctgggtgggtcacctctgcacccccagcacctgcccctcccgtggctgagctggtgctcagtgagcaggttgtgaactaataaaggaaggctcaggaagcccggtaaacccatgaccacaagagcagccgagatagttgctgaaggactctgattcctaaaagaagccctgggcccagatggttagacaatgagtgcattcagtcttcaaggaacagagactatatgcactaacttgcaaactgttccagagctctgtgaaaggagggaaactccccagccaatcttagcggcaaattctgactgaactaatacaaaaggagaaccatggaccattgttttctttcctggggttgtgttaaaaaacaaacaaatcctgagctgatggatgtattgcggcacattctaagcaacgagccctgagttcaaatgtcttcaggtagcgtgctaaagttcagcatcattctctactgtaagactccttccaatctttcaaaatgcaaatgcgcaaaagactctattcaccttcagaaaagggccttagtatccagccctgtccacccttaatttgttttttaaatgtcacacatctataagcatatcttgacagactattccttagaatgttgtttgggaagatgctgctacagataacacaatgaaagaacaaggcataatgcgtcatttcaagaattcacagatgatcaaatattagaaaatgtgttgaaatcgatcatggctccatggtaggtttttttttatttgttaaattttgagacaggatcccgctccatcacccaggctggagtgcagtggcacaatctcagctcactgtggcctctgactcctgagttcaggcgattctcattcgtcagcctcccaagagtacctgggactacagggtagattttattaataaggtcttattgataaaactatggtaatagtcccttcccctgaattttatttttaaaattcaacctacatccttgttgcaaacttagcaatgtgagaataggaggattttttttttttttttttttttttttgagacagagttttactctggttgcccaggctggagtgcagtggggcaatctcgcttactgcaaccaccacctcccggctgccagcaatgctcctgcctcagcctcccaagtcgctgggattacaggcatccgccaccactcccgactaatttttttgtatttttagtagagacagggtttcaccatgttggccagactggtctcaaactcctgacctcaggtgatccacccacctcagcctcccaaagtgctgggattacaggcgtgagccaccgtgcctggctgtatagaaggatctttatgcgtaagataaacatgcctcctacttgaatgatgaaagactcaaatcagtcctgccttttgaagtcaggaacttaaataagcttgtttattatcacgggtatcatttaaagttattctagatgtgctagtcaatttataaaacaagaaagtaaaataatgtggacccataccaaaaagatcagagaggagaggggatggtgacttgcctgtagaggaattaaatacattccacaacttcataaataatactgtggtcctgggacaggggtagacattggcagagcagagtaagaagaacagaaacagaatcaaagaaaaataaatatttagtatagatggcagtcatatttgaaaccagtggggaatggacaaattatgtaggaaaaactaattatttttgggaaaaagttagactcctaatttatatcaaattgtatttcagttgaattaaagacttaaatatacaaaataaccataaaagtgctagaagaaaacctaaataagtttttaatcctaagggaggggagatctttcttaaagcagatattgaaaagagaaagagaaagatagattttactattgacacatttaaaacgtcagaaaccactgaattaaaaacaaatctgtcgtggcagctcacacctgtaatctcagcactttaggaggccaaggtgggcagatcacttgagctcaggagttctcaaccagcctggccaacatggtgaaactccatccctattaaaaatacaaaattagctgggtgtagtggcgggcacctgtaatctcagctactcaggaagctgaggcacatgaatcacttgaacccacgaggtggaggttgcaatgagctgagattgcaccactgcactccagtctgggcgacagaatgagactctgtctcaaaaaaaaagctgggaaaatactcataaaaatgtcacaagaaaggctaacatccctaactcgtaaagagttctactggttaatttaaaagtgagagaatcccagtggagtaatagatgaagggtgtgataggagtagccatttggcaaaaaagggactacacctagctcattaaagtgtgaaaaaggtttatcctcccaatttattaaaatgtgtattatctacatgattctgttggaattgagagtgaatgaggttgtacaaactaagtcactctgatggagatggagtttagagacggagtctcagggaaggttagtgcggccggtcagtgactgctctttctggcacagtgcatacgtccttggtaggacctacattttaaaacttatttttttattgacttttcttatggaaaatttcaaacctattcagaagtgaagagaatagtttaatgaacccccatgtgtcaataccaggcactccaaaacagtatacttttatctatatcccactgtttttcagctccctccaattcagttaaattctaggtatttgaaatttaacagtaattaagctcagaaatctaaagcaaaataatagtcccctcctactccatctctcaaaaaaatctcatgattgttaactagtaaaaaattttgtttttatccttacatatttttatatttttatgcaaataagtacaaactagtatatatacataattttattcatttttaccccaataatttgttgggtttacttctctgagacagcatgtttagatgatctctttctttctaaagctgcacagtgtttagtaatgtagtctataatgtattcagccatttctcagctgatgctcatgcatgtagcttaaatttttgctgctaccaaaaaaaatgctgaaatatatacctcaacgtgaaaagactgagtattagaagcaatgatgatacagtttttcaattaaagctgtttatgttgcttctgatgtcatacagtatgggaatttttatttatttatttatttatttatattttattatactttaagttctagggtacatgtgcacaacatgcaggtttgttacatatgtatacatgtgccatgttggtgtgctgcacccattaactcgtcatttacattaggtatatctcctaatgctatccctcccccgtcccctggtatgtccataaaacagaatgctaagcagtcactaaggtgctgctgcaaatctctgtctgatgaggcggaaaagcaaatagatactgaggcaggtcaggaagctgcgtaaagcatgattccagtttggcttagataataacctgttcatgtctggggacaaggaagatgacaatctgtcttcctccagcacccagcaaatatccagggagtgaaaactgttcagaacagatagaccacgatattacatggttttatcactcaagggggattatggatgatcttcagggttttatctttttctttctgcttatctgtcttttaaattttttgtacaatttagtatgtattacttgcgtaacattttaaagtaaaagttagcaaaggtaaacatgaggtgggaagcacccagtggagtagacagcagcccatcctgagagctggggctagaacgcttcatccctttgctcagttaagatgtgtggacatgggcgggtctgcacctctaagctgctgcctctctgtcacagggtgcctgcccccaggtgtatttgagaataaaaataaactcgaagtagagaggttttagagcagaaagaaacagtcatgttcatctgctacctaatctgctttctaaatttgagttgccagatttgggcctaagatctgggtgtccctcctcaaattctgtgtggtctcagtcccctcttaaatgtgcaggtgtgttgcctgaaataatgatgacaaaactagcaggcctggggcatctttggatctcctaatattcactctgaaacaaataagtagcatttattttttccagacatgaaaattgcatgtaggtctaagtttaaaatattccagttttagtatcccttgttaccatattgttttttgttaaacttcactatcccagaggaattgaaataacgtgggcactgtgtgtgttttcgaccttgaactggtactggcagagacccctgatggatcaccagttcaccgaagcgcctgagtaggcagggagacccgtggagcaacacacgcatgttctccagccgggctgccatccacacctcattaggaatgtgacagtggagtcacacttgaccggctgtcgatggggctaatgattccatctcaacaattggaactgtgcccaggaacaattaagcttagctttgactgagaacctactcttcctgccagctctacctcaggttgtaagtgaaagagcgagaccgcgtggaggcttagacgcattgttgggcacgagttttgtttcggtgatgagtaaaaatccacctgggggatgggaagtggccccacacctgccagccccgtgggacaccagaccgatgtcatggactggtgtgtcaggaagtgccatggtcctgccgtggaggggtcagcacctgcctcccatagcacttagtgcagttcagtcaggaccgtgaggctcaaggagagggacttccgcagcccagcctccttgccctgtgaccagggtggcaaaaggaaagagttcagttcaagccatagagctagattcctggtccccagtgctacaaccctagccgtgtgatcttggacctctggctttgtctctgtgaaaaggagaccatcttagaagccaccccgtaaggttgagatgctgcacaggaagacattagtgtaatgtctggcacacagaagcctcccaggaatgttattaatactgaattctactgtatctacttttcttgagcagtgaagcttactttttgctcttttaaaagtaatttatgcatgctgtaagtagattggaaaatacagaaaagtgggaaaaccagttgcaaatcatgtaactactcaaagcgaatccctgggagaattttggatcatgtccttcttacctgtttgtgtgtacatgcagtagtttcttggtttgctttgtagttaattcatagttataatcttacagtttatgttgtatctggcatcctttccccttacatagagtaagcgtttcccatcaatgtgtacattctttgggttttcttattctatttaggaaaagctgtcctaaggcatttacatcagaatttcatttcagtatcaagaaatgctaggcaaattagttgtaacatcttcccccacagtagtatttccaaaagatgtacattccaatagatatactatttctcaaatggtagttcagaggactagcagctttctaggtaaatgaattgaacactatgtcaattttgccatagaagcttcgagtgttattttataacagagacataacagcttttgacctagtttgttttctttctctcctcaggacaatattcctagtattactgttttctcaatacgccagaaatgttaaatttcctctcccgatttataaatccaagaaaggatggactgcgtacaagttacagctgttcaaaatgttccctgtgagtagctgacttcttcccctgctgacatttttgcccttggttaatatgtaagatgattaagtgaagggagggttttaagcaggccctccttgggggatcatatctgtgcagtgagaccaggctactaatgaccactcagatcatcatagacttaaacattctgattctgaaatgggagcacatccttttagcagtgccgaaggaaggggacactgtccttgggactgagtaagatttgactccacgtggcctctgcaggcacgatgtccattcttgttttaccagccagactttggaatgggtaagataagttcacctgaatgaaactgctctctcagtgagagtccattcaaggaagaagacgtctgcaaagtactgactgtggtgggctctggggtgtgatattccgaccgcgggaagacgtgttttttgccaacacctgtgagccctgctggcctgacagagcttccccttgaccactccagatcatcctggccatcctggtatcctggctgctctgcttcatcttcacggtgacagacgtcttccctcccgacagcacaaagtatggcttctatgctcgcacagatgccaggcaaggcgtgcttctggtagccccgtggtttaaggttccatacccatgtaagtattctgatggctagaggggtcaagagcccacgagggcccaactgagaggggtgggaatttggcagaacagccgtctttgtcccagactgtctcctgaaggccttgccattctggtcaggagaggattagacagcaagtaagggaggccctgtccccagagggcagaaaccaacacacagagactgaccggctcccttctcacattagcgagctgtctcttttggatctgctaggatgaaatcctggacaaggggtctcttgccaggtttaagctctggtggccaggatttgagggcagctgcttagataggcaagtatagagctgcttggtcccagagctgccaaagtggaaagatgtgagtgggaacagcctggggattagcaagcaacctgctcaagcatgatggaatttatataatctcttaatgggcagccataatcttttaaatttggccacagctgtagaggtaagttgatagtcactaatggccaaaagctgcatcttaatttgagtgttgtgtaactgttgggggtgtgaatacattccctagctggggtgtcacctggactcgcagctggccccgtgtaggtgatcccagtggttgttacacacttggttccattgtgaagactctagtcccggtgtctgggtttttattagaattggagcctgagcttagtcaggttcagcccacttctttccctgtgtaaccatcttattttcattttttataatgacaaggagaaaaagagagaagccaagaattttaaggttgggttaaagatgactgctctgagcatgttgaatgatgagtgttggctgttctttttgttctcaatacacttaggaaagctttaaaaagtttcgtctttcaggccgggcgcggcgggacatgcctgtaaccccagcactttggggaggccgaggcaggaggatcacccgaggtcaggagttcaagaccagcctggccaacatggtgaaaccccatctctacaaaaatacaaaaatgagccaggcctgatgacgggtgcctgtaattccagctactcgggaggctgaggcaggagaatcgcttggatctgggaggcggaggttgcagtgagtcgagattgcgccactgcacttcagcctgggagacagagcaagactgtctcaaaaaaaaaagtttcatctttctaaaataactttctcatcagattgtatggtctaagtgtgcatttatacagacctattctttttccaagaaagaatgtgcatggttcataaacatacctgtagtctgagataaaatgaaattacaattagttggtgaggcagtcagggtgagggcgaggcgggggtggcaggtaggtagaagcccccacagcgtatacaaggtggtcttctgcttgtgcaggcaactcccaaggtgggcgccagtaggggcacaagctgggctgtccaggagaggcagctgtacaggtgctggggccagagggagttcactaggacccatggggccacacacgagaaggcgaaacttagtagacagagcgcctgaggttgtgctggccgtgagcgagcacgtagggctcctggcctgccgagggctggtggggtaccagagctccatagctagaaagccacctccagggatatagtcgtactactgtatacatatgtagtactctccagtgctttgtctcaagccagagaggggcttttgaatacctgagcagtgcttttcagtctttagtacactaggcatggtctggactgattgttaatataatacagatttctggtgcaaaatgtcaacagtgctgaggttgaaaaaccctgctgtcaagtaacaaactaaatgaaagtttcttggtaaaaggagatatgaaataacagattcaagagagaaggctggaagccaacaaggtctttaagaaaaaaaaatatagatatagatatatagatatatatctgaaggaaaaaggatcaaaataagaatcccccttcaaaatcaagacactaaacttgaatgctacaaccagaattcttgaaaccagaatgctacaacaataacaagataacagtataaaagataattgagaaaaagcaaaatgttccttggtgaggaaggcctctgaatgaggaaaatccattccaaattaacctggagctgatacgttgagcaggcctcttgctggtggcatagggtgtgtcgagccccatccatcaacctgcgtaccttgcacccctgaccaagggccgcctctgcatcccctggctgctcccacagaatgaacaagcctgaggcaggagcaattctgcccttaaccgcactccaggcttattctgcacgtctgactttgtatcctttctcttcccaatccagtggttgctctaggctacctacaacacaggccaaacccctctaggtggcttagatggcttttggaacacttccagaacttgcctcctgccctgtgccctgcatgagagctctgcgttcaccagaacaccctcaaaccccaccctccagaccctcccgatccctggaggggcacctccgttcccacctcctcctcagatccttccctggccagggcccgacttcgccttttcctgaccgcctcactggtgcttcttgtgacccagctcagcttgcctccatttgaagttgagcaatttccctctccccggatcttttggagtgtcctgtgtccccagctacgttgttggctcctgcatgagagaccgtgttttagccatcgttcttttcccactgtgctttctgctcagtgagtgtattataactaatgcttcaacggaagaagggctactcctttatcaaaggagtctattcattctcacacgaaagagacccatgctatttttgttaagtaagacctatggctttcaagtccaaataaatatacttgtgaagaaaaaagtatctaatgagggattaagtaaatgcggaacttaaaatgaagtttcagtggggcctcactttgctttctgaaatgaaactatttaatttcccataacatggtttatgatataaaaataaggttctggtattatagtagagaaggactgtccataccttatggatgctttactgttgggatttaagtttagctggtgatttctcactgccttttcacttgatgtcctcccctggggaaggccactgctgctttgtaccctgctctgtacagcagggctataaatccctcatacaaatttcccaacgtggcagggcactttcagttgttatttagtggatactgagtgtggcttggaagcaggaaagagaagttacagcctcttccagcccaacaatgtcttcttctttttcttcttttttttttttgagatggagtctcgctctatcacccaggctggagtgcagtggcgcagtcttggctcactgcaacctccgcctcctaggttcaagtgattctcctgcctcagcctcccgagtagttggaattacaggcacatgcccccacgcctggctaatttttgtatttttagtagagatggggtttcaccttgttggccaggctggtctcgaactcctgacctcgtgatctgcctgcctcggcctcccaaagtgctgggattacaggcgtgagccaccgcatccggctacgatgttttcttttaattaaagacacagtgcacatcagtcctcattatggccgccttcatctgacttagcaactgtcccaggcatctggtgcttaagattttaaaatgaacagtttccatgagcttcagaatccaagtggatcttgtagagtcttgcagcgttcagaatgactttgggtaactggtcctggtcactttcgcctgcctctctaggagcattcatggttgttttcctcccacagttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggtacgttcctgagaagacaagttcctgattggtcccagcaccttgttactttgttcttaggtttacattaccttgaagacaaaaccaagagtttcagcaggagcccagccaagcagcaggactctagcgactgtttgatgcatcaccacctttgtttactttcgactgtctgatacaccactgcctttgtttactttcattttcctcgtccatgacgtggaacggaattcctacccttccttaattgcagtgacatcaaataacacactctctgcgaaaccactgtaagccttaaattcaaaaaccacatgccaagcactgcacttgttctttgctttttttggggtgtgtgtgtgtgtgtgtcatttggagattagatagataaaatcaaagtagctctgtctatatatatatagagagagagagagagagatagagagcactactttgattttctgttatcttgcctttccaactgttctttttttttttttttttacacaaactgaaatttttcttcccagcaaaacaagctcttcactgcttacaggttttttttgttttttttttgtttgtttgtttttaatttaaaaagacccagggtctcaccgtgttgcccaggctacagtgcagtggctattcagaggcacaatcgtaatgcaccacactcttgaactcctgggctcaagcaatcctcccacctcagcaccttgagtagctgagactgcaggtgtgcaccaccatacttggctatacagtgctatttctacattgcaaaaattacctgtttttttccctgtttccccacccaatcttggctgccacaatcggacagacagaaagcacaaggataccgtttgctctcccctgtagtggaaaccttagcagcaggcagtatgccccaggtctgtcaattagatacgttccaattgtccccaagggtaagcactgtgtaatctatgcacagttacagtttatataaatagggacaggaatagcagaaatgaatgaaatctgtgggatctagggcttatgaactatggggtttatgattagcttttagaagttgtcagatgattgcccctgaggagtctgcagagaaaagaaaacagcccagatcccctcctgttctccagccagctctgtaaccccagaagggactgtgtgtgatgagattaatggactgggccttggctctggtacctgatgtccccatctttctctaatggagctgctgcacatgattaaatacctgtatatcagtatgtttaaaagtgtcagtacttatgaaattataaaacatttccttcctgatgaaactggattttaagagtaaaggatcacatcaatgttttatttccatagacggcccatgtttgtcttataccccaacaaatggctttattttctggctaaaatcctttgctttcatttgcggtgatttaaaaacactcaaatctaacgtgtgatttagagatgtgcttctcaaaatggaatgagctttgggggttctgttaaaatgcagattctggccgggcacagtggctcacgcctgtaatcccaacattttgggaggctgaggcaggcggatcaccctgaggtcaggaattccacaccagcctggccacatggtgaaaccccgtctctactaaaaatacaaaaattagccaggcatggtggtgcaaacctgtaatcccagctactcgggaggcaggagaatctcttgaacccaggaggtggaggttgcagtgagccaagatcgcgtcactgcattccagcctaggtgacggagtgagacactctctaaaaaaaaaaaaaaaaaaaaaaaaaatgcagattcttttctgcttcagcaggtctggggtggggtctgagattgtatttttaatcgccctcccagctcccaggagatgtggaagctgcaggctctggaccacatttttggattgtagatgtgtagaggctatttcagagtgaatgcattatcccattgaatgattttctttcctccattcctttacatcttaggggaattttcgtggaaggcctctcctgtgttcttgatggcatatttggtactgggaatggctctacttcatccagtcccaacattggagttttgggaattacaaaggtacacagatttttctaattaaatgattgggtttctaagcattggtccatttcattgatcgatctggccactgcaagttccaaatgggcgggcctctggttctaaaaaattacttctctcctttttttttttttttttttttttaagtgtttataatgcctgtttggaagtctctcttctcttgctggtccgggtagggaggcactcagtgctgtcattccatcatgcagtatagatatttataaagcactgactctgccaggccactgttcaaggcacttgggatacatcagtgaattaaaaagtggagtttacattctagcaatcaacaatcagcatactaagtccataaatgatgcattatgtcagccagtgacaagtactgggggaaacatgggacaggaagcttggggagagggtgatcaggtgacctgaacacagacctgaagggtggagggagggagcctgcaaataacctgggggagagcgttccaggccagggtgtggccagggccgagccctatcctggaagtggaaggtcagcaaggaggccagtgcgggtcagggagtcagagcaggtggggtctgccgggtaactggggagcaggttacacaggcaggcaggtaggtaggcagccacagactgcctgagtggaagggagtgctgcagggagcagcttggtcagatttttttttttttttttttttttttagggatcgctttgactgcagtgatgagaatagaccatggggggctgggcaaaaggtagaaatgggatcccaactgggaggtgtcactagttttaaattaagagatgacccaccattggccatggtatgttgtgaaactaagaccatgaaaattggttcaccatcctcgatggcctacgtctcacaggtctccctcactgaggacttggggtgagcccggaaaccttctagaactggttgacctctgtcaaattgggagggaggagtggatttcaaaagagctctcctttgccatgtaagattctataatcagataaagagaaaccagatactaagtttgattaaccttgattgcaaatccaggtgagagggagctgccaggcaggcacacacatgcctggtttgtttgttggtttccccaggttggcagggccctgccagagctcagcctgaggtgtgccaatggccccatctgcctgttgctccctgtatgcgggatgtgagggaaggttgtctgaggggcgcttcctctagcgccatcctggaggtccttttgctacccatggtgagaagccagtgctgagcacagggagatgagggaaggatctcatgggcacagaatggggcctaagccatgccactcttcagccagtttgctgccatgagcttgcaggcatataactaatcccaaatcccaaataagatagccggccctctgtatctgtgggttctaccaacttcaattcaaaaatattgtttctgaactaatattgtttgtttctgtactgttctgggtgagcatgtacaaactttttgttgtcattattctctgaacaatgcagtctgacaacgatttacagagcaattacattgtattaaggattgtaagtaatgtcgagatgatttaaagtatatgggaggatattggctgggtacggtggctcacacctgtaatcccagcagtttgggaggccgaggtgggcagatcacctgaggtcaggagttcgagaccagcctggccaacatgttgaacccctgtctccactaaaaacacaaaaattagccaggcttggtggctggtgcccgtagtcccagccacttgggaagctgaggcaggagagtcacttgaacccaggacgcagaggttgcagtgagctgagatcatgccactgcactccagcctgggtgacagagcgagactctgactccaaaataaaaaataaaaaaaaatatataaataaaataaagtatattggaggatgtgtgtaggctacatgcaaatactacaccattttatatcagggagttaagcgtctgtggttgttggtatctgaggcggggagagtggcggtcctggaactaattcaaggttccctagggacgactgtaggagtaaaattgttgtagatgaagggaatcttaggggaagatggtgtaacaagcctcctccttctgcacccctttaaaacacatcatcatataatgtggccaccaaggtagtttgggaaatcattccttttattaaaatttgaatggtgctagcttactctgacaagttaccttgccagcactttttaatgagctgatgtatcccaagtgcctagaacagtagcctggcagagcgggtgcttcataaatatctatattgcatgaaggaatgatggcacctgagtgcctccctacctggaccagcaaggtccatcattatcgttattatcattattgctatttaccccttagtttatttctaggaacagagcaagtactatctcgctggccgtcagatctctttgttggtgtccagaggaaggtcatttctccttgctgcattctgcaccaccgttgaagactttgtaaatccagaaacccagggtctattttaccaaggtcctagaggcagagccacagttcaggagggaggtgccaaggagattccagggaatggaccctgtgagaggggaagcaaaggtcctggggaagcaccgggaaggctgggattttagggctctatctctggtagttagaataaaacataataggtacttggtcaatattcattgaacacaagaatggcttagttgctgcatatattgttgacagcatcaaaggcagatcagtcttctggatgtcactttgctaccagatttagtttcaggtatccctggggccagtttggcccttcatacctaacaggcctgcccgaccctgccaggagtctttgcataggctgtttcctctgcctggatgctcttccactagcgaactcttactcacccctcaggaccatctccaacaaccctccccaactcttcagattttctcttccctgctgctgggctcccccaacagcagaacagcatagcagtgagattatttgatcaagcttgtgacttattcatctttgcattcacctgtcccagtctaacaagtcacaagcttgatcaaataattacatagttcctcgaaaatgtttgctgaagatagggccattagtaaatgaaagccttccttattccatagtaacagccaagcatgagtcgcttttgcttgatttgtcagtttgagtgatcttttccattgcttccctgccgtctgtggtgtggggcaggctagggacagtgagacagtgactgagtccagctgggcagccatctctcatgtgcacagcctcagatcaggctctgatgcgtaactggctgaccctggtcctttgagggttctgtgcagtggtcaacatgtcacacacagctgcaccagccacgtgtgcctggtgggcacttgagatgtggccggtgtacgtgaggaattgcgtttaaaattttgtctcattttacttaattaaaattgaagcaaccctcttctcctcactggggtcatacataaatccttgtggatactcccccaaacactctggaacctcctttacccagtttacatccttagggtgttttcctgcaagaggcagcacagagtaggggcccatagtgcaggattcctgagcctgatgccagcaccacctctcacgtgtggtgccgggaacccaggggataggcaggggcaaagtgtggcctttgcgttgagacacagagggccatcccaacccatgactggtgacagcaggctagacagaagctgctgggaggcagagatcaggagtagcagatatgccctacatggtgctatgagagcctataatgggggaatagtcctggagttgggatgcttttcagaggagcatttgggtgatgtttaaaaggatgcatctaggatctggctaggagggaaccacagggaagggtgtccaggtagacaggcccaggcctgcctggtgtgcttggaaagagcctgagaagtgggctttatttcatgagtaccagaggatgcaagcaggggaccagcctccccaatttcatgtgttagaaaggtgaccccgtggccccatggaatgggtgcaggaaaggccagtggcagcaggcccatgtgggcggctctcagatggctcagtgcgtgccagctaccattcaggcagttttatgcaggtcccgtttaatcctcaaaacaaaaccacgaggcttgtgtgtgactgagatgaagatcctgagactctagaggctacgggtcggcccgaccatacagtcagacgtgggccaggagaagagcccgcagtcaggctccagatgtcctcatccgtagccccttctcttttccacctctcacgggaagcgtgccgtgaggagaggaggttccagacatgtctgggggtttggtctgatttccggtgtggggaagttggcattgaggctgaagcactttgggggaaattgccttggtgacatgtggtgccgggaacccaggggataggcaggggcaaagtgtggcctttgcatttgagacacagacggccatcccaacccatgactgtgccagggcagtagagccctgaggcctgagtgcagggagtgtcaccaaggcttggagatgcagagggcggccctcagggtccccacagtggaggtgagaagagtgggctgaggaggaggtgaaggtagcgagccaggccatgggtatctctgctgtgtgttctttagtaacttacggtgattttgcatggagatgagtccctgtttcccagtctcctgtgtgttctgcaggtcggcagccgccgcgtgatacagtgcggagcagccctcatgctcgctctgggcatgatcgggaagttcagcgccctctttgcgtcccttccggatcctgtgctgggagccctgttctgcacgctctttggtaagactcccctctctggctttttcctttacttttccaaatttttaatagggatcatggtgtttttgctgactcccttcagtaagaaggtaacgataaatttctattttaaaatacaaaggatatgccttcaaaaaatgaaaacttttatcactctctgagttgaatttatattaaatatggaaccaacaataagatgtaattgtgctatgaacatttcaattaaatttaatctctttagtatttctgaccaatttaactcaaataccatccctctgaatgggctacttaaaactgaccattttgacagtgggactctgggtttgatctctgcaccatttagctgtaataaccagagacatgcaccagatatttaggtaggtctccctgtttaatcaaaatgtttgtgtagagagagaaccaatgtccttagttttctatttgacaaacaaaatgccacatggtgtttatgctcccgtaggagcccaaatagcgcgtacgccgagggtcatttggctcagagcgcagggtggctacagtctgaccccacacgtcccccttcctgtccctgcactggtctcattggtttctgttggacagagaaggggtgccagggagcctgccctcacctgccttgagctgtccccgctgtagtggtgctggagcttgtggtctggtttgtttttctccaggaatgatcacagctgttggcctctctaacctgcagttcattgatttaaattcttcccggaacctctttgtgcttggattttcgatcttctttgggctcgtccttccaagttacctcagacagaaccctctggtcacaggtgaggaaatgggctttacatcttggagtgggagctggaaccacagccgccagtccacacgcagctctttgcccattggagaggactttgggcctccaggagctgtggtgcagatgcgtctgtggatctctcttgaatctcacttttcaatacttacctggaagcgctgtgggcttcctgctggcgtgtacacataacagtcatggatgctaaggtctctttttcactgggaccctctcctttgggagaatgcctctctctaaatgcttttgatttcattagtctatcttaatagactaatgctccattaagataatttttttttgaaactcaacttcatagactttgaacacgttattctactatttgatgtctatcctattaactcctcagagcaaaatcacgtggcttgtgcattcaagattaacctttttaactcctccttttgttttaacactgcaatgtcctgaggaatgtagaaaggaagaaccgtctcaagacatagccattgctactggtaatatcttagccagtgcagaattgaggagtgtttgtttatacatatattttttgtgggtgaaattcacataacaaaattaactactttaagcagttcaatggcatctagtacagtgttgtgcagccatcacctctgtccagtttccaaaacatttcattaccccaaaataaaaccccaaactcattaagcagtaaatccccatcaccgcctgctcccacccgctggcagccaccggtgtgctttctgtttctatggattcacggtctattctaggtataaatagagtcataatatgtggctttttgtatctggcttccttcacttagcatgttttcaagattcatccatgttgtagcatgtagcagtacttcattcctttttttgagatggagtcttgctttgtcgctcaggctggagtgcaggcctgggcatgatctcagctcactgcaacctccgcctcctgggttcaagcgattctcctgcctcagcctcccaagtagctgggataataggcacccaccaccacacccggtcaatttttgtatttttagtagagacggggtttcaccatgttggccaggctagtcttgaactcctgacctcaagtgatccacctgcattggcctcccaaagtgttgggattacaggcgtgagccactgtgcccagcctcattccttttttatgactagataatgttcctttgtgtgtatataccataaattgtttatcgattcatccattgatggacatttgggttgtttccgccctttggctattgtgaatattgatgtgcaagtacaatcagttctcattattcatgaagttatgtttcgtagagttgccacaagcagtattagcaaatactgaaccattgctggggaaagacagtcagcaatgccacagctcatgcctggatggatcttctttaacacacaccatagccgccttatgtgtagaaacgtcagggagcacttcacaccacttggacattttaaacagtgagatcaccaacggaaagcacacggtatgacagacatggcactacatagtccgcaaaaaggactcttgtttacaggatgaggccagaacaaggcagagcgtcagcttatttgacatcagtcaggaatgtatgtggcgtggctcagatttttcactgctctgtatacccatgaaggcaccaagggtattcattttgggtttacaaatacattttagtgtatgggcaatttcacaaacacgtaattcatgaataatcaatgtgggccatatttgagtacttgttttcatttctcctgggtatatacctaagagtggaataattgggtcatgtggtaattctatttttaaccttttgaggaactgccaaactttttcatggcggctgcaccattttactatcccattagccatgtacgagggtttctgtttctccacatcctcaccagtgcctatgattttctgttgaggattattctatcttcaggatggaaagtgtgtggataaatgagattcttgctgttttttacatttaatatgtcatattcatgggaggacatctttataaatccagttgcccctgattaaaagcagctaagcactaattgataacccaggatactgaaaagtcttctatgactgcaggtgccagaaatatttttgtcatcttattattcactttgtaattttttctcagccttatgactaccatttttttttatttagaattttttttatccaccgactacacccctgtggcttcacagttcgttgtagggtgaacaccactcttagattcatcttctatgcaccactgttgggaattctccttatggagatacctttggattattgttgaaagtattcatcgtagtttaaaacattactggcaaaaattcatctacatgtgcacaactaagaaatgtacactttcctttcctgctttgattggcggagttctgcccacaccattgccccttcccaagtcaagggcaggctcaccgctgctgtggcactgatcgtttatggctgtgttctctttctagggataacaggaatcgatcaagtgttgaacgtccttctcacaactgctatgtttgtagggggctgtgtggcttttatcctggataacaccatcccaggtacgtggtatatatcaaacacactttttttttttttttttttttaacatatgtgttactttttttgccaaatagaaatggaaaacgggaagagtaaatgagttcaaagccatcactggttataactgttttctaaaacagttgtgatggcactcccagcctccatgtatgaatcagttttttgctacataaactgattaattttgtttctcgtgctgaaggacttttgggagacagcagctgagttcgctgcgtttggtgagatggcagtgggatgggcacaggccaggctcctgtccccctgcacagcctgtgccaaaggccctgcagtgtgggtttcatctgatctgagagaggtgggcacagcccgtggcacttctgcttggggagactgtcccttaaatgagttgttcctaaggtgggcttccagccaactaagaccagaaggcagtagaagaccatgggcaaaggctgagatcaggggtccaggatcattgacaagagatgcctggaggcagctgcctctccaatacccatgatccctgtttatggatacattctgtgctgagcttgggatgacagactaggatgttatgtgggtcctgccttggcggtggctgctgtgggccactgtaaagtgctgccatggacatactggcagatttccctgccttcaaggaagggtgatacttattcttaggctcaaaggttttgttgagattttcccctttaaacaacccatctccaaaaaaaataaaaaacctcaatcaagagattgctggggaaaccaaggcagaaggaatcacacacacaaatagatggaaggcactggatttaagagtccataacgactactctctttctctcctaagccagagggaattgagagagggatgcaacagtcaggctgatggaaattaaagtcagctttatttctgaaatactgatgagagagcagagcttagatataaaaaaaagtcatgagcttccttgctgagccctgtgtgctcagagcttcctccctgacccatctgtcagggtgcagagtggccaggagtgtccaaccggtggatgttcatccccgcagaagcacaacaggtacatgacctgtgtgtcccccatagcaccagacacgctaaaatggagcaaagcagcatgaagtgtgggtctgtctagatgggggggtgaatgtgcagtgactggttgatgaaggcattgtgtgatacaataaagattcagccctgttttgcaaactcagatttgcattttaaagaggtttttttttgactcagatttacattttacagagtttgttttgtgtgttttgttgtttgttttgttttgttttgttttgtttttaagacagagtcttgctctgttgcccaggctagagtgcaatggcatgatctcagctcactgcagtctctgcctctcgggttcaagcaattctcctgtctcagcctcctgagtagttaagattacaggcatgcaccaccacgcccagctaatttttgtattttgagtggggacgggatttcaccatgttggctaggctggtctcgaactcctgacttcatgtgatcctctcacctcggcctcccaaagtgcttggattacaggtgtgagccaccacacctggcctagagaggtagtttttgagcagacctggggcaggaggtgatgagccagaagactaggtaaccagatgggagaccgatagaatgaaccaggaaagcaataacatggcctgagctgggccctaacagtgaaaattgagaatatgggtcacatagaaggatagggaggtcagaaggtcattaggtgattgcttgaatgaggacatggaggggttagtgcttcttagacttctggtttgggcactggatagctgagcaccttcacctcctcaagtattctttgctgttatctaggcaggtttgatctgtgggaccatgtgtgtgtgtgtgtgtgtgtgtgtgtgtgtgtgtgtgtgtgtgtgtatgtgtttgacgacagtttcattttcagtagagctgctaaacgaagcattcctttgttctatcttgggatgtgtgacaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagtt

SEQ ID NO: 16340 - DNA, 9985 bp, Human
aggccaagccactatcatctctcaactggacaaatgcaaaagcatcctaactgttcccactgattccccgcttccatcctaccccctgctgtgaacatgtttacaatatagctagaaatatcttttcaaaacacaaatttaatcacaaaccctcttgcttaaaaccctccaatgagttttccattactctaagaaccaaagtccaaagacttaaacacagcctgtaagatactgcacaatctggcttctgttcatcttatcctcccctacactccaggccctttagttccttgatggcaccttatttcctcccaccacagggaacctacacatgctctctgcttttaaactgtgtccacttccttgcctagttaattccttgcttgggaaagcctttcctgacccccagaccaggtcaaactctacatgatctcttggacacaattgcagtttgtattgttacatactctaaaatccatgaggggggaggctgtgtttaccttcaccactgaatctccagcctatcgcaacacccggcatattctaagtgctcagtaagtatcttaaataaatgaatccttttgccatttcatacctcactcaaactcttctcagcagcactggaatctttctttggtctggccttagcttacctgtccacactacatttcatgctactactcacaccgtctatctagatggcttttgccagttccttgcataagaacaatatttttctcctagtctgcactcagttatttagagactggaacacacacctttcttaagccagtaaacatcctccaaggctgatctcagttcccacctgctccatgtacttctaccgttatactagctagcagtgcaaagcattaagttgagttctagctaatctttttttttttttttttttttttgagacggagtttcgctaagtcgcccaggctggagtgcaatggcatgatctcggctcattgcaaccttcgccttccgggttcaagcgattctcctgcctcagcctcccgagtacctgggattacaggagcccaccaccacacctagctaatttttgtatttttagtagagacggtgtttcaccatgttggtcaggttgctctcgaactcttgagctcaggtgatccacccgcctcgacctcccaaagtgctaggattacaggccccgcgcccggcctctatccagtcttgaactggcctactgtctattgaaattttccctctctaggtacactctagccattttccagaacattcactgaatcccgtcttctcttcactcctttaccgcaacagcactaagtacagcatcctgaacacgggcaggacttaatgcacatctgtgccaccgattatcaatcagtctgactgtaagcttaaatggagaatgatgtgagacctgccacctgaaaagggccgccttgggagccatacacctgcacagcccctacaagctctggtaggtaagcttacccccttccccaagccgacccactgtcctgccagtgtgggccatggtttcgggtcctgaaggacacacagtcggaggttggggacaacccagaaccacaataccctctgtcgtcctcaactttacccagagaaaagcctcctctgcgcgtgcctggcctccgggtcaagaggccccggcccatgccgtgcggcagaaccctccgaatcatagcccctctgagcccggaccctctgaaagctgcactgctgcctcgctattatcgcagccgtcactgctccgcgccaaacgccattcagacgagcgcgccaattggccagcggccctcagggctctgccccgcccaatgctctaggtggccgtctccccgtgacctctcctggagccccacccaggcccgctcccacccgccattggctggccttgcgatacgtcagtcctgcgcgcccccgggcggagatggggagggcacccggcgttctgagcggaagtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggtaccgtccccgtgggatcagaactccaggctcttctttcctgacccgatccatggtccccttcgactctattccgcgcctcctcccaccctccccgcccacctcacactgaccactcacgcgtaacccggactccgcttcgttttctcgtccccttcagactaccccgcaacttaatgacggcccccgcctctggtgtctcaactctagccgaattccggcgcctttgggattctcctccgctccctctatttatccccagcagcttggttttgttgtttcgagcctaggtgaaataacagatgggaaaacacctttacaaaactaaatggtgtatagctgctagtaatctgattgtttacatgactacttcccttttggctcccatgtgtcttgctctctctctcatctttttcccccaacttggttatcttatttctggtggaatgccagagagaagtgccccaacatcctcttgtcctggggacagatttgagtttgggggaaatgtttggctctttcccaaaggttatccaaacccagggcccaaacctgggttttctggggatagtctgaacactgagacatactctttctccaggaacggggaggtaacaactccttcacccatgaggcactcacactcaagtataaactggacaaccagtttgagctggtgtttgtggtaagtggggtgttgtagagggacgattgcattgttaacatagccctgatttttaagagaactctgattaattgcagccagtgtatatgatgacgtaactgaaaaaactagaaaggtagatgggggaaaacagcagctactgggcccaggcagggagcttggctgcctctcaggacagggaaaccggccaggtagctgaacctatctctgaaagccagggttgagttggcgtccctccattctaggctagtatgtaagcagatctgttggctgtttcttcccctaaacaggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcggtgagagacctgccttctctaaaatcaatttatttccatgatttgatgacctctctgaaggtggttcaaaggtggtaaattgatgtgttcaaagacattcctaatttgctacccagttctcattgtcctcttgggtgtgagagtcctttctctggaccgttatttttccttctgcatggggtagaaagataaaccattctcctttttgtttagtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggcaagtttgagttctttggatatactgggacatgaaaggtgttaacacggtgctaaggactgaggtggtccttccttttgtcattgcttacctgcttctcactcaaatggtcaccatcctataatccccaggccttatgaactccaagatgtttggtccaaatttcctttgaacaatttggaagacttttagccattgtctagtggttgggattggtcttcttttttcttcagtgagttttttccccaacaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaagtgagcactctttctccagtactctcaaaatactgttatctagacacaatgggtgcaagggagttctggtctctggctcatgtttcctttcctacttctccaccataactctttgtatcataacctgttgcagcaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctggtaagaggtaacaggggtcaaagtgatctttaacaacaaattgggaggaagtagagtgtgggaacgtgatactgggatttgaatgaggggtaagttatacttggagcttcccaaaatgaaagagatagagcaatgtggacgttttcctcagagaccttagtgttcctgaccccacatcctttccccgtatcttccagattcgagggactgggtctggggggcagcttcaggatctggactgcagcagctctgatgacgaaggggctgctcaaaactctaccaaacctaggtaggggaatttcaggtgggggttggtatatgcatctgcaaaactggtaagatacaactcctgcctactggttttatgtgtatgtgtaatctcctgtccctgcagtgcgaccaagggaacactgggtggcatgtttggtatgctgaagggccttgtgggttcaaagagcttgagtcgtgaagacatggaatctgtgctggacaagatgcgtgatcatctcattggtaagttctgaggaccgggctgactcatactcgcgggataggggtagttgagagcagaatcacctagcgtttctcacctgtaccataaagattggtcattgctgacatggaactgacatacctgtccccctctcctcagctaagaacgtggctgcagacattgccgtccagctctgtgaatctgttgccaacaagttggaagggaaggtgatggggacgttcagcagtaagtacttacctaagtgagaaagtgcttatgtgtaggttaagtgcatagacctcagttcttactaggtatgtgactttcggcaaattccttaacctctaaacctctgtaacctagattttaagggttattgagaggattcagtgagttagtccttgtaatgtgcgtctgttctggatttctgggacaagagtctaatttactgttttagtccccttagctcagaaaggtgttaggcatttttgagagcattccttgagtttcacagctgcaacctcctccacctcccctttcagcggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaaggtcagtgcagttccccagcctatcgctgatatttctgtacttcttgtgtctcaaaatcctggctttaggtgacttttcttacgtctttttcacagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttggtacagtgcatgggaagtgtgggggcttatttggggtccctttttctccttgggttctcttggaatttgcagaagatcaggcttgtgctactacagactcgttggtcaattacagtaaaaagtcagatcagttacttgccatgctctgcttttgggtaacagatgtagttgcaggcaaagctaatataccttaaccagagaaacctgaatttggtcaccttcatcctgttgtcctccttttcctgaatatgtttggtgatggccaagcatataatcaagtttttctcacattaccttggaaccaaatccagagcccaagacagtgaacaggtagtcaaactaggactttttgagaggaagctgggaacgagcatgagtggtagtccaggtgttcagagttgactactttctttctctagcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtgagagcgtgggcccagttccctttacaacttgagctttggtcaatttagatggttcttacacttctatcactttttctttccaggtcaagttcaacagagccttggctgaccattctatggctcagacacctcggctcattgatggcattgttcttaccaaatttgataccattgatgacaaggtaaacgtgagactggaggctggaatgggcgtcctgcacaaaggagctgaggctgcaaggaaatcttggctccagcgcttcctgttcctgagagggtgagtgaaaagtgggcttgtgttgatgggctgtcctctttctccacttaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgattccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgccttttaggtcttggagttcttttatacaggattcaaaactaaaattccacaacacacttaactgtagttctaggacatatgtatggtcaggacaacagagcagaagttgataatgctccgaggaatcaggtaagtaaacggttgtcctgagaatgagatcactccaccccaaggagaaagatcggaacctttaaactttgggttattaaaattaagcttattagtaccttgatgcaagttagagtttcttacaatgactctaaaagtagagccagggtcctggcaagtaaatgaacaagcttttaatacagcttagttatgtaaaatactgtacactgtaaaagatctagaaaactagagcttcaagtcatgttttaaaaaagccattaagcttaattgaaaaaccaagtatagagtacaaaactgcaacaagagccacagtgattccatggcatccagaccccgagtccttcatgcagagctgcagccggtcagtggaagtatcacattggtgtgctgtgtggacacaagcatgtctagcctggggagtgggttgggagctgcatttgggtcctgctgtcgcttttattcttgaacttgaacaggcggcagaatatcaagaaccaggtggtatgaaggattacgctgcaacattcccccctcttctaccccgcccttcaacctctggctattgttactttctgggaattgtgttgggttcttgtaagtttacttgttaaacactgtctgtagtagggccttacagcttggtctaaacggtggtgatttctctagctcgctcatgtactacagcctgtagggagaaagaaaagagaacaaaatgaagtttcacaaaacaggtttatacattggaagctgcagatacttaagtcaatcctaacccttcagaaggcaagacaggagattctaggaatcttgtaatttatttaaaattttatttactttttagagacaaggtctttgtcacccaggctcaaatgcagtggcacaatcagctcactgggctcaagcaatcctcctacctcagccagtagccgggactataggcacacagcaccagacctagcaatttaaaaaaattttttttgtagaaacagcatcttgctatgttgctcaggctggtctcaaactcctgggctcaagcaatcctcctgcctcagcctcccaaagtgctgggattacaggcctgagccaccacacccagcagtacttttttcaaaaaattaactgatcactgcactagattgtaatagacttgataggaaaagatagaatccttaatgggtaggagaggaaaatcattctctacagtgttttttaaaatttggcaatgtgaggtccaaagtaacattctctatattcttaaccaaggacctagaaagactttctgctacagagtgataaatagtagaataggaaacagtatacctcttatttcactgtgtgctgcagatgagccatttagctgaccttctctcaccatccctgctaaatagaggacatcagcatcagacattagactgaaaagctaaaactattaatagcaaaaagaaaactaaagggagatgaggacatatggtacgactgaaaaggaatgggcatttagaaatgaaacaatcattgagaagataaggaggcagagaggataaactggagtagtctttagacttgcattacctaacagggaagcagtgagtttccacagtgcactacgattgcttgtagacaaaacattttacattttacattttacattttacatttcacatacaggcaacatgtgtctgctgtccctaaacagtctagagggccaagtttcggtaaaaattcaatctcaccagggatgggcaaatggcatgtgagtgagcaacttcaaatagaagagtgaaaagcagcagaatactcccacaaaaaaaaatacggtagcactagccatatgcagctacttggtttcaaattaaaaattccattcctcagtcacactggccacattt

SEQ ID NO: 16341 - DNA, 43463 bp, Human
caaaatttatttccctcaaagaaatgaactttaataaagcaagaaaaatatatgatcatacatacacaatactagggcctcttgcagggcacttaaagagcccaacagagaaaggggctaaactcacttgaagcttcattagctatgtagaaaatctgcctctgcccccagctcacattctggcccaacactcacttagttgtgtgaccatggacaagctgtttgatatctcagtcccttgaatcccacatgtgaaaattctgaataactatagaacctatctcactaaattggtgaataaattccatgagataaattagaactaactggtacatagtgagtgctcaacaaacataaactattatcattattgtgcagacacagttttcaaaagaaaactgtttgggaaattcttccaagggccatgaagagcctactgaagtgtcctgagaagagaagggacacagtcagatttgcctttcagaaataatgactgggccgagtgcagtggctcacacctgtaatcccagcactttggaaggctgaggcgggcggatcacgaggtcaggagttcgagaccagcatgaccaacatggtgaaacctcgtctctactaaaaataaaaaaattagctgggtgtggtggcgcacgcctgtaatcccagctactcaggaggctgaggcaggagaatcgcctgaacccgggaggcggaggttgcagtgagccaagatcacgccactgcactccagcctgggtgaaagagcgagactccgtctggaaaaaaaaagaaaaagaaaaaagaaagaaagaatgactgaagcagcagtggggaggatgaattggtcggggaggagggaagaacggatttggagtcctttcaggactgtcctaacatgaaaatggatgagacattattgatctaaggaattttttagaaataaaatagttttattcaaaggatatagaatttcaacattttaataaaaatctaaataaaaataaaagtaaaacttaaaatgatttttcacatttaaagatattaaaataaattcaaaattgcctagtaaaataaaagccaaataaattataattaatatcaaatcttgaaataaaagtgtttaaaaatataattgttcaatattgcagaaggttcttaagcaacccaccctgctcatgttgaattgtaagtacttctccagaactgcacactggaacgggaagagaaataacatggactttcacaccattaggaaaggagacttcattatactgagcccgtctactcctgcacactcctggggtgggattgtgggtcacagggagacgtacgtgcatactgccgaagagctcccaagtggctggctgcaccagttaacactcccctgagcagtgtaggggagtctcagagggtcacttggcattttccatcattttcattttagccatttttgcaggtgtgcgcaatgctgtttttataaccaacacatcatttttctcttcctttcctggagggggaacccagcttttctaggccctccaccctttgggcaggaggaactgggtgtgtggggcggggggaagccatctctgggtggttggtcagctggggcctaaccacaggaggcagatagactgaggctatgccaagcagaaagacttatcaggcacctcttgcctttcctcatctctgccggttcaaatcctgctcgccccgcaagggcagattggaatttaccttctccagaaagcctggggtgactctatcccctcactcctcctcccccgttcgccagcttttgtcttgacatcggcggaccaagaatgtgtgactctgggcaaatcattaacctctctgggcctatttccttatctggggaacatctgcacttgagcaacagaagtctaagatccctatctgatttgatgttttgcgacccttttaaggcgcagggcgcgaaagaacagaaacagaagtgtccgttcaagtaggtcggccggggtgtcactcgtataaaaacctatgctttgaaggttctcgtgtgtctcggcctgcaggtctcgctcagagctgtgtccctgaacatccaccctgctggggtggcttgacgcacttctgtgcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagcacgcgcgccgcgtcgtttacgcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcaggtaccggtgttttgcgctctccgctaagcctccggctctcctcccagggccttcttctggtcatccttccctcctccccggggaactgtcctcctcttcggttacccctttctttcccttcatcctctggcgtcttcttcgcctcccccactttggtcccaagtcccccgtgcgtcagccacctcctctcccgcggacctccgtcctcctctctttttggatgactccctggaacccctccgacttcctgcgtccctctccggctccgttctcccttccccattctgtcacagcccgcgtctcctctatttccagtggggctgggatctgtgaccctttggttgtcctcgcctcctaactgaataaccttaacttcagttttccaggctctgctgtactctttgtgcaccctgggtggaaagcctcctaattctttcagtggtcaatgatgagccgaaaaactgccggttctttcgtcttacggccaggccctttaatctttaggatgctttgatagtgtttcccccttaacatcttccttcattcagtgcttagtttagcggaatgattggctgagaaaatagaattgaaatgtggatgtggggaggtgtcgaacttttctattaatgctgtgaactcatcatcctttgctcttgtcatcttttctggcttctgaaaaggccgtttggaaccagtgagccctcagatcgtaaacctgggaaactaagtgttgcggagtgaagtcagccatccttagtatggaatattttgacatttgattttcccgaaggtgagggaaggtttcatgggctgaaggacttggtgatttaatatagaccttcttttcctagggcactgccatagagtttagaatttagagatatcaaggaaaagattatttcagatgattcccatatgcaattagggagagccagagcttgcagtaggaccccggagatcatgacttagtagtaaacaccaaacgggtttctcctgcatgggcgcctgatgcaataatttgccttagctacagagggtggaaccctatctcggaaataattcattggggcatagctgccgcaaattcagccactttgccatctgtcctcttcgctggtttgagcctgaccgattttaataaatagcctttcattttgaaatatcaccacgggcttaacttttttcttcatgattggtgtcagaacaccgattgcatattctgtctccctccacccaccttccactccacaaataaaattaggtgtggttcctttgtcttttcttaacttgccattttaaaaaatatccttccctttagaaggaagcatacaactaatttggagaaaaaaaaaaaccaccacacccaaacccctccctctgccacgttagcctggaactgcagtgaaaatcatccatcggtagttaagacaggatctagttaactaaagtaaactttgatcgcggcagctttccgatgctactaactactgtcttgtgtattgtttatgttgtcttgattattgttttgtactttaagatattttccgaatatacgagttagttgatttaagttagtttggatatttttttctaattttccaagaacacacatatatcagttagttaattgtgtgaattactgagtcctatgtcagctgaaaaataatttaaagatgatctaattttacccattttttgtatatggggaaatgagacacactgtcacccctatccattttggataactccattgtgaagtgcaattgaaaacctttccggagtgggatttttacttaatgactggtcttgttagtagcacatgtttcatagaaatttgttaatctggaaaatgaatgaagtgagtttgtcactttaagaaaacaacggttagtatttgtggccaataataaaattcaaactttggggaaattttagaatttgggaagactcgtatcttttgctgtgagcttggcagcttcacagtccttaaagatatctgtgatgagatgagtggtgatattaacaaacgtggatttttttttgatagtatttggataatctgcgtaactcagtgaaccagtgttttccaggtgaccaatgcatgatgttatgaaatcaggtattggtgaaagagccattcaaagcttaagatacattaatagatttattctgacagtacaaaaaattcattgctatagtttctgagttagaaataaccttgaagaagctaccacttgtcagagttttgaggtagtatcaaagaatatccacaattatccgaaacggcttttaaaattatttttccttttccacctacatatgtctttcttcatatactttacccagaacgtcatattacaaaagaagcagactttccacattggtcttttaggatttttcacagattaaggttaccaaaatagtaagtgccaaactcaaaatttaaaaacccatgaggaaacaagccaccttgagtgagacttaggggaaatgataatagaattagatcctccaaaagtattagaataatcacatatttttaaaatgcttaagataatttttaaaataaaagaagtactcaaaaacatgagcaaagaacaagagactaccaaaaacaatcacacagtgtgaaaatgaagcacatattgtatggaaatggatcactgaaattagaaactctgttgggtgcccaagggctatatcaatttaacaactttaattactcagctgaaagtttttcatcctatataggtaatattttgtttgtttactcagatgacctattccaccatattactataaatatggaattagtataagttgttggaagttaataaaataattcagaaatattagcaaggaaaaaattccaactgtaaagagaaaggcaaaggaagatgagccagcagtgactgagaagaatggtcagagaagtgggaggaaaactgaataatgtttttatttttttttgtaagcgagaggagagagatttaagaaggtggtcaatttattggttcttctgtgttctcagtacaaatcttgctctttcctactttttaatcaatgcttttgtctcctcctttttcacccctctatacccaaaggaaaaaattcaccatgtgagcagttatttgttaacttgcccgtgtgttcttctagattattaaatgaagagggcagagaccttgattcataatgatcactcacataataaacatttgaattgcatcattctttttttttttttttttttttttcattttgagacggagtctcactttgtcacccaggctggagtgtagtagcatgatcttagctcagtgcaacctccgccttccgggttcaagtgattctcctgcctcagcctcccaagtggctgggattacaggtgcccaccaccacggccggctaatttttgtattttcagtagcgatggtgtatcaccatgttggccaggatggtctgaaactcctgatctcagatggtgaggagggcctttcaaagtgctggtattacaggcgtgagccaccacgcttggcctgaattgcatcattcttacatagactttttaaaaggcacgcttaaaaacacattcctaacatttcttaacttctgaaaccaatcctgaatataaattctctttcttggctagggagatcttgtgcgaaaactcaaagaagataaagcaccccaagtagacgtagacaaagcagtggctgagctcaaagcccgcaagagggttctggaagcaaaggtgagtcctgggatgctaaaataggaacataagtaggtataggattgttcatctttaatttctttggatgggagagacctagaaaagtttctgaacaagtatcatttggtttatctgtttatccataatgccgccttctcctttccctctacctggtagactcctcatcctttcaaaatgcaactcaaaatgtcaactttttaataaagccttcctgaccctgcaaatgctggactcaatacgctatatgaatttccatggaaaggattgtgctcttctttacgacttctcttatgcctgaaaataatgatttttgtttgtttgtttgttttaaggaaaaggtctgtttatttgatacctgctcccagacctttcaaacaatagatctcccatcaccaaacttaagttgttttggggttttaaagtaaccattttgctatagcaatccactgacaattcaaatattgctttatattgcttatcagtatctacatcaaagtaaacttagtcttgttttttttttgagatggagtctcgccctgttgcccaggctggagtgcaatggtgcgatctcagctcactgcaacctctgcctcccgggttcaagtgattctcctgcctcagcctcccaagtagctgggattacaggtgcccaccaccaagcccagctaatttttgtatttttagtagagacagtgttttgccatgttggccaggctgggcttgaactcctgacctcaggtgatccacccacttcggcctcccaaagtactgggattacaggtgtgagccaccgcacctggtcaagcttagtcttgtaatcttggaaatgatcatatattttcctaaatgattaagtaaagatatcttttatattactcaaagggaaaaaaagacctatggcttctattgtttttaacctatcaaaatcttgtctgtttgataaattttatatttaattctggtgaggaataaactaaattcagatatataagttcagattcccacccacccctccactcactcactttttatttaatctctaacaggagctggcgttacagcccaaagatgatattgtagaccgagcaaaaatggaagataccctgaagaggaggtttttctatgatcaagcttttgctatttatggaggtaagggattaatgacaaaaagaactattgtgttgttagtggctctaatattatacttaaatcaagaacatggcttgcctgttggtatccacttgtatcaggccacaaagcagaggatggatgttttgcttttgtttgcttggagtcaccatttggtgtgatacctgttatttttctccactgcatttattcctggacagcactttttttgattaggatgtagggaattgttggaggcccatgtatgtatttgatgtgtctgtgtactcatgtactctttttaaaatgcaatggagactgaagagtaacagagggccattgtagtactggctaactatactatgccccttcacacaggggcagtgataaaacagtccttagattattctttatggtcatctgccaggagaaaacattcttcccagggatgtagataaatcactgtgaatgccatatgaaggtatataggcaaatacaattcactgatgaaatgtaaaactatatttttcatagtcaacggattattacaacaacattagacatatagtactttgccactgaaagttgacttgagtttggctaagtggatctgtaaatgtttacccttttgaggttaaatagtgcctcaaatacccaggaaaaaattagagaattggatgctaaaattatagatcattgttatcagatgtggtgagaaattattttgtaatttttacggcagaaaactgtaatctgctttttcattctgttctctaagggggaacttttgttgtagattttgggctagtcctacttgaaattacaaatatagaattagtaaatggcgtaagagcttttttattttacttccatcagctagctgaaagtaaggttcttcagtattgagggatttgcattgttgacttgaatacacttttagggagtataggtatcagtttctcatgtctccttgccttcatttgttcagagtaacaaggtaaagtatgtgttttcctctcatattctataggtgttagtggtctgtatgactttgggccagttggctgtgctttgaagaacaatattattcagacctggaggcagcactttatccaagaggaacagatcctggagatcgattgcaccatgctcacccctgagccagttttaaagtgagatcttactttggagtgggggtatcctactttaaataaaataacttattaaattatttaatatacttatctaaataacttcctgattataaagaactactcatttcatgtagaaaatctgaaaaatatggaaaagcaaagaaatgtataccttctgctcacagatagctatgttaagatgattgtgtttgtccttcctgttttttctgtacgtccctatgtatttcagtgttagcagtacactgcttattttcatgtaatattgatgaacatatactcatatcattaactattcatctaaagcatttttaatgatagcatagtattctgttttatggaagtgccataatatgttagtttgtgccatattgaaagcattaaagtgtttctcatttttgactgcaccgaatatcttgatagatggatttttgggtatatccttgattatttccttaatacaagttctgagcaaaggtatacttgtagagattttcagttaaatactatttgttttaaagtttcaatgcagaaacttagattattcctaccaacgttattgaaagtagggcagaatttcctttttttgtgtgtgtgagatggagtcttgctctgtcgcccaagctggaatgcagtggcttgatctcggctcactgcaagctctgcctcccaggttcacgccattctcctgcctcagcctcccaagtagctgggactacaggcacccaccaccacgtctggctaattttttttttgtatttttagtacagacggggtttcaccatgttagccagggtggtctcgatctcctgacctcgtgatccgcccgcctcggcctcccaaagtagggcagaatttcagaatgtgaaactgaaaggaattcttttatttatttatttattttttgagatggagtctcgctctgtcccccaggctggagtgcagtggggcgatctctgctcactgcaagctccgcctctcgggttcacgccattctcttgcctcagcctccagagcagctgggactacaggcacctgccaccgtgcctggctaatttttttgtatttttagtagagacggggtttcaccatggtctcgatctcctgacctcgtgatccgcctgcctcggcctcccaaagtgctgggattacaggcgtgagccactgcgcccggcctgaaagaggaattcttgccattttgtaactcgtcattattcatttaaggttgactggtggagagctaatttttactattggcatccgttaggttctcttaataatttcagccagtgaagaggaggaattctgaatgatggctctataagatcaggactacctatcattttagctacttgttccaccaataggaactttgtagagataataccaatgtcagtacaggtttcagtggcagaaaacacttcccttaaggttcaatgtctatactgagctgccatgaattcttaactagtcaaattcccagtgattttggcctttgcttagatcactaataataatggcataggcatggattaattgatcctgaagaatagtacagactttatgacaacttgtagaaaagaattgtctttttattgtctagttaatgtcttctttcttatgggaaggaagaatgtgggagagggtgagaaatagatttgaggaagaattttctctggcatacattactgtcatggatacatcattactatagatatgggagcttccatctttgagatggatataaatattgatggggaattatcttataaggtaatatctatgtgtaatttgtatgagaatgacaaattgggttggcatttgttaatttaggacctctggccatgtagacaaatttgctgacttcatggtgaaagacgtaaaaaatggagaatgttttcgtgctgaccatctattaaaaggtgaggttcttcatctccttcaggtaggattgatcaaaataaaaggtttaaactttctctcagatgtctttcattaaattttttattgaggcataacattcaaagagcaaagtgcacagatcttaagtatatagatcaagtcctttattttttaaaaaagttatatgtagataattagttatatacagataatttttctaattagcaaatgaatcaagacaataccatgactgctgttgtaaaatcaactgtgggattcatgtaaattaagaactttatgcttggatttactttttaattgtctagcattgaaactgaaaagtgcattgtactttttcccattgattgatatatgtcaacactgttcttacagctcatttacagaaattgatgtctgataagaagtgttctgtcgaaaagaaatcagaaatggaaagtgttttggcccaggtgagtactctagagatgttatcagagtaacctaggtggtcgctgtccttctttcagtgtttaatgactgttgcatttcccattatgctgaccctggccacattgtaatgaagcagaggttaattctgtcctgtatagcgtctctttttttgcatttttattttcttctctcttttgtgactaaccctttatttcagcccaaactaacaagtccgtgttaataggcattcaatttgtctgaccttggaaactacttttctggatttaatagctaaaaccacaggagtgactgatgatgggtagtgttcagcactggtgtggagacttcggggcagataacttgatgagcactttctcactggctacttgatctgcctctgcttggaccctgatttcatgctattattcttagaacctcatgagcaggtcctgacttttctgtccttgcttttctcagtttgcctataggcctaaagttttataatttgtataatatttaagctgacaaattttagagaagacaaaaaagagaccacagagataatttattctgaccttttaccaattgcaggaatactttctatattagaagtagttcttatccttttgttgggtcacagaccaccctaagaatgtgatcaaaactgcacgtctccctgggaagatgcatgtgctcatgtatatatgttgctggtgtctcacctcatctgttggctattccgtttaggcaaagtacatttctccaacaccatgtttagtcatgaggtctactgaggctcacctcttaaattttatttacttccttgggcaaaaaacaaaaaaccaatactgtgattatacctattttctttacaccgatctctctctctctctctgcctgaatatagaactccctaatatgttgtttttcatgggaattactggatacttttccactgttgtcctaattttttttttagcatgctttttttctctgtgatagttaactttccaacatagctaaaataatttctccttcttcatttacattgaaaactttcttaatttggctgttgaatcatctgctgatttattttgatacttgtggagtgtaattttatcccttgcttgaagctcattgttttagtaattactcatggtttagaaaattatttcttacattttgatactgttgaagccacacgttcatctcattttcttatccaaaggcatgccctttattagaaaaaatggaaaatgcctctaagtatccctaaaattttccattcagaattttagatttactgaggttttgtgtatatgtttttgatcttaacagtattattcatttccaagtacgttgtcagagttgggaagtaactagttgatttgacaagtcaatttattgtttgagcattggccttctctcttatttcagatctgtgttctaggagagcaatttgttttttgacttgccatatcagatgcatgtacagctgtcaatataatcttcaatgaaaagtaagggacccatgggaaatggtgtagcactcagaaatggccctggtggattcactggctgaaagcccatctgttgcttaagcacagagtagcgttttctgcaccttagtgtctgactccttttcagctttatgaagcatcattgtttctttaaaaggccctgattcaccttctgtggtaggaagacctctactcctattatgtggatttaacagctcagaacgaattcttttgtttctcttctctgtctgtttttgtggtccatctctggatgttccagttttaaaaaccatttttaacttgtttatgaaaaattcaaaacatacaaaattttatatgttaaataaaaacataataaacaattatgtacctatcaccctgcttcactgttagatttttttgtatctattcccctctcactttcctgacttctttcccctaattctttgtgtgtggtagggtggggacagagccccactctgtagcccaggctggagtggaggggcacgaacatggctcactgcagccaggacctcctgagctcaagaatcctcctgtctgggcctcccaaagtgctaggattacacatgtgagccatggtgcccagcctgaatttttttgaagcagatctcaaacattattttattatacctgtaaatttttcattatctatctctaaaagagaaaaatcctttaaaaataaaggatttaaaaaatccttttcaatcctcttaccttgggaaatgttaataatttaatatcatcaaatatttgatcagtgttcatgttttctaggctgtcttaaatgtttccagtttttaaaatttgaattgggatccagataaagtctatactttgtgataggttgatatgtttcttatatctcttccaatctgtatggccttccttcattcccttttccctccccgcattttcattaaaatttttttcaagaagctgagtcatttgttccttactgttttctactgtctggatttggctaattacgttattgtagtgaggttacacatgttcatctttttctctattagatttagaagcttgaccaggtatttttggcgagacatttggttaagtggtgttatggacttctgtccagagctacatagtacctggttagctcttctgtgggctgtggccattgatgtccattgtttagatgcattaactgatgaggggatttcaaaatggtgatttttgtcattgttattctttttttttttttttttttagctagactatttctatatgaaaaaactttctatcaactatttgatttaactgagacacgatttgtaaagaaaggtgagaataagtgcttcatccattctcccaccccttgtctttttaaacctgttttccattagttggttccctaacatccttcagaaatgcacgagttcctgcctgccttttcgttttttcctcctactgttgtgaactttagattcaaatatttgatattcagtcagttgcagttatcttattggtggttaaattgtccagtctttggtgactaggagttctctgctgagtccttttgacacagcccttgtagtctctgaaaacttcctttaatatgacaagatattgccatctcatcttatacatttcctgtcccagacttggaatcagacatttctccaaggagccctggtacttgatacttattagtggggatggtattgatcactaattataaaccttgtcagtgatctgagctaggaagttgatattttttaaaagataaacttttcatgagttaatatagatacttaatagttaacttaaagttaggtttatagggtttttactatattaatcttaaatctctctcctttacccttaccaaaaatcgcagttctcagcaacaaaacataatgattgatgtgccttatctcccactgtatacgttaacagtctcagaatgacaataccaacaccaccatcagcaatatgaatgttgaaaacagttaaaaacacttttattgttcttttctttagggatatgccagcactgtgtagtcttacagtctgataactgtatttaaagtcacttggagtcattctctctgtgtggttatgccatcagctagatatgcagttagtccatatatttcattttattttcagtattcagggtttcctttttaaaaatttgttttataatcatatagcacaatagcaaagacttggaaccaacccaaacgtccatcaatgatagactggattaagaaaatgtggcacatatataccatggaatactatgcattcataaaaaaggatgagttcatgtcctttgtagggacatggatgaagctggaaacaattattctcagcaaactctgacaaggacagaaaaccaaacactgcatgttctcactcataggtgggaattgaacaatgagaacacatggacacagggtggggaacatcatacacctgggcctgtcggggggtgggaggctgggggagggatagcattaggagaaatacctaatgtaaatgacgagttgatgggtgcagcaaaccaacatggcacatgtatacttatgtatcaaacctgcatgttgtgcacatgtacactagaacttaaagtataataaaaaagttaaaatttgttttataatcatataaagcattttttatacctctaaaggcaaatctaaaaaacaaggtatatttagtctactatctttctcttccctttaccttccgtccttctgcttccctgcttcctgagcagtttttaacttaaaacaacttccttttttaaaaaaatagaatataaacaaagacatatagatatttgtatgccctcctttctagataaatggttgcattccatacacacttttctccattgtggttttcttcacataacaaaatatttcagagattggtccctcatagtatatagagattgcctccttccattttatagctacataattgggcattgtgtggatatattttacataaccagttgtccactgctggacatttaggttatttcccatctttaacattacagataatgctgcattgaataatcttgtgcttatatcttttcatgtttttgctattgtgtctttgggatagatgcctagaaatgggacaaaggataaatacaaatatagtaatgttagatattgccagattccctttcccaggggttttgctttctatctgtattggcagaatctttttcctcctgatttctttttaaattatgccttttattggaaaacactatatattcttgaattacctgggaaatagatgttcctcaggctctttaactttctactctagtaggaccagcttatatttatggtacccgtgtcttgaagttcactggaacagtttcctcattgatccagcctcttgggtaattgtataatgttattttgtggattcctcctagaaattctgtagaaatagagtctagaaggcttaatattttaaattgcacattcaaatctggaacatgttgttagtgtgagtgggttgcctttttatggagtggaaataccattggatttatgagggtagcaaatataattgctctttattgagtagttattatgtaccaggtcctgcctgtgctaaatactttacatgttttgtttaatcttcatcatattcctgcatagcaaggtagaagctgttctcccctgttcttagagaggttaggtaagaacttaatctttagtcacacaacccataagtggtgtagagttgggagatacgccaaggtctttctgaactcgaagcttcagttattatggccattaattgatttactgaattattttgtttctgttaggaaacttttaagttttaaatactgcttactattagatggtttgtcatagtcacttgaaattcttaaattggagggcatacatcattttacaggatttggcactgatgatcaatgtatagaatgtgcaatacactggaaaatgctgaggtgaataagatacagcttctgtcttctaggcgcttaatatctaatgggaaaggaaagttcaatgcacatttaattactccattgaggagagggtggtggctattaatagtatatttgcttgactggatctttaaaatacagagaaatgcagaaatgcaccttaaatatgttcagagtagtaaaattcagctttgaaaacttatttaggtaatttcagattcttgccaaccaataactattataattgaataagaggtattttgctttatctttcactttgaaacagtgactatatgagttttaggtcccagaaggatatttttttctctcttgataaatggaaagtgaataaattggttatggttttaatgtgggtgtcctgaaggttaggttaattgtgatgttcctgaattttgtgtgattgtagcagtggatggctagggttatatataatactttatatcttatgccttgttttctctgtcttttacactaatttctttatatgtcttttagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtatgtatcacttattgtttacctgtttatgtaatgaagtttttaaaattgcttatattaaaaggtaaatatcaatgttatgaaggaaaaatttttaaaaagtgatatacagaagtacagatgaatgtattatggagaaataatggcagaaataaatcttttaaaaaattctttctgaatataatttcttttttggcatatatgtatttttttggcataaaataaagtctctgatcactatatcttctagttatagctgcatagggtagaagggacagttgaagaatggttttaaaagccgttgaacttattgctgaaggatattttagaaaccatttagtttagcatgctactgtccaacggaactttctgcagtgatggaaatgttctgtaatgtgtgttgtccagtatgattagctaccagccacatttggctcttgagcactcataatgggtccagttcttctgaggcactgaattttaaaatttatttcatcttaattgaaatttaaatagacatctgcctggtgtcctaccatattggacagcataggtatagcctgttgatttgaaagatgtggttttcatggataaagaatatctggttagtttacagtatgattcagaattggaatctttatcttctgattccttgtccactgtttaacagacttagccagtgttccatttcatagctttagatatttttctatgatagggtaagagagtaagtttttcctacatgagctagatagatcgtgtttcccagagtagggactgaagaataagaaaaattaattgtgacaaaatgtgttgcagttaattattctaatgagacatcaggttgatttggaatatttcatggaaagaggccagtggcaagcctttcattttggccatatgtacagagtcataaaatgagacataacctgtgacccagacattccatttctgggaattgatctaaggaaataattcagaaggaaaggaaattatacttagaagaagtatataaattgaaagtagaaataacctattcagtaatttgagagtggttaaacaaattatggtaaagtggattagtttgggataatattctgtcactattaaatgtgagaaatttgtgccattatttagaaaatgggaagtataaaataggtaatacatgattttatacatactaactgtaaatatatgtataaactttacttacatttggatgaaatctggaaagggccataaaaatcaaaagagttggtctgttaagtaagaagagggtacaattttagggtttttagcccttggttttaaagttattttagtaaaatacttattctgaagtaggccattgggagcgtttccttagtggatgttttgcacagaatatcttctaggaaattgagagggcagtggttatagtagtgtatttgcttgactatatctttaaaatacagagaaatgcggaagcctctggttgaaaatataaaatactgcagataataaaatgatttgaaaaacattgaaaattacctggcttggtgaggtgatagtgataagtgagtgctgatgttaaatgtgagcctatactgatttctttttagcccctcagttaagttttaatatgtgggttaacagggctaaacataggcatgggtattattttccaaaggacctaagattgtcatctgcctccatgtacatgatgacttagaagacatcaggggtttaaggggcactatgggagaggtggtgttttttgtttgtttgttttgagatggagtttcgctcttgttgcccaggctggagtgcaatggcgtgatctcggctcactgcaacctctgcctcccaggttcaagcgattctcttgcctcagcctcctgagtagctgggattacaggcatgtgccaccacgcctggctaattttgtgtttttagtagagacagggtttctccatgttggtcaggctgatctcgaactcccaacctcaggtgatccgcccacttcagcctcccaaagtgctgggattacaggtgtgagcgactgcgcgcggcctgaggtggtgtttttaaatttatttttatttctgctttttgagaagtggggttttgactcactggtgtaattaaatgaaatggcattgccaaagtagtactgccacactaattacttaatacattttctaatacgtgctatgaaaatgtttgctaccgaggaaaatatttctaaaacttcattttagggcctgttcaactttgttgtgaaaatggtatatttaggacttttaggatttgtatctagaatttcaggattgttggaaaacataatttctttctttgtaacagactgacttacttaaatttataggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcaggtactgctcaggttactcttacaaattagtgaatgaccttggcattgcattgaaaatgaaagcttgctgttttgaaacaattctgcttcataatcctgattatgaatttatttttgttttctccaaaaatcatgttttacatttggaatctctaaatgtaatctccaggatgacaggcagttttgagtgacaaaagtgaacttgaagggaaaggaaggagggtggagactgtcttaagagtctcacctgctccaaaattacctttttccttgttcatcgtatattttgaggatggtaatatcttgattgtctaaaccaaggcaatactggcaatggtgatgtgtataaaagggtggggtcgggtgggggtagggtgaaagttgtggcaggaggattgttctagatatctagggcagacaacattgctgaagttggggtgaggatgtatcagtaaccaactggagttctggaaacaacctccgtccaggtatttggggggcctatatgacagaaaggccagcaagcaagcttaccctcatcactcacttggcctctattcaaatagcctacttttgtctgatctatccagggatgtgtgggaaggcatattggggctggtgagttctatatttctttagaaatttattatgactcagctgtttatgacttaagttttttgtgatttctatacgttattcctggtatcatctcttagagtaatacattccatataaaatacgaggtgtagctaaacataactttctaaggccccaaagtgttttcccagccccagcgcccacccatttcctgtcttctcttcttactcactgtaattacagacttgggtcataacatagcccagtcactgactctggatcaaagcatccacagcacctgcctcatcttgttagttcccatgatgccatctgggagaagatgcctatgttctgcgcaaactgtatctctaggccctacaggtttacggtttaggaaggagggacttacagaggaaagaatgtgcccaacttagagaaagttgggggaatgacccctctgagctttcatgtaaaaagaggaggtcatcagaaactttagccaggtatgatggcaatgacaaatttgtcagatttgagtctttgttttatttcccagtgtctgagtgtttttgtttttttgtttttcaccgtttcaatatctagcaagtatgccttcccaaactgaggaagctgcgtaaggctgaccttgtctgaagccagtgttacgaagagggtttacacagagtagctatgggaagattattgagaaggactgagaagtaaggcagtgtctggggcctgtgcagtaaaaaagtggtgagtagggaaaccagcttggaacttgggagtgatcccaggggttaactggtagaaaggctctggggcttctcaacagtggattctttggtcattttcacttcaaagtgtcatgtctgaattctggctagttttgttatgtcccttgcaagttcctgaccagaagtccactagttttttcatgagtcagcatcctcctggcttttgttccatggtaggactaggattggtttatttagtgttctgattcttcttgatggcagagttctctggtgattaatctttgcatagctgtatttccttttgtccttttgttagtttagaggtattagattgttcatatgaagatttttctaaaattttattttattttgattgacttatctgtcttcctagcctgtgtgtattttagttctctacagtttcaggtacagttgctgaactgagatacagttactcagaattctgatgattcctgcctcctatctatgagctgagattattgatgagtaaattttgtatgatttgtatgatttcaagtcacacagtgtggtgctttgatatgcttatacattgtgaaatgattaccacagtcaagctaattaacataattatcacctcacatagttactttttttttttttagtggtgagatctacttaacatctactctttgagcggatttcaggtatacagtgaatcattaactatagacacagtgctgagatttgtgacagaacagatggaaagactttggcagcagcattttggagattctaggcagggcccgtaatttatcctgtcccacattgtagatgttcagttgctgtcagcccaattataagctatgtgaggacaaacaccatgtttgtttctctcacatttatatgggcacagaagatgtttcctagttgttgaaagacaactaaaacataggtgcagcaggaccaaataagagacactattaaaaaataaaatttaaaaattaaacctcttggccgggcgcagtggctcacgcctgtaatcccagcactttgggaggcagaggcgggcggatcatgaggttcaggagattgaggccatcctggctaacacagtgaaaccctgcctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgagcgagactccgtctcaaaaaaaaaaaaaaaaaaattaaacctcttttgcagtgtatttcatgtatttttaggatccatttaagcaattttacattactcgtaaaacatctgagataatcatggaagcacaccagaaaatgtgatttttcttgaaagaagagagattgattttgactcataaaattaacttgaaacacttctcccgcaaatagctactaaattgcattcagagaaatctctttgggaaaccattactatgtgcacttcatcgttaggtaattagcttgatgttagcttgttcaattcatgccttatatcctttgccttgaataacactttatttaagaagctcttgctccaaagaaaccaactgtatgatgccattatcagtcatttacttttttgtagcagtaaaaaagaagaaatcaaactgctatgaaagctaaagaaccatttcatttcgcttttaatttcccattctttgaaatgggatgaagaaacttcatttagtgtatacttataaagacttgctaatgctttaaggaaaaccattttatctgcatgtcactattcaatatcttatttcttatttttcatgtgatttttgcgtatgttttcctaatttaaaaaactatattaatctgcctttaacaagttattttcagttaaaagtaataatctttttggatgtagctggagggaaggaattaatacttcagagaagttagatcatgtttattttaaatagtgagtaataaaattttcattaatgtgtttaaaaataaccttcacatgtaccccataaatttgtacaaatataatacatcaaaaaaataaaaataacaactacccagacaaatttaattcaaaatttttttggccattcccttaggaaaccaactttctgtttagtgaaaaagaccactatagtatggagcctttatcactagaatgcagttgaaaatagaggccttgttttttgtttgtttgttttttgtagttaaatatgcaggtttatcgcttacgtttttgctttcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacaggtaggattctggaggtaacttaacttagattgtgcctgttcagggtttgcagcaattagcaaattctatgtgttctgggtgacaagatattttattttggcagtcatttgcttttttacagtacttggttttgtacagaatttgttatacagtattattatagtaagagaaaaatcacctgaacatctcaatttgtgggccttggggctagcatgaaaaaaaatgtttagcagagcacttggaaaatagatcttggtttgcattgtgcctcaccaatctgactcaacagtatgtactactttgggggagacagcattggacccacagaaagcaagccatctgggtttcagactcttctgtattacccatagcagtggaataaggccttgcatataagcactttgtaaatatttgcctggagaagtgagtgcgtgaaaacttgccaacagtagctgctgtccactagtggaatgagttgcctcagggagcagtgagcttcctggccctgaaaatactcctggcaaggttggacgatagcttgtcagccactttgcagagaagacctctgcagtgtatggagatggggctagatgttttctaaggtccttgcaaacactaaaatgattacgtgtactctacggggttcacaaatttcagtgggtaaggatacattaaaatcccctcaacgtgtcattactttggttaattcagaggggaatgtctttgccattctttagtgtcaattatgaatattgtttttagtactgtagatttagaggtatgaggtactgggctgaatttttgctgacccagtaagtatgttggacagattttgaataactccattatcatcatcttgacattaacccattaaaaaataaccaagatctcattctgagtatttgaaattgttttgaaagcaagataaaatagtttgtgttgggtgtcaaatatttttcagtagagtgagtcaatggaaaccgatatcttggctttgaagagtattaatgtgtgttttcttttcttcctccatgcttgcttattggttggtttagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacgtaagtggagtgctgtttaccatgtgattttcacattgttaacttagaagcacaggtaccaaatgaatttttgtgcactttatgtcacagaggaacaaagggaaaagaaaagagatcttttcctgagcaaaacagaaaaagcagttgcctcctgcctttttataagtgtcctaaggagctcgttgtagtcttagatagctgagagacagagttagtgtatgatgggacagtgcggatgtgtacactgctgtacagtgtattggcagcattactggcaatatcctggagtggatctaaggcacattggcctctccttcctggcaagagtcccagcaaacattggaaatggtggagaggttgaataaagaaagtcatagtgctcttagctcaatgagctatgtagtagctttggggaatatactagttgattctgatctctggcttaagaactaccttcctcaaatgttatgtatttaactcaaaattcacagacgatctccaggtaccctcctgcccctgtgccctgtcacccctccagcctccaccaccaaacatgaacatcagtattgaagcggagggacgaaaggcatttgcatataggagatgctgtctatattggtggcaggaggaaatgtggcatctaaaacaaggctgagagtcttttggcatttctcttattgggtgttagagaggcttcctcgcctacatagaaagagactttagtccaggggtcactggttccagtatacccttggttcagtttttacttttcagaatggctttctttttatggatttttaaaaattaaaaatcaaaattagtcatattttaaaaagtaatgactactttttttaaaacaaaaaggaaaaaataattctgaagactattatgtagaaaattaaacttccagttatatgcctctccccaggtgttttatgtctcttctctgtattgagcaaacattttctataaaggaccagatggtaaatatttttagctttatgagtctctgtcacataactttgttgttttttacagcttgtaaaaaacagcttttaaaaaatgtccaaactggctgggtgtggtggctcatgcttgtaatcctagcactttgggaggccgaggtgggaagattgcttgagctcagaaatttgagaccagcctgggcaacatagcaagaccctgtctctacaaaaaatacaaaaattagccaggtgtgatagcacgcccctgtagtttcagctacttgggaggctgaggtgggaagatcacatgagcccgggaggttgaggctgtagtgagccatgattgcaccactgaactcaagcctgggtgacagagtgaggccctgtctcaaacaaacagacgaaaaaagatcatgcttagctccatggtcttgggtatgtctgccttctctagatgatttttctacgtgttctaacacatgcatgcataaatgcataataatatgcatatgtttataaatggctattaatgatgttgtttttaatatattctttttcccttgtggaattagaaagaattactgtaatctgttaggattttcttagcaagcttgcttgacatatgtcaaaatgataatagtaattatttttaggattatgggtgatcattaatttctttacactttttagattttctgggacttctttttattttcagatcaaaccaataaaatgtttttccttttgtatgagaaaagattattacttttctttttgtttcatacccagctccttctcttagtttgctctgattctgatttcagattaaaccagatgttgttcttgctgtctcagttaagtaatttgcttaagtctcacagccagtgagtggtgaggctgggatataaacctggctgtctgacaccagactcatgctcttaacagttatgctgtactgctttataaaccccactggatgcctgctcgtccttatctaagtgccattgtgagggttagggatcagaaaatggaaagtcactggaaaacagggctaaatgaaacaagaagctccagagtcccagaggctcttaaggagaggggagaactcccttagagagtttaatactttttgtgtactttatatatttttttaataaaaaaatttaccgttgcagttaatgccacaccaattctctttccatccagagaagtaaccactatcccaatgttgttattctcaggcacgtttttgtaattttacctttcagtacataaatgttagttgacatctgcagtaaattataaccaccaaactatatggttaagaacataagtatacttaaccagtcgacatgtatagggaatgtcagattgccaggttacatgtttttaggctttgttctttaattccttttgttgttgttttgtgttggagtttctgagctcatatgagttttatatttgcttgctttattacagacaccccatgtgataacatgtgcttggaaagcttagtagttttttctttttttcttttttttttttttttttgagacagagtcttactctgtcacccaggctggagtgcagtggtgcactctcagctcactgcagcctctgcctcctgggttcaagcgattctcctgcctcggcctcccaaatagctgggattacagatacatggcactgtacccagctaatttttgtattttcatgaagacaggatttctccgtgttagccaggctggtcttgaacttctgacctcaggtgatccacccgccttagcctcccaaagtgctgggattagagacacgaaccactgtgtctggccaagcttagtagttttgatggttgaatttccccaaactctttggatcaagggcaaaaaaaaaaatgaatcttcttgagaaggactaactaggtatctaccaaaataagctctttacaaactcttgttcttattgaaataacgggttcttaagagtttgtcatagttggggtttctataagaaagcaccacatacagagtggcttataaacaatggacattgatttctcaccgttctggaggctggaattgagagatcagggtgccagcatcgtctgatccttgtgagggccccattctcagtcgcatactgccaacttcttgttgtatcctcacatggtgaaagagggcaagagagctctctggggtcccaaattccagtgattagggctccatcctcatgacctaatcacctcccaaaggcacctcctcctaataccatcacattgggagttaggatttcaatatacgaattttgtcaaggacacaagcattcaattcattgcaggttctttgaaaataatttaaattttgctttttaaaagtatcttatgtgtgtatttataagaaagggaacctggcatcaatgtgatcataatgctcttatataattttattgtgtgacctgaactttacccactcttatactgagttttcttttgttcagtgaagaaagtgaattgaatccaaatgcccacatttatggccagctgaagtatgtgtttagtcagccatctgatatcaagttgtgagaacactaggtacttcatctaaagaatagtggtttctgccaaattcattttgatttctgttcacaaatttgaaccaaatttacaggctttgtctaggttcacatttaatttccataattaaattccagaatatgttagtttaccccacagactcagtataacaatataaatccatccagaaaggaagactactttgtgtacagtgtgaattatatatttttttctttctttttttttttttttttaagatagggtctcactgtgttgcccagattggtctcaaactcctggcctcaagtgatccttccacctcagcgtcccaagtacctgggattacaggcatgagccatcacacccagatcagtgtgaattatattttataggcttattagctgcctgatatatgaggctattcccatttcaaatatttatgaaatttgaatgaagattatatcatcgaattatcattgaatatatgaaaggtttataatctgcatgcatttgtgaatgaacccaatataagtaataataagtaagtaatgtttttattgattatatctttttagggttggattgagattgttggatgtgctgatcgttcctgttatgacctctcctgtcatgcacgagccaccaaagtcccacttgtagctgagaaacctctgaaagaacccatatcctttctggtcactccaaaaactcaggattcacatgtgaacatcttgctaatgaataagtccaagtctttaccttgttctatggataaatggagatgttttagacactgtagtaacgcttgtttaaacctattattttacctatccctttgttcctttcctattctctgtacttgtagtctgacgtgtgcccactcaatgtttggcctttaaaagaagcatatttagaaaaatgctctgaatatctttcagaacgttaatagtttttctcagctgtttccaaaacgcacttcacacctgcacctacctacgtgctctttaaataaagggtacctggtgaaagctttttccattaaaagatgagtgccatttgatagtagctgaaataataatttagctcacttggtctgaaaatcagcaaaatagaaattttctttctttagtaggcagtgaagttatgagctgatttcttaggggtaggtcagtgacaggaaatagatcttgttttgagcattttagaaatacttatcagaagttcttatgctatgggttgggtcattgctgattagataatatctcttttttctcactgtaactggaaaagtttctattgatggtgttaattttggatgagagttgtctgaatgattttgtggacaggtgtttcatcttgccttaaaatcagcataaacaggatctggagtactgatagagagctggcatggttttaagttgatgattgattgttctcaggctcattttctgaaatactgaggcagtgctgtagttttggattccttgactacttcatacaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaagggtaagatatcagatgtttactcttccatgggctccagtcagttgtgtcatctgccaggttctgaaaggatgagattaatttcttaagattttttgcaggtaagtactgtatcttggctgcatttaaaagactgtctttgccgagattttggcattatagcctgaaaaaagatttgaaatagaatatactttttttttttcctagtaactgtcttaaacaaagagacttgtccagccaggctgaggaaggaagggttagaaactacatctactatctctcaggtcacttctctctcctttttggaggtttagaatactctctgtaattgtttaagcatgaatataaacaatagagaaggccgggcacagtggctcatggctgtaatcccagcactttgggaggctgaggtgggcagatcacgaggtcaggagatcgagaccatcctggctaacacagtgaaaccccgtctctactaaaaatacaaaaaaattgtccgggcatggtggcgggcgcctgtagtcccagctactcaggaggctgaggcaggagaatggcgtgaacctgggaggcggagcttgcagtgagccaccatcgtgccactgcactccagcctgggcaacagagtgagactccgtctcaaaaaaaaaaaaacaaaaaaaaaaaatagagaaaagcctttaaagaaatacaacaaaatccagcactgaacagtgtaaaacttacaatatccagcaaacaataaaaattattatatatatgaaaaagcaggaaaatgagaagtaaagtcagtcaaaagaaacacccagaaaaaacaaacatgatgcagtaagtacataaggatgttaaagcacttattataaatatgcttcatgtactcaagggtgtaaaggaaaacattaacatgtgaggtgagaaatggaaaaatatatgtgtaatatggatataaacacatgttttttatatatataaacaacatgaaacatttagaggcaatatctcaaatgaaaatgtcactggatgggattaacagtagattaaacattacagaagaaaggtcattgaacttaaagacatagcaactatccaaaatgaagcatagaaaaaaatgagactgggaaaaagatgtccagtgggacaatatcaggcagtctaatgcatgtgtaattgagagtcctagagagggtgtatagaaaaaatattatacagtagctagaaaatttacaaatttgatgaaaacgctaaaactacagattcaagaagcttagccccaagcaggataaacacgaagatgaccacatgaagacccgtgagaatcaaatagctaaaaaccagggatgaagagaagaacctttaaagcagctagtggggaaaaagactcatcacataaaagcaaacaaagataagaatgattagaattcatatcaaaaactgcgcggatcacaatataatggaatgaaatcttttaaagtgctttaagacaaaattcctacacccagcaaaaatatctttcaaaaatgaagaggaagtactttaagaccaagcttgttcaacctgcggcctgcaggctgcatgtggcccaggatggcttttgatgctgcccaacacaaattcgtaaactttcaaaaaacattatgaggtttttttgcattttttttttcttagctcatcagctgtggttagtgttagtgtattttatgtgcagtccgagacagttctttctagtgtggcccagggaagccaaaagattgaacacctctgttttagacaatccggggctctgagagtgcattgccagcagacctccactatgagaattgttaaaggcacttcttcaggcagaagtatgaaagtttagatgtacccagaggacttgagagatctagaaatgataaatatgtgggtaaatagaaatggcattttctctgtcatctcttaatttctttaaaagataatggagtatttaaagtaatatggaatttataacatggaagtaaaatgtatgctatcagtagcacaaagggtgggagcaaagaattgggaatatactcttgtgaggtgtatacattatatgtgaaatggtgtaatattacttgaagataaactatgataagttaaaaaatggatagaatgaactctagagcaatcacctggaaaaaaaacacacacaaaaaaggggtgtaactaataaaccaatagtggagataaagtagaataagaaaaaatattccacaagaagatgggagaaaaggaaaaggaacaaagaacagatgggacaaagatgaactcttgcaagttgaagatacctgtttcagaaaaatttaaaaacatttctcgtcttccagaattaacatctatttatactaaaacaatatcaaatcccattaaaatggactaagttatattactagttaaatatcattatccataaacacagtttgctttattaattattctcaaataatggctgtctccttgtcaattacaactcttttttttttgagatggagtctcactctgtcacctaggctggagtgcagtggcgtgatctcagctcactgcaacctctgcttcccaggttcaagcaattctcctgcctcagcctcccgagtagctgggactacaggtgtgcaccaccacgcctagctaattttttgtatttttagtagagacggggtttcaccttgttgaccaggctggtcttgaactcctgacctcaggtgatccacctaccttgacctcccaaagtgctgggattacaggtgtgagccacctcgcctgacccaattgcaactcttttatagctgttaactatgatacacttagactgtgctcacagagagaatgcatgtgacactgtgtatgtaatggaaccttgaatgcatgcacacacagacttcagacagtatagtaaaaacggaagaattcagtgaacaccagtcagatgaggcatgagattatcacaggtggaaactagcaaaatacagttataacatatgccaactatccagcttctgagacaaccacatgagggctctctatcctagcactgaattgcttgggagggaggagaaatccaaatggatattcaaaatgtgaggaaatacctcctaagctgaaatacaggtattacatgaagctctttataaagatgaattcttataacctgaaactgaatgggcatatctcaggacacaaatacatggcagccagtgattttgagggggataatattttatattgccatatgaaacagaaacattaaacttcttttaaactgatcttcatcaacacaaatgtccaaatttattttgaaaatagtgtgggtattggattgtaaaattacttctgtaagatggcatgctggttcatttgtacatttgttgggacagtaatgagaacccttgtgtttttaccagcaggcctatttctgacaaagttgttattattctaaaactgaattttcaaaaagttgtttttggttttaccttgattcaaaaccaaaggaatttgtcattaagtcacttgtggagttttataaaactagtcaaaatttggtgtatgtcctcagagtactttttggtgccattgttagactaatgcttaatttggtgtttcttatgaaataatttaaatttgacatcacttattatatctggagagttgatcaagttataaaaagaaaaaacaacttagcaatctacaaaattcctttaaattaaggcacagggtgcctgtttgaactaatacaaaatgtgttttgtttcttcgtagggaattcacaattgaaactgaagggaaaacatttcagttaacaaaagacatgatcaatgtgaagagattccagaaaacactatatggtaaatttgtaaaaataataaacaaaaagtcactgctccttaaagcttttgttgttgtttgagacagggtcttgctctgtcacccaggctggagtgcagtggcacaacctctgcctccccggctcaagcgttcctccctcctgtctcagcctccgaattagctgggactacaggtgcaggctaccatatccaactaatttttgtattttttgtagagatgaggtttttgccatgttgcccaggctgatcttgaactcctaggctcaagcagtccacctgccttcgcgtcccaaagtgctgagattacaggcatgagtgaccacgcctggccctcattccctgtcttctttggcaaaataacttgttaaaaagtcatttaggggccgggcgtggtggcttacgcctgtaatcccagcactttgggaggccaaggcgggtagatcacgaggtcaggagttcaagatcaacctggccaacatggtgaaaccccgtctctactaaaaatacaaaaattagctaggcatggagacacgcacgtgtaatcccagctactcgggaggctgaggcaggagaatcccttgaacccgggaggtggaggttggagtgagccgagatcacgccattgcactccagcctgggcgacagtgcaagactccgtctcaaaaaaaaaaaaaaaagtaatttagaccagtgatgttgcatgcttttttaaaagttaagaagatgtttttttgtagaacaaattctgtgaattaggcaatgagtaatttggagcacgtatgaaggatgctgaagtttatttgtggctgaattgaaattcctggaaacggagtagtaatgggtgtttgagaagctactgccagtggaaagagtgagcatacctttccttttgttcttggcttgtcttgtagccaggcttcagtgagcagtgttaggagtaagcgggggcttctccatcacactctggggcttttccgtcacagtctggggctttatagccatgatcctggcagctggttcagagctgcacatcaccattactcagataccacagaaggatgggaggaaaatgccttgatcatgtttctaaagtattaactctttatcatagacaaacaggctctcttttcccatatgtgtgtgagttttggtaccaatgatctcatttcccaaaaaacataaactcttccaaagttatgaccagttatcttagacctggacattgcttagcagtgcttcttcctttccacataataagtaataattatcagtatatttcctgtgtataccacgggtgttgtcttacccacatgaagagctgtgagcccctgtaagatgtctttgatggagtgctgttctttgagcaaactctcccctaagggcgtcctgaccccagaaccttggtgatacaatgccagtaatttggttctgaacaagttcttatcaagataacaagctaaaaagttaaacaaatacaaaccatgtaatactttttgcgtgtaggaattgtttttgtgaattttgccagctgtgttagattttaaattctagcaaaatcttattaaaagccttagattttttatgctttctgggtagccgaggcaggtaatagagataaagtgtagctgctgctattcgtagtttgctgactggtgaaggaatattctagtacctcaggtttcatttttacacagtataaacagaatttggtgaaaggttttttcactccagctttctcttcaaaggcatgtttcctatcagcaaatagtttttaggtatgttctagtttctttgttctgatatacagagataaaaatccatctagaatagagatatttttagtgctaagaatttttttcttttcttttctttttttttttttgagatgaagtctcgcccttgccttccaggctggagtgcaatggcacgatcttggttcactgcaacctccgcctcctgggttcaagcaattctcctgcctcagcctccggagtagctgggattacacgcacctgccaccatacccagttaatttttgtatttttagtagagacggggtttcaccatgttggtcaggctggtctcgaactcctgacctcagatgatccacctacctcagcctcccaaaatgctgggattacaggtgtgagccaccgcagctggtgaattgtttagagagaatctgaaatgcattatgtggtatttgagagaatgttattgaatttctatctctttttcagtggaagaagttgttccgaatgtaattgaaccttccttcggcctgggtaggatcatgtatacggtatttgaacatacattccatgtacgagaaggagatgaacagagaacagtaagttgttgtgtacagtgtgctgttatagtgtcagaaaataaaaattttctgaattacattgtgaagtacattaataagactctagaatggtcaattagttattactataatctagtgctattaacactcatctttgcttaagtatgtatagacaaaccagtttcctgtgttatcttatttgagctttaggttattctagaagctattgttttagttgcctggtgctctctattcttagactgaacctattactttggggaacaatctatattatgtcaatggaaggaatggtactttctggatatgctgtgtttcagaaaattgggaaggatgagataactcctagaatttagccagaccactaagctgtatctgtactctggtaaagtatcaaagggaaccctctcaaactgcatgaaattgtctggggtacttttggggtaaagatgtgaattcctaggttctactctggagatgctgattcactaggtctgagacccagggatctggggtttttttaaaaaaaataagaatcctgagtgatttcactgtgaaagcttgacagatcataaatgggataatagttgtctgggatatagcctttcctagcattcaagtattgctgaagatagaagtttataagaagtcttcatcagctcccacaaattttcttttcggtctgatgcttctgaatcactgctccttgccttcttcctctttatctccttgccttacttcaccatttttacctcacctctgcctgcagaagttacactcctgggcagattactaggaaagccaaccagaagaatggctagaaaggagaggttgtatatgtcaggttaattgaaagaaacagcgtcatccacttggccattctaaagcttgagtgtacgtaatgttagacatcaaccgtgtggttctttctaggacatttaacctcaaagaatgaactagtgagttctcggcaccagtactttagtctgacacactattgtaatacatagctaataaagttagtatggtactctctgccctaaagttgcatcttcatttcccaaccttgaaggagcagccctattcattcaacagattgtaagaacctgggctaggccccaggtgcgcaaacataaggcttggttctttttgagaaatgatgacaaacataactgcatgtgttctttttagatgtcaagtctgcttcaagctttgtctgcttatttttctaataaaaaggttttagaaaatcttttagctgttcctttgaatctaacaatattaatataactagagctttaatagaaatttcgtaagggctaaacaagaataaattagtcacagtgttttatgaattgcatgaattcccatcatgaagagaaatttgattaggctgtgggaagccaaaaatgtttctaaattattagcacctagttcctcaatccatttgcctataaatttggtataaaaacattgctagtgaaattttaaaaattatttttctataaaggcaggtccctgttactctcttatattaaatagaaatatcacaagatggaggaagggaatagaattctgaaccttctgtgatgtgagcagccatattggtggaatacaggccttacttagagtgggatattcattgcttggcaataaaggttaattgaactttgggtgagaggctaaactggaacctgtgtcattcattatttttatgggacaaatttattctgtgtttttgccttcaagtgaaccttttgtacaagtattaagaactgccttcagttcccatttccaacctaaagtggttgattggtttgccttccacagaatatttttattttcgcctttttttttttttttttttggtctcgctttgttgctcagctggagtgcagtggcacaatctcagctgactacagcctcaaacttctgggctcaagcaatcctcctgcttcagcctcccaagtagctgggaccacaggtgcgcctcacaatgcccagctaattttttagtttttgtagagatggggtcttgccatgttgccctggctggtcttgaattcctggggtcaagcaattcttctgcctcagcctcccaaagtgctgggattacaggcatgagccactgtgtccagccttatttttgctttctttgatttctgagttactcagaaactatttcagggcagtttaagaaggctgtactttttagtgtaggtatatggaacatctttttttgttttgtactatttcttttggacatatgtttgtgagctaattaaacttttctgtttcacttggtcactgaggttcataggtttttctcttaaaagacagaatgggctttggtttgggtcactgccacttgtttgaatatttaggtagtctccacagaaagtcttttatgtggaaccaaaaaattaccgtcttttatatacagtagctttcagaatgctttcacatcatttgacttttttagtaacgggcttgtgaagcaagcagagcaggtggtagagacctgctttttaggtggagaaactaaggttcagaaagagttcatgacttggcctaaattcggagctgaaaccaggtgtttctgatgctggttctgcttctcttttgccatactgcttttcatgtcatgttttctggcattttggtaatgacgttatgcttgaacacttgctgaatattaacctcttttggtttgggatattagcatttagatatttacaaattaacatatttggatttttttctttttaaatcatccagttcttcagtttccctgctgtagttgctccattcaaatgttccgtcctcccactgagccaaaaccaggagttcatgccatttgtcaaggaattatgtaagcaaattcaattgggtaaactccatgggaacaccatcaaggagactgaattttaggaaatgtatcatttatttcaataaaaatatagactgaataaagaatataaatgattttataaagagtacatgattttagcctgtactcttatttctaagcgagaggatatgcttgctcagatgttttattctggcatttgagtgaggcaaggtaggacccaagagtcagatttaaaaattatttacttctcatactgaccttggtgccaagttcatcgagggaacctgagtggagtgtagcaaccataatggatctacagccacagaatccacagccctgaaaggaatcctggtggtcatctggcacatccacttatttcagagctgggaaatggggagagtccattgacctgcttagagccataaaaatagaggtggtggagtcaggactcaccttctggccttggctcttggtcccatatttgttccccctatagctgtatcagatggaggtatgagtgaagatttggattcccgcaagggatttattaaactttagggatatttctttctcttgcaactcaacttgttgctttcttgtcttggtcccatttataagtctcctgagcttgtaagacagtagttagataacactgggcttaactccattgttttatttttaatttactttgtttattttggatagcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagaggtatctggccttctctttggcatttttagccttagaaatgtgtactgcttcttactgatttgtgttggattttgatgtgtttatgctccctttcctttttttttctttttaattttaatgaacggcttgtatcagacagagcccagattctcaagtcccccggtttaattatgaaaatatccattagcacttctctaatattttataaacatttgtgttgctccaggcttattctccagcagtttgcttttatacttgtttgtttattgggcaagagaaatatgatcctaagaatttgttgccatagttttattggtaggctttggagggttagacattttaatgttttatttttacagacgcgtatacatgtgtatgtataagcttttccgtgttcatatattcaaaacagtgaatcatgtttcagtagttttggtcaataggaaggcagtaatggagatggtagaagcacagaaggagaaggatgagtggtaagggaaaggaaagagtagctgctttaattgacatctgcctgcctaatttatcacctttgagcacatacatcaagtgcctgttctgtgcttagcttgatacagaagtaatagggaaaacagaagcaaaagactgcttttttttctgaaggagtttatagtctaatccagaagtcgtgaatttctagcttgactttttagagaccatctggctactctggagctgtgtccccatctgggtgtggttctcaaaagtgtggtccctagaccagcagcatcagtatcccctggaaatgtatgagataagcaaaacctccaccccagacctactgcatcataaactgggggtggagaggcagagggggcaggcagaactttcttagttttagcaagacctccagatgattctgacgtgcactcaagtttgagaaccattgctgtgtggcagccagtgtttggttttggctgaggaacagtagccttggtcagagctctccagtttgccagtcttatgtaattccctcacacgagttacttgactgagtcctgtttgttctaatagttaaatttaatacacatgaagtaacttcaagggacatggagatttagaaaagttaggaaaggctttgtggcagaattgagttgtctgggggaactggtgggcgttttgggctagaagagcatgaacccatgcctggcatgacattgtttggctctgtgtaaggtttcctgagttcaggatgaatcttcttcttaaaaatctgaacaagttggttgatacttggcttctctttccttgtctctagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaaactactcttatgtccactttacaaaagaaaacagcattgtgattactcccagggaccgtattttatcttcagtggctgcctgattttacccccacaattaaagttgaaggaatcctgaacaaacttgtgatctatttgcttgtgtttttacattttcagcaaggctgtttctcccacgtttgggtagacatgctcatggcttaatgttaaacacagttaacactttttaaaaaattaacagctttattggggtgtaatttacataccataaaaatagcctgtcttaagtgtacagttcaatgatgtttagtatatttacagagttgtgcaaccaccaccacaaaccaattttagaacattttcatcactccaaaataagtctcatgctcatttacctcactcccattctaacctcagcccaggcaaccactcctctactttctgtctattgatttaccttttctattctttatcttattctgagaaaatgacgcagtgtgcaggtactgtgacagcagtctccaagcaggtgaaatgacttctggaaaagcctgaggtgaggatggggtggcaggagtggtgctttagggctgctaaccccactgtttgcagattctccaggaggggagggccttgccatatttgccttctatcttaaggcatgcttgcactcagctccactggtagcctggaaatcattaagctcttgatgctaggggaacccatctctctcgtctgatttagcaattcctgaccatcgcagtgtcttgattctagcctagcagtttttggctcaggttttaaggtactttacttcttttatgtttttgtatagaaaactcagaacgctgtgcttatttgtaagggaaaaattccaggttgtgtgaatttgagcagctgtttatttgcagagctatgaccttatctagtgtgcccacttcctcccctgcagtattggatagaggagtggtgatctccagtgtgcccttttgtttctagtatgaagaacaattgaagttgtgatttcttagatgtaaagtaggaatctcccagggatttccctcatttgtatctcatctccagtggtgcctaccgcagtgctgtacatagtaggtcttccataaatagtctttggatgagtctcgaatttttgaacagacttcttttttgaacaaacctctttgggaggaaagccttatactgaagcatatttctcttccgtctctgcttttatgagcattcattattaaattagaaggagccagattttaaataaactgagttttcattttctagggatttctctcacttcgaattccatataatatagcttttaactgggcatatgttctagcagctttacattggcagggggctgccctaactgcatttatttgctgcttttacagcaggtacctccatagtcaaacagtcaccacagcctcagacattggtttaagctcattaatagggaaagatacattaaatacatagtgagagttacctatcatcaggttggtgccaaagtagttgcggtttttgccattaaaagtaatgacaggctgggcgcggtggctcatgcctgtaatcccagcactttgggaggccaaggcgggcggatcatttgaggtcaggagttcgagaccagcctggccaacacagtgaaaccccgtctactaaaaatacaaaaatcggccgggtgtggtggcacgttcctgtactcccagctacatgggaggctgaggcaggagaatcacttgaacccgggaggcggaggtttcagttagctgagattgtgccactgcactccagtctgggcacagagcgagactccatctcaaaaaaataaataaataaagtaatgacaaaaaccataattacttttgcaccagcctaatactttggatcagaaagggattggaaccaagcctcacttcccttttcattggcaaatacatttgtcatgaggtagaggctggatattgaatctgcaagccctcttttgttccttcccctgggtagcaatgcgtgatttctcctggatcacctgctctaaagcaggtctctaaagtgatacctgagtgagggagacgggccggcagcagagctctctggttc

SEQ ID NO: 16342 - DNA, 17644 bp, Human
ctgaaactgaccagagagctcctcatgtgggtcagtgtccctgccagggcatggggccaggggccaggggccaggggcatgagggagcctcccagagactggaatgctgagccagggctcctcagaggaaaggatgtagaggagggcccaggaagtagcccagtggggccagtttcctctcctggacagctaagaaagtacttatgaccttcggccacctgggctgtctgagcaggcagggcctgctggccaccaccgtcctgtacaggcacttaggggaatgaatcttccccacctgcagccccagcaaacacacaccaggctggtccctggcaattcaccccaagagccaggccacagctgggcagaggggtggccagtaacagctggtgtcattctctgcaggatagcccctggacaagaggcataagacccactcatccttgccctgccccaggcacacttagaaaagtcctctcaccgggcctcagtttcccacctataaatgggaagatgccaacacgcccgagtgggactgtggtggggcaggcaggaggtgggaggagagcccagatcatcccaggccttccctaggggacgcagggggaccctcccttctgggcctggttcttccagcacgttccatgcagcaggcaagagggccaggcccaggggttcctgacagcttgctggccctggagtccagattcttgtttgttggctggcgctaggcctctggattggagatgcccggggcacaggcggcccacggggatctgcagcagggcctcggcccctccctctgcaggggctcgtctggtccctcccgctctctgcctctcctcatttatctctccctttctgcttcttggctctgggtccagtcctatctcccctgtttcagtttgtcttttcctagccctttgcgctctctctgtctctctcagccctgcttgtctcactgtctctggctgggggatctgtctctttcacttccacttttgctctatttccctgctactgtctttcctttctccttgtctgtctcttctcctcccctcagccagcatctgtctgtctctgcctttctctcctgctccctccctccctcctctccagcaccttccaatgccaggtggggctgccattccttccaccttcccagtgacccgccagtgtgactgccttgagaggaaagtcctaaactgtccctatcttcaccagcctgccctcaaatcattggttcaaatcgctgtcgagaagtttgggagctcccagggcgggggctttctaacagctctgcctagctcgggcctgccctcaaccgcagcatgcagggcagccacagacaacctctctgcaacttctgatgcctccgtgcccccatccacagagccctggctctgggggactggggactctgggacatccctaacatggcatgcagtggcggtgcgggaggacttgactgcccctctggagccctgggcccggggactccaggccagtgcctctctgggtcgggatggggatgtcaggccagcaggatcatggtacctgcctccagggagggcaacgtccacccactgagtccagcccgcccaccccacccactccggagcacctggctctgccctcaggaactccctgagctttgcacacagggccgagacacctggatttctctggttccctgagtggggccagcttggaagaatttcccaaagcctattagagcaacggctgcctcctgcctgcctccttgggctgggcagggctgagggcggagggagagagagagagagggagggggagaggaggaaggaaaaagttggcaggccgacagcacagccgtgtctgcatccatccagaggaggtctgtgtggtgtggggcgggccaggagcgaagagaggccttcctccctttgtgctccccccgccccccggccctataaataggcccagcccaggctgtggctcagctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacgtgagtggggtgtccctgggcttgggggggttctagaatgatgctgaaaggcactggttccatcctctgcccattgtgcagatggggacactgaggaacggagaggacaagaggttgctggaggtcacgtagagagctggggggaagagctggggctggaactcagctatgcatgcctcccaaagcctgttttctgccaggcactgtgggaagctgagatccagagaataatggtcttgccaatgtcccctgcagggcatctattatggggaataagcttggccagcagttcctcgccccttggctgtagctttttggcccttctcagtcctgcctgtgccgccagctccctcctcctgcagccctgcaccctggggaaactttgcccgctgtccccagccaccctgaaccaaatgcccagcctgtctgcagctggctctgcaagtgtgtgagcaggactccctcagggagccccccatattcacactagtttccaaataaaccacctctaggaatcaagagaaaggccctcttccactcttttgcccctgagattagacaaagataagggagtgaaaacactctctggggctgtttgaaggcagttttcctggattacagtatgggctggggggcaagcgctgggctccatggtctctaggcactgagaggtgtggcgtgtgtgtgcatgtgcgtgtgcgtgtgtgtgtgtgaaggtgtgtatgtgtgcatgtgtttgccagcatgagtctctgtgcttgtgtcaactgtgtgcatgtttgtgctgctgtgtaagggtgtgtgggggtgagtttgcaacacgtgcccatggctcctggcttgaatggggtctggactggggtcactaatgacaagcagatgctggtgactgggtggcagctgtggaaaagaatgtctcctgggctgcttagcatggcaaattggccctggtggcagctgcctgctgtcccagacacggcctttcccagctcctcagacaagtgcaaactcaggccgggcttgggccacagcaggggaggatttggcctgagagactggggaaggcttggaggatgtctctgagggcccaagggacaggtgagcaggcctgggggtgcccttacagggagggagagaagccaaggagcagagaggaggactcgtctagagagatgaggctggcggggctgtgggcagggcatgtgggtgtggggacggtgtgggccatctctgagggcgcctcagagatggcagatagtgattacagcagctgtcctctcgcttcccagccaaagttcagatcctgcggctggcagcccaggagaggctaggtgaaggtctggtgcagagggcagctggctcagcctggccatggggggcttagcacttctgtgtcacggtgacacctcacccaacctcctctgcagccaacctctgctaggcccaagattgaagattagctccgtgggctggagtttagactttagccagtttagacgtggccgcgggggatgtacgggacagagctcaggcaggccacatcaagctctgcccccccaggcctcagttgccagtgggtgcagagcttgtggcctcagggagttctgctgggtagggtcaagctcacactgaagcttggctgggtatgatgggctgggggagcgtccctgtaggggagtggatgtgatttccaggctttctggccccgtctcttccctcccatctcacagggcggagcctctgcacctgctggcgaaggcttcaccctctagtatgcgcatccgaggcagaggcgggagggtgggccccttctgtgccatctggaacagaggccacaccagcctcccgtgccccattccctccctggccttcattttttatagtcaccccaatacttgggctgggcgtgttgcaaatgggagagaaagaggagcagcctagtgtggggtccggccctgggctgagaggcagacacctgggttcaagacgtgtccactgctaacttgttgagcttctttggagctgcggaccctgaccctcgagagggaactcaggtcttgtgacctcacagccacacccagacagccagctcacttcattgctttgagcttatcacccatcccacgaaagctggctaagagcagcccagcaggggcagtgctgaacataagggcgcttagcatgatggtgggggctcaggcgctgtcctgtcccaacagtggaagggtggggttcaggacctcaactctgggcctagaaatagagaaggtacccctctaagggctcccgtcagacactggccctggaactggaggggcctcaggggtggcctggatgcctcaagaggagcagggaacagtctgggcagcaggtgacacactctctttcatgacctggggtaggctcctgcagcctctctggccctgagccccagcccagtcaaaacctgggtggggcaagtggttggcatggagatttccaaggaaaacagagaaagatgtggcaggaagtggttggggtgagtcagggggtgtcccttcgggacatgctggggacaactttctcctgactgactcagggctcaggatatgccctagagagaccgtgggcctccgtccagcctgcaaggtcccggctagttctaagagccaaataccaattttggctaagggtgagaggctctgaggctggggtggacactctcacctgtccctgtcctagctcagccactaacaccatgtggcatcacacaacagactggcctgtgtggccctagttcctgtctatgagatagggacatagcagggtgtggctgggctctgagaagtaggagatgctggtggactcaggattcctggcatttgctggcttttttcattcttctgctgtctggtctgctcagccggctccctgcaagcatgaccagggactgctgggtgctcaatgcagggctgggttagcccggctccctcccgagagaagcccacagccctaggtcaagataagccagtgcccagctgcctgtgatatgaagcaggaggcagatgcgataagaggtgtcagggcgggcccgggaacttttgaacttaaggggtgggagggccaggaaggcatcagggaggaggtttcgtaggagcctgaatgtggagacactgcagagggaaggggcagagggactgtgtgagcaagcacaggctaggaggaggtgagggccgtggtacgggagttgttgggtatggtcaggctgggggtgcatgggaggagggtggtgagggctcaggattcgggccaggggctgcatccgggggaaggggtctggattcccagagcctgtgatttcagcccgctgggctcaggcagagggcaaagctaccctcttcggggtcttctcccagccctgctaattccaggcctgactgctcaagaagtgtttctacctgcagcatcaggggcctgactgaagccctaagttctcccctttatcccgtttttctgggcttcagtttccccagtcatagagtgagaggcctcttcatgccaccagttctcccgggggtgctgctgcctcctccagagctcaggggagggatggggaaaggaaggcagagtttccatgtccctgcccagcccgtcctgcccagggaggggctgggggctgggtggtgatgccacatctgggacatataattactgtttccgccagccccagatgagggggagggcacagagatggggagctttgtggtggagacttccctcaccatggaaaatcctgacgctgcttcccctttagggacctcagaacagcccagccggtcccagtgttgcccaccctgatgcttggccctgactgggatttgccctgggaactctgaaggggccatgctttgagaggggacacggcctcctgggatacctgtctgaggggctcaccccctgctcaccactcccaggccacagcctcctgtcacaccttgccttcccttctccaccccaggcaaccttctagcagcatgaagtggccattagctcactgcaagccaattccagatggtacccccacttagtctagggcccccacccagcaggggccatggcccttaccttctggaagcaccaatgagtctggagtctcctgagtggctgggatctgagccctcacaccgggaggtgaaggcaggaaaatgctgtccgcgaggccctgcaagtggccaggatcccctcagtcagggcttccccatggggatgagaggggctccttgcccacatggagtggtgcccagggggatcatgaggggctgtcttcactcagccaggagctacagttctgtggggtgggcagactctgaggctgaaatctccaacttaaaagatatccggaaaggccggaaaatgcccccggcccttccagcagctcctttcagtgcctgcaatctcgctgtcagggccccttgaaaggcagatttctactcagtgtaaagaaggttgttgttgatattgttgttgacacgaagaaggggctgtctctaagtcaataagctccctgccattaggggtgtgcaagtagatgctttctggtgaggaggctgctttgggggtgctagtctatgcgggggtccagtggggtgggtgacaggttctgcagcataggctttgtgtcatgctgagatcagcaattctgatggcctgcgggggatcctgtgcttaggtttctggatctggggctggagagtgaccaccccgatgtgaggcaggaggcacttttggagactgcgggggctcgaatctgggccaaggcctccattttactgatggggaaactgaagcccacagaggcgtggagacttgtcaaggtggcactgcctcctagcccttgattattcctgctgctccaaagtgtacacacatggcacaaacacaaacatgcacacacatgtgctcttacgtggaggacacacacacatggtacacaaagcacattctcaagactgggtggtcccactcagactctgggacccaaggagggttgggcggggattcctcaatggagccttttcctctccctgccctggagttaggaaaagaaggagggagggagggaggaagccattgctttgtgtattgtttcttgtcaggaagatgaaatggcttctgggagcaaataaaggccttgttgagacctgctgctttctcacatggggggctcatttttttctcttctcttccctctctagctggtagtggcagctatgtgggtgtgtgacacagggagacagtgaggcacccagaagtgccatcagacataccagtgcaaacacacagcacagcctccaggacctcatgtcctgcagggatgcctgtatgatatagctgttcccagggaggccgaggcacttggtcagtacctcatcagttgatgaaaaagagtgtgcattctctaattcaggggtacagggttttcatatttttctgaagtcaagcttgttaattatggggttcaaaccctccctgatcatgttattggtagttttcggctgcttcatttattctgtacatttctaatagaagattgttaacatttttcactctggtggtagggtgatccagtcctccttgtaattttgtcaattttcccctcatttatttttaggctatgttgtttggtgcatacaagtgggggatttttgcagttcctttatagatttttatttttttttttgagacggagtctcactctgtcgcccaggctggagtgcagtggcaccatctcggctcactgcaagttctgcctcccgggtttatgccattctcccacctcagcctcccgagtagctgggaccacaggccaccacacccggctaattttgtttttgtatttttagtagagacggggtttaaccgtgttagccaggatggtctcgatctcctgaccttgtgatccacccgccttggcttctcagagtgctgggattacaggcgtgagccaccgcgcctggccagttcttttatagatttttaaaatgtaattattgtgtaataaaccacttacaatctaacaaaaaagagaaagagggagtcagccctggacacatgtggtcatcacagacacagcagacacttatctacaaagacacacagaggcacacaaaaccaggaatccccccatgtccacgtgtgaacacccatggaggagtgacactctggagcccacataggtcccctcactgcccagtgctgagtcttggaggcactggggtgggcagggcaggcctcgatgtctcctatcccttgagaacgaaagctcagagcctcagtcaggcctggctctggagcctgctcttccccaaggccagggcaccagggtgcccaggccaagtcaggggccccatgccttggaagccaccctggttggcctgtctatgggtagcagggagtgcttagagcacattgcctggagagatcatccctgggctgccctagagccaggacacactggcagccacagaaccaccttctgccagctcccaagtccaagctgggaatagccaggtcccttgactgggcctaggagtggccagcccattgacctgtgagtgtagggtggcacagactatggggcaaggatcctggctttgctgcatcctccctgggcctcagcctctgcgtcatcatctcactgagccatcgcacaggctgccctctagggctcccagaggctaatgattggcccattgtttcccagctagaaagtgaagaagaccgccctgggtccggagagcatctctggagccaggctgcccctagcaagggtgggagttctagaaaattagcattctctgccacttctatcagcacacagtaagcctcccctcagaggcgtgggcagagaaatggcagaggtcccccactctgtcttcaccgagctcccaggccaggaggagatgcacccacataggccgcaggaagattgatttcctacaagatgcacagagaattcagtgagggcatggtgggtgggagcagaagttaattccagccagggatctgggaaggcttctaggagctggtggggtctgaactgggccttgagtagtgggcttacaagggcttagcacaaaatggagagcttgtatctttctgacacttcagaagaaatgtgtggattattctttcggtaatacttgcattcacaaaacccagggctgcagacaaaagcgggaagacaattgagaattgagaattgagaattgttctgattcttacttttttttttttttttttgccttaataagacctgggccaggcaaaactacctggggatgtgcaaatatatatgtacatatatataaaacaagtgactacaatgggaactgtccttgtttaagcaagttttcaaatttaatgggttgtaaacagtaacgtacatttgaagtattttacctgctctttcctggacattgagtttcaacaggcctttgagtgccccttccaattctgaattatcaagtgtttccagatgtaaataatgcaagtgtattagatagttgaaggaaggttgtcagtagatgttgaagctatcaggggaggcttcctggtggtagtggtagtgggtattggagaggaaggctgtcagcccatgtggttctcagcagtcacgaaggcacattccagaattcccagggcaggtggctgacccctccccttcccaaggactcagagtacagggcctggaactatcaccctctgctctgcccactttgcatgaaaagcatgttgtctttgggtaggggctggggctctcgcacctggttaagaaccagaggagatgagctctttctggtcacatctgtgagggatggggctgggagggttctccaaggcgggagccacttacagcgatgactccattaatcatcggggaagggctggtttcaggacttctgccagctagcaattaggccaaccctggagagcagaagagagaggaatagaaggagccacgagcttcctgagggctcagatacagagggacaggggcctcacaggtgcaagtgtgggtgggcatcaggactagccgggctggcctcaccagcctcaaccccattcagcctgtcctaactctgggcaggcttctgccagcagctccacccgccgtcactccttctgcctgtccccagatcctgcacacacaatgagaagaaccaaaacaagagtcactaccactgccccatccctcctgcgtcgacaactctttccaaaagccctgagacggcccctttggcctttgaacctcccagctgctctggagagcaggcacggacaatgagatccattttgcagatgggaagactgaagaccagagggaataggccatgctcatggtgccagaaagtagaagagtcagaacctgaacacagggcttctgcctctttggcccaaccttgggacagaaagggaactgggcattggccagagggctggcggacctaagggatgtagccctggggtccgccaggaaaggcccaaagctggggctgcaaggcaggggaggggatgtgagtcattccctgtaacccagggctgcagacaaaggcgggaagagaattgttcttgtaggatggcctcagggtggggctgggaaaacctccaaggtgtgcccccctaccttggattttgcaaaattctctatggccttggagacactcccatatcctgaggatgggagctgggtagtttgtctcccagctgggaagtgtttgggtgcaccagccctgcctgggagaaggcagcctaagtggcctcaagtgggcatctttgcaagtgagcctttgctgatgtggtccatctcccctgtgtgagtgcacttagcccctgggacggccacaaagcatagtggaaggtgctggggcttcctggggaggggtcctccgggggcagctgcatggggagggccttcatgacctcacagcagcttccattcccttctctttccatgagtcatgtttctaaaagtggcccaggagtaagtggcagccagacggtggtggcggggcctatctggccaggcagagggagggtgaggctgaggccagcagtggggaggaagaagagagaaggagagacagggagggcagggccagaagcaatgggagacaggccttggaccaaggaaagagacggggtggagaaggagagagagagggtggagacaatagggaggcaggcacagaggagaaagaggggtggagggagccaggacctcaccgaaggcctcctcagccctggaatttagatgcagtcgggcatggggtggaatgttctggacttttgggtatgaagccgtgtcccctgctgggccttcccacctttttgcatctcttctcctaggagtgctcctgaccatcaccttcatgcctggggctcgccccttgcctctggtcttggtaccccagaataccctggcctggatgcagctggatgcaaaggccccagctcaccccaggcctctccagcttctaggcagagtggggcctgggtctaggcaggtattaggggctgggctggagtttcattaacacagggggtgggttcaaggcctgatttccactacctgccgtgtaggcttgcctgggaccctgtgatgggctctgaaggcccatctgagggtccgcccttcatgcctgggcctgggaggcctgggtatccttggggtcctgggacacagtccctgcctaccctcctcaccagtcctcaccacctctctcccctgcagctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctgtgagtcaggggccctcccagatggaggtgggggaagggagggcgggggctggtggggtgccctgccatgggcagccagtgggactcccgacagggctcttgccattgggtggaggatggcgggtcagcgctgggggctgggggcagggtcctgccctggagaggagcacagggacctcctgcccagcttggggtcagcactcctctttccctgggtctcattgtcccccaccctgattgttctctttctccctccaacctctccctcctctcactctctcttcacctatgactctctgccttcgcccctccctctgtttctttccctcacagattgactacactggctgtgggattaaccctgctcggtcctttggctccgcggtgatcacacacaacttcagcaaccactgggtaggagacccacggggggtggggtgggaagctttggtgtcccatggtaagcctgaccccaccctcacagtgtcccttcctgttctggaggctctgggagacagccagaggacaggaaatcaggaaactgaggcctgccatgtagaggcaggctgggggtcacactgccagcactttcaggcctagtctctgccctcccagctcggccctgccccatgctgcctggcctccaggtcttcccagctgcgtggttaaaagtggggctccaaatcctggctcagccactttcgggtttagcatgaccttgcgcagtgtgcttgagctttggtttcctgagctgcggagggggatatggtggtgcccacctctcagggtggccgagaagaggaaagggctcactccccatctgtaaactgagctcaacacagaggaggcgctcagtggattttagctcttatggttgtggatgtggatgtgctaggccagctttgcattagacaatggtctctggggcccttccaaagctgggagtgtgggggcagtggccttcctcaagaaggggctgctactgcccatgcctgagctgggccccacagaggcaaggagttgaccctaccacgtactctggcctgggccggttctgaggggcaccggaatcatgatgttaggatttggctctcctacctgcctccatcccaggtgggaaaaacctgtccaacggggtggtgggctgtggggtaacctagggaacgcttcccaggggcttttgagtggagccctctgaacacacctgctctgttcctagattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtccttcaggcttcctgtagtttttcttcttttgatgctgtgtccccacaaatgtttctggattactccacaaggaaatcaggccactgctagagacccagtctgaggaggagccactgcctccccttctgccttcaagacccctgatctcaggcaatggatacagccacaccacagaaccccatctgagggacacagggtcctgcccctagtaggagacttccagagcccagtgggatgactttggagacctgggggcagggaaaaggggcaggcttctgatcagtttaaatggaccgatgggagccatttctgattccggagtatggaagggatgggggaaagcagggctgaagtctaacagccccctcatcccctctaccctccacagagcagggcccagggaacactagggattgctccaccttcctccctccctccactcacatttgcaacccatctgacctgggctgggcgtctcatgggagacagactcactcatcagagcccagtgcagttagggctacttcaggctgagactgggaccctggctcctgaccctcccgacgtgcacacacacttagtagtgcctgataatagggaacaggtatcaccacggcagtgggctgaggcaggaaatagtgtatggacaggtcctggggccccagcactgctcctgggagacacatggttcctgtcccctctgtggaatgcctggctgatggtgatataaggggggctgggtctcagggagccaggggctaggcatccgcaatgaagactgaggccatgttgatggaacagggtttctaatttaagtgtgccctgggtcactaggctgtctaagtccctgcaaatcagtgcatcacatctgcacactcttttccgttcccttgcaagaacttctagcccatttaatagataaggaagcttatctcccagcttaagaggggcatataaatggcagagtgccagccaagctatgggaattgggtatgggccagcccgctgcatcccaggcctgcctgtgagggtgtgccgaggctatctctcacagcccttctcagcttgtctccttaatttgtcccattcttcttggcctgaagccctcccaatcaccactatgggcccagccacgccacctcaactcctactcattcacttctacccccacccccatttcacccccgctccatggcacagccttctttagtgtattgcttagatatgacttttagaatcctagagccacgaggcagggcctgaataagccattagggaactggtatttcttgagcacttaccatgtgtgaagaatctctctgagattttgcatacattcgctctaatctttacaacatccttagaaggtagagatacgtgtccccatttgtagaagacgccagggcccctgaagatgaaatgatttgccgtaggccacacagcaggttggtggcagaattgggatttgaacctattctgcttggcttcaaagatcaggctctttgcacgatgtggtctgggccggttttgtcatgattcctgctaagttaagctctgggctagccaggaagccggactgcatgaagaaggcagccactcctgcagagtgggcatggggagggggaagggaggagaagggccagccacagagccatctggcatctggagaagcctgttcattccagggctaactggacgtggtgtcacccaaacctccctgctgccttccacggcctgactctccccctccttgggaggaaagtgtctgaggaccatgttcacccagcagaatacctgagaaggggaagggcaatgctgcaccatgagggataataatgcactaagacaggccctcagctacccatcaggccagggggcaacagctttgggctaaagggatcctagactcctcctcaccttccagcctgtgggtttagtgctccaggcaccccatctctttggggctacccctgactctgatcttctcatcttctatacag

SEQ ID NO: 16343 - DNA, 7697 bp, Human; identical to SEQ ID NO: 12628

SEQ ID NO: 16344 - DNA, 73519 bp, Human
  misc_feature (1)...(73519): n = A,T,C or G
gaaggaagctgtagtgttcagtttgggagatgaatttgagacactggcagaacattgagataaatgcatcccacaaatgtttgcaaatgaggaagggggttttaaggaagaggccagggtggtgacagatttgagagtcatccattattaactgattgcttaaatagttacaactgatgagaccagaaaagaagctgagaggaagaacaagacaggttgggtacaaatccttggggaacattatgcgctgcatgactaggtgacagaaggttccaccttacacacacacacacacgcacacacacatacattcatatctctatgcatttcctccaacatcccagccccacaagcacatgtcagtgctgcttatggctcctaactatctcctggatataatttcagtactaggaaagctcagttgcccaaagcaacccaaaattagtgttcttcaacctttgagcctctaacattgactcttattgaaatctatatgctttaagagtttggtgtggcaattcctcaaagatctagaaccagaaataccatttgacccagcaatcccattactgaatatatacccaaaggattataaatcattctactataaagatacatgcacatgtatgtttattgcagcactgtttacaatagcaaagacttggaaccaacacaaatgtccatcaatgatagactggataaagaaaatgtggcacatatacaccatggaatactatgcagccataaaaaagaatgagttcatgtcctttgcagggacatggatgaagctggaagccatcattctcagcaaagtaacacaggaacagaaaaccaaacactgcatgttctcactcataagtgggagttgaacaataagaacatgtggacacagggaggggaacatcacacaacagggcctgtcgggtagtggggggcaaggcgagggagagcattaggacaaatatctaatgcaagaggggcttaaaacctagatgacaagttgataggtgcagcaaaccaccatggcacatgtatacctatgtaacaaacctgcacattctgcacatgtatcccagaactaaaatgaaagaaagaaagaaagaaagaaagaaagaaagaaagaaagaaagaaagaaagaaagaaagaaagaaagaaagaaagaaagttgggcagagggagggtcatgttcttaatacatgagtaattcatactgtggtgtgaatggggccttaaagccactttgttgaatgggtgtggggtgggagaggggtgacagaaacagtgtaatgcatccctgtttgacttctaatcacctaactctcgatacagtgaaataagccactactgatttactctgggtcctatgtcagtcccttctgctaactgggcctcaatttcccaagtgagattttgtgaagtatatgtttcttgagacagtgatcccataagtacaagcatataagcttgtcaaagcttctgaggagacttgaggtaaaaatgcctgataaaatttgtgttccagaatgcatctgactttagcaactttttaaaaaactgtgactctgattctgaaaataaaccttgaggaaatggcaaattattttatctctaacatcctttctgtccgtgtggctccatggacctgtgagagtgcagttgcccaacacaaggttaggtctaccaaaagactaaccctccaatcttctctcccagggacacccagctgccaagtgtgattactcaaaatcccagagatgaagccttaaaaatgtccgtgacttctcagcatcaatcagacacttggctgcctgccaggatcccatgccggctgatatttgggctgggtaaacaatttaacctgggccttacctcattaaggacccatattacccatattactccagctaagaacactcttgtggttctacagaggttggacaaggctgggatctgatcacagcatgagaaagagccatcattaaccttttgctctcctctcttcctccttagccttgctgcttctaaggaggctgaagctgctcgctccgcacccaagcctatgtcaccctcggatttcctggataagctaatggggagaacctccggatatgatgccaggatcaggcccaattttaaaggtagagaaaatattccttccagacccacagggaaatgctttcccagattaaagcagcaagcagcatggtaatgcacgcagatggtaaatacgcagtgtgaatcccatgactctttcctctacccaaggcagacattcttaatcaattcagtcttctctcccaccaagcccagacaaagcctcagaggatgcaatttaacagcacctctggtttccaggagtccaaaagtgaattaaaaactatttgctacttcttgtatgatgggaagaaggataaacatggaacgtggagaaatgggttcaagtttgggctcaggcacaaacttactctctgagcttagatgatgagtctctccctttctttgggcctctgtttcttcatctgtatagtaatgggcttggcaactttggcagcttttaaacatacgcttcacggagctttcaggcttccagcaggtgcccccaaaggagaagcagagggcatgatgagcaagcccaccctgctcctccccaaacagctccacttttattttcaataatgggctcccaactaaaattcttcagctgaaagtttcccacgggctaacaaataattttgaaaaattttggtctaaatcagagtcataatttcaaatgcctaccagggttgggtagataacttaaatcagtgaggcaaaccaagagtaagacagtagggagtggtagagactatgaagaaatagaggtacaggctcctctacaggggcagcctcttcttagccccagcctgtagttgccctgcagaaatgtaggccccatgtttccagagcatcaagtattccaagaagagccagataccgagatctatgtgagacttcctaattcctaaaacatgtaaattcaaataaaacatgtttgtgacccacatatgccctgtgggttgccaatttacaaactctactccagatgacctgaaaaggttcttttacctctcataaccctatgggaacttagtgtctataaccaagagactagttccctttgtttactgacgcctcaggaggttgcagccatctcaaactgccgagcagagccctgcaggtgcagtcttaaggacctccttcggagcctatgcactctgaccttcctcccagcatccttgcaaaaatcttattccaaggacctgcagccagcctcctagacaagccttgatttcaggtgcccttcctcactgttcctttggctcaagttcaagactaaacaaggcatgtgacagctggtaacagcttcctaatatttgctcactttgccccctgctctcaagtccccttctcagagtgcttgctccgcacagctctgcaaatagaaaatgttctgagagatgcacccaggtctctgtttgggcccactctccccatttaccttgaggctccttcactccccctgcaccttgttcctgaggccatagcttccagcattgttaacataacccccaggataggtaagtcaataacaaggttgctgtcccagcacactcagctcaagccttcaccagggtcacaacctctaatacctagaggggcaagacaactatagtatatgaatgaagcagggtggagataagaaaataaaaccagagaacatagggcttatctaagggcagccacttctcagctcttgttgatggctgttaggcaggaatgcagaccctgttcagccaggccatccaagacaagacttaagtctgaggttttatctgaaatcttgcaaattgacaactaaatcacctcttttaaaaacactgttggccaaatcaaacacttccaggaactggttagggcccttggcaaccaggttgcatcctctgtccctctctgcttttaggaattccagtccaccacgccccttggtgggctctctcagaactccatcctgagtggaggggccatggtcttgctctgagaaacgaggaactcattcgtttgttgaatgtgggtgcatccagggtttatgtgttagttattctttgtgcataccactgtacttgacacatagaaaagccccagtaaaccttcataaatgaatgaataaataaatgaccccacaaatatgctagggcttagagcagttaagtgactttttcaagtcatgctgtcaaaaccagagactttaacccagttactctaacttaattctttgtctaataatagtgatttatttatttgttcatttatttatttacttactcagcagtgggcatttttaagaaataaaattttatcctgaccactgaatcaaggtccgtccaaccttcccactctgagaagcttactcggaacacttgggcccaatatctacagaactagttcatcttttaggcccgtcccaaccctgcaactagccttaactccctcgacccccacctgactgagaatgaggtgcagcttcctggagccccaccgcaggagctgagaagttttctctgccctcctttgtactgaggcctgaaaaattgctgagaggattttcttgccctgagccctttgatgcctttcctgcttccaccgacacaaatcagattccctaaaaccccatacaaaccatagagctcctgaaaaggccattgaggatcagggcccctatgactccaacatgatagaaagaggtctgcattgtttaaaacctctacggagggatccatcactcagcagctgccttaggtgctagaaattttccctgctcctgaccctcgtgaaaacacaggtagccaggaatggcaagcacagtctgcagagtacaatggcaaagaaactgtgaggtagaagtaaagggcactaaaacagcattccagtcctccctctacttacctgacaggcatgaccccaaatgagtcacttactgtatctcagcctctgtttctgcatctgtaaaatgatccagcaggactaggccattccagctctgttattctgtgtcttctttatgactttgtgtattataatggctcctaggattaggggcacagcccaatgcaaatacatacaaaaaagcaaaattaaactttaacatttagtgaaatatatacattatcctgctgccaaaggcagctaaattgtaattttctcaaagataatttaatttcagatttatttcaatgaaccgcaccttcccataggatccttttggccagtgtcctctcgcacacataaatcagaaactaatttatatgggagtcacagtgccagacacttgcagggactgggtgggaactctgtgcacatcatttcaaggcataggcagtaactccttggggtatcttaatggcatgaggcaacaacaaaaaaaacctggtctgagtctaaataaaggagaaaaatcctgaccattcaagttttttccacctgagctttatttaggtggaagtgacaaggaggcagacttccactcaacacaaggacaaaaaaatttagcagacagagctatccaactatggaaagggctgcttaagacaaaatgagtttcccactgctggaagtattcaggcactcagccttgaatgggtagctggtctacagcagtggtccccaaacctggctgtgcatgagactcacccaggtagctctctgaacactagactcttgggctaacctccagagatttggttttacttagtgtggggttgggccaaagaatctgtagtttaacaggttcccagatgattcttctgcagataaccctgtctgcacttcagtttgggaagaaattgatgaggtgacctttaagaaaccttccagccctaaaatcttacaaccctgaaatgtaaatggatagcttccataaaggaattccaaaccactgaagctgagaatgaccgcctagatcaagagctacttactctctctccagattgatgaggaaattgaggcccaggacagagaaaaggcatggccgaggtaaacaaccagtgagtgctggagttatgtccaaaacccagaaatcctgataatcccttgaaggaaaaacctagtttctcatcccaagactgagtcccctcctatatgccaagacttctgatcctagcttagtttgagcaaaatgcttgggctactttttcaagagggacagaatgcaatgggtgccagagggcataaggacatatctactttcttctttccacaatcagaaaactttggttcaagtcctggttctaccacttgttagttgaatgagcctaggtgagttactaaaactcttggtgctacctttgtcaagtaggaacaagaattctgccctgtctacctcagtacctcataggaatcaagaaagtggacctgaaaagcaaatcacaaattgcaaattacaatctttatgtgaagggctgtgaccatttatccaagtcctattcaccttcaaagtcatctccaggccaccacctttctgaggtctttcgtgccttattctccagaacttctctcacctggactcctgctgcttttaccactcttacccatggtcttgcatttctctttggttattttatgtcagccctttttgtcagcttatttggaaacccagtgctgaaaattctggactctgccactgtctgtgtgatcgtgagcatgccccttccttcctctaaacctgtttcctacagaatagccattaagatgagcacccttggagttagacaaatctgaactcaaactctgactcacccatttactagttatgtaggcatgaacaaatagcttctctgagcctctgttttctctcctgtaaaatgaaggtaataaccataccttctcctggagttgttgaaatgatgaaatgaaatgatgttaataatactctcagcacagcaggaacccccgtaatgtttagtaaatggcaactgctataattaatactataaagtgaagagattgggcttcaatgagacaacatctcctctaggaatgagacagcaaaccagtgaataatcctccatttctttcctacgctttgcagtaggattcaaaagacttgctcagaaagtatttaacaaagtctgtggacttcccctgaggttccttctggattcctcagctggtaattcccatcaatgcctttcagacaatcattcttggttcataagttgaaggcaaggagcttgctgttccttgtaattcccaagatggcctccaaatgttgtagacataaatatatttcagccactaatttgtggctgaaaggcagccaatgggacttggggaaggaatttcaaccatatggcggctgatgaatcatcctgtgttaatgaaagtacatctcagctcagcctctggtattctgtacctggtgctcacttggggaccaggaagtctggcatagagatgttaaatggtggctgggaatcccaggtgcttgggggtggggtggagagcaagcaaggatctcctccaccaaaggcgatccattccagaagtcagtgttctgggaatgagtcctaccctgtgggttcttccatggccttggggctaagcaggaatctctcttgattggcaggtcccccagtgaacgtgagctgcaacattttcatcaacagctttggttccattgctgagacaaccatggtgagtaagtcaaaacacaagctgttagttcctgctggagatatctctccatgaaatatttatcctctgcattggtctccaccaaggaagtggggaatcagctgggtttttctcaagtctccagtggtataccatgaggctcggatgtctttactgtcacattaaatgttttgagtgaatacataatatctgaaaatagccaaagacctagcagggcaagcacctgccaaacacccaggattacaaaaacaaaattatacaacaagtcaaatttttagagtaaaagaaaatgtgaagacctgtttttaagtttaacattcaactgcagaatggcagaagactgctggttatacaagctgaaatgggtatattgggttaattgtatatttcctctactgttgaatacatttaaaacttttcacagtaaaaaagtttagaatgaatctattacactagaagaaatgcctaggaaaaaaaataccaaaattgtaagaatgattatctctgaattaaaaagttatgaataatttttattttcttcctacagtatttatatatttttcaaatttctgcaaggggtgaatattatattagtaattatgaataagtgtaatgatattttaaaacttttctcagactttttgtttttgttttttcaacagaaaaatcaattgtacttatgttaaggaagtgatctagcttgtgaaaaaaaataatcagggcagcctaaagttaactctaatctatccatttcggaacatccacccgcccctaatctagttcaggcttccatcatggctggcttacatgactgcaaagggttctcgttggcttccaacttgcccccttccagtctactttatcccacactagcctttccaaaacacaaatctaaccacgtcactgctcctatttaaacccttcctatggctccccatcaccctcagcattaaacccaagttcttttgcaaagctgaggaggctccctgtgattcaccctgcttcatttcctccctctcccactgcatactctagctgcaccgattgcttacagctctccagccaggtcgtctctcgctctctgctttacaggcttctggtggtggctgctaggccactgcccagagcacccactccagcctcctttcccttgccaattcctattctcctttaagactcagcttagaattatttccatagaaagcctccccactgtaacatgcacgtacgtgtgtgtgagttcacgtgtgcccttcacccaaggctgggatgggtcccttctgtccattctcataatacattttacagtttccacaacagcacttgtcacttacaattaccactgtaccaacctgcttatgtgtccctcctgtcactatactgtaagttccttgggggctggtatcttgtttcatttcctgtgggaaccccagcagctagcacagtgattcaataacagatactcaacagttttttaaataaataaaccaaatcaattatattgcttatcaattaaaaccagtatttggtcctaagcatttatggagattacatccaacctttcagtcccaggctggcagaaatcactgagttcagtaggtgaggtggcctgtcttgatatggtcacgaagactgttcccacattcaaaggacaactggtgaaactccctaaagtaacaggcctcttatctccaaatggagatggtcccacttgttagctaggaacaaacatgggtgcttttcactggatatccaggtcaaataaatagccaagtttttttcacctttgaatgtatgtcttacaagcactcttaatgagcccctctgcttttcttcccctcctctgagatcagaagcatattgacatttgtattaatcataatctgtacagtgagtgttgacacttccactctttttcctcaatggtaaatggttatcaagccaagtcagggagtggaccacctggttctgtaaaggaactggttatttgaggacaggtgcacatatcagcactcgtttcctgataatgaccaaacagagacttaattccttcatacagattcctaaaaaagaaagatatagccttacttcccatggtgattaaaagcccagctctggagtcacatacactgagctcactctgtctacgaggagcttatttgcttcacatctttaagcctcagtttcttcatctgtaaaatcccaatggtaattaacatactgatatcattaagttattatgtgaagtgtgtagagaaaaaatgggtttttttgttttgttttgttttgttttgttttgttttgttttgttttgagacagagtttcaccctgttgcccaggctggagtgcagtggcacgatctcggctcactgcaaactccgcctcctgggttcaagcaattcttgtgcctcagcctcccgagtagctgggattacagacatgcaccaccaggcccagctaatttttgtatttttgatagagatggggtttcgccatgtcagccaggctggtctcgaactcctggcctcatgtgatccacccacctcggcctcccaaagtgttgggattacagacgtgagccactgcacccaacctagaaaaatgtttatcattgtccatgctttgtaaatgttcaccaagcattttttatgatggtgatgatgatggagactcttgacactgcagccccaacattatcattgatgatttgctgtgtaatcttgagcaatccttagacttctttgagccttggtttattcctcctctcctctccactcccacctccacaaccctcaccccccatttcccaccccacatcttctgactacctttccagacttcacttctgctgcattttgctttctacagaaatggtgtagcagagtaattagacacagtcttcaaagcccagacaaaatctgaggctcagctctgtgatcttggccaaggtatttaagttggctttctcatctgttaaaaatagggatgccagtagcatccaccttgtggcctgctgtgagtattaagagataaagcatggaaagtgcaaagcacagtgcctgacacaaagggcagttgcaatgatgccaactattgttacatgccatttatcattttcagcacattttcacattcatgctctcacgtgattccttcaccacgtgtgtagtcttacaaccactctgtaaaataggcatgctatgttccccagtttacagctgaagaaacggaggtttgtacagatcatatcacaaagctacttggtgactgtgcaaggattaagatccagttctcataaccgtagataaatgtttgttctgtgccacactgctataactccaaagagcacagactaaaaaaattggaggaccaggacctacaaagtacacgtaagcaacagtctaagtgcatcaaaagtggaaatccaacccaatatcatgccatgcccagctcccctcaagagaaaatagtaagtaatgataatggagataacaaaggaccccagaggagatggtctcctggagtagaaagaaataatcttccgacaggaaatgaaggatcagttatgatgtactgccttgagggtagaccacaaatgacatagttttctccctatttattaaaattaatccaaagtagggcaggaggtgctatttccaagcatgcatatttcataatatagtatttcttatatatatctcataatatatcttactagatctcacttaacatcaccaataggttcttagaacctgcaactttcaacaaaatgactacaacataaccaattttatttctcatcaacattataacaaaacaacattatttgataaactgctatatgtcatttcacttaaagtctgttcccaataacctgtcaatgatgttaaatgaagacttatgtactatgattttttcctcactggcttcttaattatttgtgtgtttaacttaattatttgtgtgtttacagatgatataggggaaaaaactctcagatctaaaaaaaaaaaaaaacttaagaaattgcctagtctggctctctattttctggagagagaatctggttgttagaatggtaaggtcacttgagcaaggtcacacagcaagaaataggtgtggtagaaacacaggtctgatgctctctgcagtgctcaaagattcccctcccttcagcttcttttccctctggattccacctaccaaaacttttggacgactctcccattcaagcctcttttcttgtcactcaaagtggctttgggaaactgctattagtataataacaagaaaagcaacttattcttgaagaacttattatatgctactacataccaggcagtgaacagagcacttctgtatctatcacctaatttaggcttgataacaacccccataaagtgggaaagtttatctccagtttacagatgagaaagctgaggatcagaaaattaggttattttcctaaggacacacagctaataagtagcaagggtagaacttgaactcagtgcgtggtctcctaagccaaatgtaaacatttaattcctgaatgtttgggactacccagcccttccttgtctcctttcattacagagaattagagcaaaagggaacttcagcttgaacagacatagaaactggaggccagagagaggattgcacttgcccatggacacacacacacacagctaattagtggcatagtcagcccaggctccctgacttccagcctgggttctgcctctccaaccacacaaacagctagttgtgcaccatgggtccaaggtaatatggacatagtccgggtttcagaaactttccaggctgtgtttgttctccagaaaaagcaggagtgcatagcagctctataaacagctggagtccccaggcctaactgcctacctcccaggacctggctttattcaccggagctaacagacctgagagcagagaggcagccagcaaagcaacaggggtctctatccagtcctgacaaggagagggctgagactgcctgtcctttatctgaccttttctgggactctctttgagtctgtgcagcaagaggaaggtaaaagttgaaacagaaatgtacaagggaggccacatgcagtggcttatacctgtaatctcagcactttgggaggccaaggtgcgcagattgcttgagcccgggagttcgagaccagcctgggcaaatggtgaaatcctgtctctactaaaaaaaaaaaaaaaaaaaaaaattgcagggcatggtggcacatgcttgtagttccagctactcctggagcaggggctgaggcaggaagatcacctgagccttaggaggtcaaggctgcagtgagctgtgatcatgccactgcactcaagactgggcaacagggtgaggctctgtctcaaaaaaaaaaaaaaggaaaaacaaaaagaaagaaacgcacaaaggaaaagaggaaagggaatcctgatctagagcagcccctctggtattctacaaagagctaaaactcagatgaaaacctctagcttgtctggacaaatgtgtgtaagtgtgtgcactggagcatctatggatctgtgtagtatgtatgtggaggtatatactgagggatcgtggaattgtgcagtggcatacataggcatgtgtatatgtgatgctaatttgaacatgtgtagacatgtaacttcaaagagaaatgtgtatgatctataggtatggatataagtatgtgtatttctatgtttatatttgtacatgtggaaatctgtacatatgaatacacatgtatctgtgagtttgcatacatgtaggagatgtgaaagtacttaagaacgaatgtgcatggagtgtattattttctttgggtatttgtatgtggatatttgtgaatatataaagagatatttaagtatgtatccgcatttgagtaggcatgtttacatgtgtgtacatgcatgtgcatgtgaatgtgaatgtgtgtgcatatgaatacaagtgaataagtaaaagagtatttaaatgtaccagtatgggagtatgactatacatgtgtgcacattaagggacttgtatattgctggaatttgtgtagaactgtatataaacatgagagagagagacagagtgagagagagagagagtgtgtgttgacatcctttgggcatgaatcccagtatttccattattagaacatgtgttccagcctctcttgccaaggggcaggctagcttggcacaagacaggtgcactgtggccaggacccctgctgattgatgacagcctatgcaactacagtccacaagtttggccttatttgacgttaaggggcaatggacagagatctgaaccaggagtcaggagaccagggtttgagttctcactctgccaccattaatacttctgagatacacttcccccaggtacctggccctaagaatggtgtataggatcacacagagtaataggtatgcaagtctttggtaaatgctatagaaatataaaagattatttactactaactagtcagccaaagcaaagactttgcattagtccattttcacactgctaataaagacatacccaaaactgggcaatttacaaaagaaaaggtttaaatggacttacagttctacatggctagggaagtcttacaatcatggtggaaggcaaggaagagcaagtcacatcttacgtggatggcagcaggcaaagagagagcttgtgcaggaaaattctcccttatagtaaacatcagatctcgtgagacttactcactatcacaagaacagcttgggaaagacctgcccccaacgattcaattatctcccaccaggtcccatccataacacatggaaattcaagatgagatttcagtggggacacagccaaatcatatcattctgctcctggcccctcccaaatctcatgtcctcatatttcgaaaccaatcatgccttcccaacagtcccccaaaggcttaattcatttcagcactaattcaaaagtccacagtccaaagtctcttccaagacaaggcaagtcccttccatctatgagcctgtaaaatcaaaagcaagttagctggccaggcacagtggttcatgcctgtaatcccaacactttgggaggccgaggtgggcggatcactttaggtcaggagttcaagaccaggctagccaatatggtgaaacctcatctctactaaaaatacaaaaattatccagacttagtgcaagcctgtagtcccagctacttggaggctgaggctgcagaattgcttgaacccaggaggcggaagttgcagtgagccgagatggtgccactgcactccagcctgggcaagagagtgggactctgtcttaaaaaaatacgtaaataaataaaataaaatctgaaaaaaaaaaaaaggaagttagttacttcctagatacaatgggggtacaggtattggataaatacagccattctaaatgggagacattggccaaaacaaaggggctacaggccccatgcgagtctgaaatccagtaggacagtcaagtcttaaagatccaaaatgatctcttttgactccacgtctcatatgcaggtcacactgatgcaaggggtgggttcccatggtcttgggcagctatgcccctgtggctttgcagggtagagcctccctcctggctgctttcataggctagcgttgagtgtctgtggcttttccaggctcacagtgcaagttgtcagtggatctaccattctggggtctggagtgtggtggccgtcttctcacagctccactaggaggtgcccaagtagggactctgtgtgggggcttcaaccccacatttcccttctgcactgccctagcagaggttctccatgagggccccacccctgcagcagacttttgcttgggcatccaggggtttccatacaccttctgaaatctaggcagaggttaccaaacttcaattcttgacttctgtgcgcccgcaggctcaatgccacgtggaagctgccaaggcttggggcttccaccttctgaagaaacaacctgaattgtactttggcaccttttagtcatggctggagtggctgggacacagggcaccaagtctctagaccgcacacagcacagggaccctgggcttggcccacgaaacgattttctccaaagcctttgggcctgtgatgggagtggctgctgtgaagacctctgacatgctccggagacattttccccattgtcttggggattaacatttggctcctcattacttatgcaaatttcttcagctggcttcaatttctcctcagaaaatgggtttttcttttctagcacattgtcaggctgcaaattttccaaatttttatgctctgcttcccttataaaaccgagtgcctttaacagcaaccacataacttcttgaatgctttgctgcttagttccaccagaaccctaaatcatctctctgcagttcaaagttccacaaatctctggggcaggggcaaaatgctgccagtctctttgctaaaacataacaagcgtcacctttgctccagttcccaactagttcctcatctccatctgagaccacctcagcctagattttattgtccatattgctatcagcattctaggcaaagccattcaacaagtctctaggaagttccaaactttcccacattttcctgtcctcttctgagccctccaaaccgtcccaacctctgcctgttacctaatttcacatttttgggtatcttttcagcagtgcccaaagtcacttccacattttcaagtatgttctcagcattgccccactttactggtaccaatttactgtattagtccattttcatgctgctgataaagatatgcctgagactgggcatttacaaaagaaagatctttattggacttacagttgcatgtggctggggaggcctcacaatcatggcagaaagtgaaaggcatgtctcacatggcagcagacaagagaagaacttgtgcagggaaactcctctttttaaaactatcagatcttgtgagcttattcactatcacgagaacagcatgggaaagacccgcccccatgattcaattacttcccaccaggtccctcccataacacatggggattcaagatgagatttgggtggggacaccaatacccaaacataaggaaatgcccttctgggttttggagttttttgttgttgttgttgtgtttttgtttttgtttttgttatttgcttgtttttatttttactggtatctcttcattcatttgttctttccactccatttattaattaatgtcttacatgtgctaaatttggcattaggctctagagatagagttctgttttagtcctataagctaggctttcctgcattaacaaatccccaaaatctcaacatcttcagacaacaatgattcatttatcactcatctaaagtctgctgcagatctaagggctctccgggactgctttcccccaggtagtagctcagcattgcatttccgtatcaacacacaatttcacatttgccacacaagagaacaatacactgaagggttgaacactgttgtattagtgtgtgctaccataacaaagtaccacagattggatgccttcaacaacagaaaattattttgtcacagttctggaggttagaagtccaagttccaggtgccaccagagttggtctctagtgagggcccttttcctggcttgtagacagcttcttttcactgtgtcctcaaatggcttctctctgtgcaaagagagacagagagagagagagagagatctggcacctctttctctccttattaggacacaaatcctactgaattagggccccaccctcatgacctcatttaacctttatcacctccttaaagactccatcttcaaatatagtcactctgggggttagggcttcaacatataaattttggagggacacattcagtccataacaactgccaagtaaatgtgttccacctaggagtgacttctgcttgcatgtcactatccaagggaagtcacatggcactgcccaaagagaagtataatcctcctatggtaccagaagtaaacaggaaccagacatcagtgagtaggaggtctctgctttcaaggagtctattttaaggaaaacaagataataccacagtaggatgggtgagattacagagctatgcaaggatgctgtggaacacagaagttaataataattctctgtaaattattaataataattctctgaatatgtacgtgtcaggcactgttgtgtgctttcgagttatttttcttttttctttttttctaaactgatcagcaccaaattgactgattttactaaagcagcaatctggtcatggtactccccatgctcaaaccttccaggagagaacagtttcaagggatgaaccaaaggatgaaagggtttcaaaaaaactgttgtgtgttcaatagtgccaaaagaggaaagaaaagtcaagtagaaaagaaagtgtcatccagtagtttcagcaacggggtataggggaagggagggcacatatgtagaattagggaatgtaatttcaggggcatgaagaaagcaaaggataaattgaaacaaagacagcatgaagataaacctttcaaaaagctctactgtgaaaagaatgtgaggtgttagtattggtgtttgtcatttactgagcacttttctgaaagccaggtaattttggttagtgaattatgggaattatttcatgtacaacaatcccattttatagataaggaaactgaggcttagagaagcttgattcacccaaatttttccagccaataaatggcacagccagttatcatccccaggctgcctgactcctgaggccctgttcttggcctactccatttgctgagcataaagaaagagggaagtgggaagtggcagagccaagggcaccagggccacgtaagggtatcacctcatcctggtcttctgcagaacggtttggtcaataagaagctcagtaggatttgtgcagtcttgtctatggtcataccaccctgaacacacccaatctcatctaatctctgaagctaagcagggtcaggcctggttagtacttggatgggaggatttgtccagtcctataagaacttgtgtcacaagaacgaccttggtcatccatcattttgggtatttgcaaataaggcctcaagatacaagaaaacagctaccacacaaggagatcaaaagccccttatagccaggtgtggttgttcatggctctaattctagcactctgggaggctgaggtaaaaggatcacttgaagctaagagttcaagaccagcctaggcaacaaagtgaaaccccatctctacaaaaaaattaaaatatcagctgggcatggtggcatgcacctgtaggcccagctattcaggaggctgaggagagaggagatcacttgagcccaggagtttaaggatgcagtgagctatgattgtgccactgtactccaacctgggcaacaaagcaagaccccaactttttttttttaagccctttatacccaaacataaatattaacacattggctagggagcagtcatttagtcacaagtcaaagtcaacctatcctgggatcagttgatcaaatgaagcagacattttaaatcacaaaaataaaacttaaatccatctacttttttcccactttgttgctctcagctcctagttaaaattggcataatctctctcctgcttgacaaaatggcctcctaactggtctccttccttcccctcctcatgctccctatcacttcccatagtttctagaaggatcattttaaactgcaaatcggatcacagaattatcctacttccaatcctgcaacaacttgcaaaggttcttaccacattctgttccctctgcccagaaagatctttgcatgcctggctccttctcacccttcaggtctcagctcagacattgcttcagggagtccttctccacccccctacctaaaaatatccctctcttccagttactctctatcacatcaccatgttctattatcctcagagcaatatctaaaatttaaaagttcacttgtttgtttgttgccttattggctttttcagctggagtggggaccttgtttccctcaatcacctctatatttccagtgcccaccacactgcttaaatcacaagagctagtcagtatttgtggaaaggttctctaagcacacccccatctgttgtcagaatccctgccataaacatcatatccaagtactttttgcttgcacacctccagtgatggggaacctactacctcccaattttagattcaaggggtcatgtggaggtttgttacatggatatattgcataatgttggtatttgggtttctattgaacccgtcacccaaatagtgaacataataaccaataagtaatttatttattggtctttcatctcaaggtggaactcagcgcactgaggagagcaccctgatggtaaagggactgcccatttcatctttgggcagctctgaaatctccatttacccacagctttagtcctgacctagtgccacacagaatcaaccaaatcaactgacaacccttcacataattgagatcggctctccctgtcccttccccagcctggcttcctcaaccattctctctagttttcagtcccttcaccaccagggtgctctcctcaaagtgcatccagcacttgatttccatcttgagatgaaaggtgaagaaataaactacctatagggcactatgttcactatttagttgatgggttcaaaagaagcccaagctccagcattacgcaatatacccatgtaacaaatctgcacatataccccctgaatctaaaataacaatttttaaaaagaaaaagaaatagacccagcctgacaaggagtgttccgagcagagcaaagtggggccatacttattctgggttagtgaatttcaaagcattgtttttaatagcagtcccaccttagttcaatttttaaggtaaacctttttttttttttttttgagacaaagtgtcactctgtcacccaggttggagtgcagtggcgtgatctcaatctcggctcactgcaacctccacctcccaggttcaagccattcttttgcctcagcctcctgagtagctgggattacaggtgtgcgccaccacacccggctaatttttgtatttttagtagagatggggtttcaccatattggccaggctggtctcaaattcctgacctcaagctatccacaccgtcagcctcccaaagtgctgggattataggcatgagccaccgcgcctggctgtaaggtaaatctgatgtagcactttaataaacaaatttcttaaatgggtggttctggttgaactggagaggaaaccaagaatctcattctcttgacctctctctcaacctctgcctcccccaggaagcccttggaaaaccttctctaggccctaaaatccatttctacccattccacctcaaagacctttccatttcgggaaccatgtcacagtgttcacttgcagtatgcttacggacagcagcaccctggaacatttttttaaagtgcattagtaatacatgaaaacaagcttttgtaattagttcaataaaaaagaaaaagagaatgagaaataagaatgcccctgctttgccctcccctccaattccctttgtcctatcctgaggtaataaaatttagtggacaccatactagtcccctttccttgattgttcatacatttaggtacatatacatgtctttatataagtaggattgtgcaatacaatttgctttttccactccaccacagcttgacgcctctctcgacatggctacatatagatctaccttactgtttttaactctctacacaatcccaaatttcgaaacatgggaaaacaaatatattatttattattagattaaatgtatgacaaaattatactatgtttccaggctttatagcctcctggtaaaattccatggtatggagacatcatcatttcacagtatttaaccacttttctcttgacatgcttttaggttttttcagctttacactattacaaacaaggctacaatgagcattcttgtgcataaccctctgtgtgcatttctttaggatatattccagaagtagaattgctttaatgaaagaatagtcacttttttaaaagtattttgcccaattcccttcccaaaaaagcttcaataatttacattccctacaatagtgtttatttctcttcatccttgccaacccaaggtattatcaagcttttttattttcaccaaatgggattttcaaaatggtacttcattgtcattttcaatttgcacttcagactcctagtgaatctgagcatcttttaatatgttgactgggcattttgaataatattataggtttctttttttatatgcatctcctaaatccatttggagtttaattttatacgaagaatttggtggtggcttaactctatttttctctgattgagtttctattattccaacaccatttcttaaacagtcactgtttttctactaatttgaaatgctatctttttcataaactaaatccccatgtatgcatttctagtctctagtctcagtttattgctccattgctctgtttctataccaatatcacactgctttaatttctatgactcattatatttctatgtctggtagagaaagccgtctgttgttcttcatttacaagtttttcttaacgctttcagccctttctttcttccatgtgaactttagaatcagtttattgaggcctataaaaatcgtctcacggccgggcgcggtggttcacgcctgtaatcccggcactttgggaggccgaggcaggcagatcacgaagtcaggaggttgagaccatcctggttaacacagtgaaaccccgtctctactaaaaatacataaaaaaaattagccgggcgtggtggcgggcgcctgtagtcccagctactcgggaggctgaggcaggagaatggcatgaacccaggaggcggagcttgcagtgagccgagatcgtgccactgcactccagcctgggcgacagagcgagactctatctcaaaaaaaaagaaaaaaaaaaaagcctctcaggttttgattaggattgcattaagtttaaagattaatttgggaataaagtacatctttacaatattttataagtatagtacatctctccaattatacaggtattcctttatgcctttcagtaaagtttttgatttttttaaatatatacaactcacatatttcatgttaggtttattcacagatattttgtgggggtggttgctattatggatgagatcttttgttgttgttcctttttccattacacttttgtctctctacacagcttatgttaggtcccttcttatcttcttgggtctgggggatccaagagaaagtctattcagcgttatccaattagatatggtgccacactcaacaaagctttagtaaacaaaagactaagagagggccaaggagaaagccctcagaaatgccattagagtctatcacaagcagaccatggggtgatgagcagtcttggtaccatctgctggatgattctctcccagtacaccaggggaggtgtcacagcaatgaacttatgactgcccagagcgtgactcttcatcagatcaaattccagaaggctgactcatgaccgtcaaacccacgaatgactgaagtggggaaatcaaactgccaaattgttccaatttacagtaagactttctattgtaataataagaatgccatgtccaccaggagtgtgctcccttgccaagcaaaagttgcttttaacataactggaattggagaaaagagaggtagacagtcttgagggaagtttcatccaggccagagagagttctaagaaaccatccttgcgtcaccacacagaagccctccttctaatggcaagaaagttggtgtttccacaaatatagtgatgcagtatgctagattaccaattgccaaattcctcctacttgaacggccctttcttatgctacagaatgaatgtcccacatatgtttacaaaacagtccccaaaacaagatgtaatacaataaattagggttcttctcattacattacaagcacatgcccatcctaagtcattgagattacacatagatcattcagattgatgccaggcctcagatttgaacatgcaaatccctccattgcatattcatctccgttgtttgttttttaactctcagagggtgatcttagtttccatatttccaagtttgttagtggcatgtctcaccattgtgccctgcactgccaacactatcagctttcctctttccaggttaacatccacccttccttccttccatttgcaccctttggcaaccagttataaatctacttcattgctcaatgtcccaatccaaaattcttcgcctgatactgattataaggttatttatgcaccaacctgtctgtcacatgggctcagtgggtccccagtatactacgtctactatatttccttgatctacccaatagatagtctaacatattgtatttaatatttaataaaaagtttaaatatatgtttaaaatatttaataattttaataaatatttacttttaaaatattttaaatagatgttttaaaataaaataaattgaacttggtttaaaattttttttaaatgggaagatacagcctataattgtcaaaagagtgtgaaattgggaaccagaagtcctggattcatatctctgttcctagcacctactagctatgtgatcttgggcaagaaacttaacctccatttaaccactctaaattttggtttcctctccagtgaaataagtataataatgcccagtatgctaggttgatgaaaaggttttttttgttgttgttgttttgtttttgtttttgtttttgttttttgaggtggagtctcgctctgtcgccccagctggagtgcagtagcacaatctcagctcactgcaaccaccaccttccaggttcaagcagttctgccccctcagcctcacaggtagctgggattaccagtgcttgccaccaagtacaggctaatttttgtatttttagtagagacggggtttcgccatgttggccaggctggtctcaaactcctgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtttgagaccagcctggccaacatggtgaaaccgtgtctctactaacaatacaaaaattagccaggcatggtggtagatgcctataatcccagctactcagggggctagggcaggagaatccgttgaacctgggaggtggaggttgcagtgagcagagatcgcaccactgcactccagcctgagtgacagaacaagactccatctcagaaaaaaaaaaaaaatttagcaaatgtcagacatccaatacacccaataaacagaactgctattcacattcttatgtaattattaaattcacattgatctttagtgatcccctaaagacaaacaaagatgctaagctccactggtccaaaccatctacagttctttacaacaaatgtagctctgattgtgtgatatctaaatgagaatgcaccaggcagcatggtgacttaggagaaattcaagacacaaagcatctggggccaagcaggcaatagacagggatctgggcagtccacaagcactggacttgagtatagagcagacagcagatcaaatccatggctcgaggcagaaataaagcactagcagactgctaaatctagggcagaagctttctgtcctttgcccttttcaatacttcctgttagttgtgggcatctaaaaacccacaggtacgtcatagcagccagaggcagtacctaatgacactgaggtgtcatcaaactgtcactcaattcatatctgggatatcatgggtagtgtagtctactggttaaacgcttgggctctgacattaacgtcctgggttcaaatcccagctttgtcacttactagttatgcagtgtcatgagtgtaacattaacctctctgtaccttgatttccctgcaaaatgagaataacaataaaacctacctcacagggttattgtgaagataaaaaataacacacataaaggtcttaacacagtttcttgcatgtggtgaagtctcagaatattagtattatttgcattgttattattaattctgaatttaccagtaactagcagcaggaacttgagcttttagggctttagttttcacaactgtccaacaggattcctgcatgcaggttccaccttagtcaattgaattgctgtgtgcccctgagggagactccctttctgtaaaatgagagagttgagacagaagtctccagggttctttctagctgtaatatttgatgatgaaaatcatgatgataagaatgatgattctctcatctagctccaatctccattcctgctatcttagtttagaacctttattacctcccaactggattgtcacaacagccttaaagcaggtctttctgtacctgttttctcctgcttccaattgtctacagtggttcctgccatactgatcttcctgaaatcaaactgtgacattaccccactgcttaagtcttcaatggtgctaaattggctagcaaataaaatccaaataccttggtttggcagttaaggatatccacagtcaaattaattcattttgcagccttatcacagcagagtagttaagagcctgaactttatgtaatcagacaaaccaggtttgaacaccagccccactctttcctaactgtgtaaatccagaaaaagcacttaatctccctgcactttcttcatctataaaattaggttgaaaatgcccaagtcataggattgttttaaagataaaataagctgacatgtatggcatgcttaagacataatgcctgttgtatagtagggcctcaataaggggcaattattattatttatgctgctaatggttgagctaaactgaactgtttgaatgcccctgcctacacacctctgcttgtgctattccttctacatgagattccttttacccccaattatacatattctaattccaaatactctgaggctgcagccctagtcttaatgtcttacccttatctcaaagatgtgagacatataggcttagagcatatcgctggccttgttccaggtgaaaccagatactgttcacacctcagaacaatcctagatctagagatgctaacttctggaggatggaacaaactgaaaggggccacctcaaatgctaccttctcctgaaaagcttttccagatttgcccaacttggctggaaatcatctctaatggcaatttgttaaaagtatttatttatttatatttatttatgtatttatttttgagacagggtcttgctctgttacccaggccggagtgcagtggcacaatcatggctcactacagcctcaacctcatgggctcaattgatcctcccacctcagcctcccaagtagctgggactacagtcgtgcaccaccaggcccagctaatttttttatttttactttttttgtacagatggagttttccacattgcccaggcttgtctcaaactcctgggctcaagcaatctgcccattttggcctcccaaagtgctgggattacaggcgtgagccaccgcatgcagcctgttagaacttcttatgaccctctcactttcaattttgtgtggtagatatttgtgtccatgccttatcttgcttactagataaactgaattctttaagtatacaaatgaagaccctgtgcctccaccgtcaactgtactcccaatcagcctcataaatgttaatagagttggattgagtttcgagatgagatatccccttgggagctggaatgataagactttaaaaggtataagaatctggttcttttgtttacctcttgatgcaatgtctcttggttctgactgcaatgggcccacctcttgcattccacatacccttcccaccaacaatcttgcacaagctcttagttctatcctactaaaacacttcatgcttcctacttcatcacaatactgagtttagaggagtttattaggagaggttagaatctgaaatgaggcacagtgggggtagaggtgggggacagatccaacttcaggtggtgcataggaagccctcaataaatgtctgtggaatgaatgaatgaacaaatgaatgagttaatgctctaccttggtctcataagcagggcagctagttgcccagttaccagaaattagatcatcaaggaatctgagaggcaggatgggtgagttgatgctgaacactgttgaatcagagctctggaaatccctcctgcttcaggtttgtgggctacccttgagagtttgagacctagaagccagctctcagaggtggaacctcaggttctagggtggagaattcaattgctgctcctccagtccctgaacttgaacatggccccccgcatgtcgaacaccaaccagcatacgtatagctatggccaaataagcaaaacagcctttagctttcggcctattacaccaattacattgatctcttctgaactgcatttctcactgctgtttgccaacttaagggaggaaatcaatggcagcaacttgtttgggtagcggctgctagggcaggcgctgccagtaggagtcaagctgcctgaggacaccaaggtacattctccgtctctcgctctaacttttcattagtcatttcataatgagagactcattatgaaatacaaagagatggattttattttgtttttcttcttttagatgatgtacgtctaaaacataaattttttactgacaacttgcattgcttctgaaataacagtaaaacatttttaaatattagtaataaaatgcaaatgtaataatgtccatctttacttaaaattcttcaaacgctccacattattattaggaaaaagttcaaatttctcagtacagcttgcaagaccctgcatgtgtcctcccactcctctattcattcacttgctattctttccaaagtgccacactcttgctttacctctaggccttcacatatgcacttccaactgcccaaaatgctttccctctttggctcaaccgtatttggtctcaccttaaatatcacttctacctggagactttcctgatcaccacccccaagtccagatgggaacctgtcttctatattccctagcaccctgcgtttaacccctatcagagccctttcctcagtatggtgtaaacattacactggaggctctggagctgaataaatatatctttcttgttctcagtggattcctcagtgcctagaatagtatctggcacttaagagagctcagttaaatgttgctggaaaaaataaaactaacaacaattagctgttagatttggaaaagttcttagagaccatctagcctaacttcttttaacagtgagactcagagaagcagagccaagttctaattccagattctttactgaattgttgtgtgatcttaggaaatacctttcccctctgggtctcagtctttccagatataaaataagaaaagtccattctgttccagctttttctgactttacctcctcttccttcttataggtactaggtagctcataggtgcactgactgagtgactaggtgagatggtgcagtgaaaatataaggtctggttcatccactaagattgctcccaatcaagctgaggacataagacatacacagtgaagaagtgctcaattaaacattccaggtgattcggtcttgctaggagatcaaaaaggaagaggtcagggaagcctggggcatcaagtctcctgcaggagataagccttaagctgagaaggcagaatttgcctgagcaatgaggctgacggaaagtgtccctcacacaggattggctgtccacaccatgtgacgtaaatcacaagtgctcactagaggctcaggctgatgctgattgcagtcctagctctgccactcactggccctgctcctgggacacatttctcagcctttccaaacctgttttcttaccctcactatgggaatctgaatgtctagcttgcagggattttgtgaggataaaatgtatgtgacagtatctagaacggcgcctgctgcctaacagaccattttaagaaatgccactttcttttcttcctgctagccacataaacggacttgacatgtcactggcaagaacatcaaaagtgcagctggggcttggggactgaaggctttttctgcccaaccattcatagtctgttcactctgatgtgacttgcccaatgcctcatcataacacacacacacacacacatgcacacttcacgcaaaatccaagggagaaggagaaggagagactatttccaatcccctgatcagatgggaccagaatgggagttatccattaccatcaacaggacaaagagccaacactcaggccaggcctgaagttcttccaccaccatgggacttataagatgtgagattatgaggccaaatgtcactttctatggggctggagggagaggctgcaattaaattatagaacaatcctataaaatatcttggaacattttatgaagctattgatatttctataggcaaacagactgaggcatgagctgtaggaggaattgagcaggggtgagggtgagagtggggaggaaggttgtttgttttagtttatccctgctgataacagatcaagactgatgaggatttataagcagcattccaaaagaaaatattgcatgacctcatttatccagcaccctcgggaatagcaggtcctcatgtatggagattattccttggaggaaagcatttaaagttggacttgaactgaggatattaatcatttggggaactatagaccctttgggagatccaacatagagagctatgcccttcctgcttgggaaacacaaatataccctaaactctacttgtgtcatgatattcatgaactccaggtttacaatgtctctgtaacaaaatttaaaactttcctttttgttttgtttatttgtttgtgacagggtctcactctgtcacccaggctggagtgcagtgtcatgatcatggttcactgcagcctggacctccctgggttcaggtgatcctcctacctcagcctcctgagtagctgggactacaggctactgtacaggccatcacatgtgccatcacaccctgctaccttctgtactttctggtagaaatgaggtatcatcatgttggccaggctagtctcaaactcctgggctcaagaaatcctcccaccttggcctcccaacatgctgggattacaggcatgagccatcgctcctgaccaaaaactttcttaatggaaatatttcttaactgcctgacccagttttctgctattgagatctacccataccataatagctcctcacgttgtgaatagaaactgaatggactctttcagttcctctaggatcagctgaggcaactgagcaaactctcagctagaagtcagaacacttgggttctaaaatcagctctggccctacattttcagagtgacattgagccagtctcaattctccctggacttcagtctctttatctagacaaaaaaaatgtgggaggtggggatggagttttgactagaacagctattcctaacctatattctatagaagatactcaccatgcacaaatataagaattccatggccaaaataaaccatattctattcccttcttgagatgcacacaactcatcagcatattaaggtctctgagaagtcctgcaataaagaagcctattgtatttcatccggtctaacatttccctaattgatttggctcctgaatttttctttcagtggaataactacactgcagtaccatcagagaaacattaactaagcattgagtttagaagctagtaagatgtcagattagtagattgcaaaaattttctcccattctgtaggttgcctgttcactctgatggtagtttcgtttgctgtgcagaagctctttagtttaattagatcccatttgtcaattttgttgccattgcttttggtgttttagacatgaagtccttgaccatgcctatggcctgaatggtattgcctaggtttccttctagggttttaatggttttaggtctaacatttaagtctttaatccatcttgaattaatttttgtataaggtgtaaggaagggatccagtttcggctttctatatatggctagccagttttcccagcaccatttattaaatagggaatcctttccccattgcttgtttttctcaggtttgtcaaagatcagatggttgtagatgtgtggtattatttctgagggctctgttctgttccattggtctatatctctgttttggtaccagtacaatgttgttttggttactgtcgtcttatagtatagtttgaagtcaggtagcgtgatgcctccagctttgttcttttggcttaggattgacttggcaatgtgggctcttctttggttccatatgaacattaaagtagttttttccagttctttgaagaaagtcattggtagcttgatgggaatggcattgaatctataaattaccttgggcagtatggtcattttcacgatattgattcttcctatccatgagcacggaatgttcttccatttgtttgtgtcctcttttatttcgttgagcagtggtatgtagttctccttgaagaggtccttcacatcccttgtaagttggattcctaggtattttattctctttgaagcaattgtgaatgggagttcactcatgatttggctctctgtttgtctgacaaagggctaatatcaagaatctacaaagaactcaaacaaatttacaagcaaaaaaacaaacaaccccatcaaaaagtgggtgaaggatatgaacagacaattctcaaaagaagacatttatgcagccaacagacacatgaaaaaatgctcatcatcactggccatcagagaaatgcaaatcaaaaccacaatgagataccatctcacaccagttagaatgacaatcaataaaaagtcaggaaacaacaggtgctggagaggatgtggagaaataggaacacttttacactgttggtgggactgtaaattagttcaaccattgtggaagacagtgtggcgattcctcaaggatctagaactagaaataccatttgacccagccatcccattactgggtatatacccaaaggattataaatcatgctgctataaagacacatgcacacgtatgtttattgtggcattattcacaatagcaaagacttggaaccaacccaaatgtccatcaatgatagactggattaagaaaatgtggcacatatacaccatggaatactatgcagccataaaaaaggatgagtgcatgtcctttatagggacacggataaagctggaaaccatcattctcagcaaactattgcaaggacaaaaaaccaaacaccgcatgttctcactcataggtgggaactgaacaatgagaacacttggacacagaaaggggaacatcacacaccagggcctgtcgtggggtgaggggagaggggagggatagcactaggagatatacctaatgtaaatgacgagttaatgggtgcagcacaccaacatggcacatgtatacatatgtaacaaacctgcacgttgtgcacatgtaccctagaacttaaagtataataaataaaaaaaaacaagaagctagtaagatgtgactccatgacatctagtaaacctttccaaacaaatcaacatatgtcacagtaagttatagaaggctggtattaaaagcgaatgggatgaaccctaggaccagcaggaacactacagaattcttccgcccatccctccttcacttcttgagaattaattgttctctttaggcagaatagtttgaatgctcagacatcagctttgattttttcctttcattccttcaatttgtctagaccagtgactctcaaatcttagtgtgcctaagaagtactgtagtattggggttgagggtaaaagggggacttcaatttatctgcaatgtattttttctcttatttaaaaaaaatgaagcaaacatgacaaaatattaacaggatgatgaaaacaagtgttcattacatccatctttgaatttttctttagtttaatttttttcaaaataaagaataacatttacataatctcagttcagggttgaatatacctcatggggcatttagaggattttcaggagtaattatgactcccatggttttgcctgatacacaccttttatgtctcacccccatataagatgcaaccacacttaataacatcctccagaaaaggttttactggccaaaagcacccaggtcctccaaaagttgatgtccttgggcctaacattgccttcaccttgttatttcctggctgtaggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcaggtgagttctgaccaggttcacccactccctgctcagaacatgtcttgccccactaccttctgggcatagactctaaaagaggggccaaacagaggtgaacaggccctggcaacccaacacctttgcagaataggtagacccagctctgtaacttatactcggcaagtaagaataaaatacaatggggcattttattcaggagccaatgatttattataaccaaggagactaagaaagccatcctagagaaagtggggttgaagttactcagcatttcaatcaaacaagataggaaagagtattcaagcatgattaccaataatagcaggaactaaggcataaagcctagaaaatcacagcaacttcaaagtaaatgagcctgccaggtggatggtgttgctcacggtcaaggccagggatactcccttctataaaatctatcccccaaactttgcactgggtctaggggtttagatttccttctccagatgtggagtatccttgagatattggctaggggcaaagccttcagagtctactgccacccctccacaccaagtccctgatctcctctcctaaggcataaggaaaatgaccaatgtccaagaggtgaaaaaatgtccttacacatgtaataataacagctaccattcatgagaattcactaactatgccaggtacttttcatgtgttatatccagccctcctaataaccccatgaagcaggttttaccaggcccatttttcagattagacaaatgagaatcagaaaaatttaagtaacctgccaaagtttccagtttgttagtagcagagcctagattctaatctatattagtgtgaatctgatgccctctcaaagtcctatagcagtgcatggcattcaataggcactcaaatatttgatcaatatatgaatatgtttttatttcaaagagcttaaaaaagggcgctggtcctaaatgtcttctcctcctgctccagtccttcagggaaacacgttttttttttcctttgggtgatgagccttaactgtccaggcctgtgggagaggctgtacagatcctaaccctcaggtttgactgaactcggtctttcctgaaagcaggctgggtaggggagggagcttaggaacctcatcatcaagagcaggcttggaggaacccgaggcttacatggccttcctcgctcaggagcccaccttcccatcccctcaagtaaacatccagactggaagagtgacaggcttaggaaatggccatccaggcccagctggctgcggggatggtaaggtcagcctgcttggattttgctgctgccagactaatttcctatctctaggaagctaagtcctggtacagcatgataggacaaaccagcagaaagtgacatttccaaggtcattcgacttcaggaaattaacccagtgtgacagctgccccactttggagcttttatctgcagaaattcaactgcattcactttctcttcactttttccctccttccactcccttcttttgcctcttcttcctcagcctctcccttccatttttccccttttgcttcaaccttgtgcttaaaggggcccacatccagagctgtgggtgtgagctggaggaaggaagttcacaaagggctgtgtacctcatcacatgcagccaaagtgccagttcaggtccactagaacaccaccaattaggtatcttagggtattggggttggctttgcaggagagcagtgctgccagcaaacacctgagtcaaccccaccatgggactcagaatccaaaggccaggacacatggttttgaatcctggctgatgtatcagcttgctgtgtgactttagatgactctcaacctatccctctctgcaccctgggtttctcacctgtcacatgagggagttgccttgatgatctaaggctctttgggctctgaaagcctttcttctccatcccctgcagcaggcactcagatgttggaaaagcctttcaagctggagtcttgtattccagcttgagctgcaggcctcaaattctgttgagaggactccctctggttctgagtctgtggcctctgtcagggttgaacaaccaaaataaacagctagcccagaatcctgaggagcccacccctttccagtcgaccccagcatgagcctactgatgtagtcaactgtgtctggacacccagaaggcagagggcctctttgaaataacctttgatgagccctgtgtgtgaagaaggtagccaagaaccacttgcaacacctgctgcaggtgcacatgggtgctgctcaacttaaaatttgagctctgtccctacctgagggctatgcagaagagtaaggaacaggggcagcccctggcctccaggcaacttgctaaagacaggtctccagaggccagaaagactccaaaaaacccagaagttccctgactgtgtcacttgaggcaacctatttttacctctctaaacctccatttttcaatcaggaacttggaaatacacacataattatttaataaacatgagttgtccacacccaccgccacccaaaggtgctgcatcccagcagccatcgggggctttgtctaggctgggcaaagttggctgggagaccagatggccaccaggtcactgaggtggggtgggaaannnnnnnnnnnnnnnnnnnnnnnnnnnnnnnnnnnnnnnnnnnnnnnnnnnnnnnnnnnagcctggaggacagagcctgccgccaggcccgggcccccagctcatctgcacctccaaggccagagggcctgcaggtccccaaagcagctgactgcactctgcttcccaccatgcttcctgccagaactccttgtggattttttatccttcagttttgctaaattcctttatttgtgttaacagtttgtatgtgtgtgtatgtaatttgcagggctttctatatatgaaaatcatgtcacggccgggcatggtggctcatgcctgtaatcccagcacttttggagactgatgtgggaggactgcttgagcctgggagttcgagactagcctgggcaacatggcgagaccccggtctctacaaaaaaaaatttaaaaattagcaggcatggtggcagatgcctatggtcgcatctactctggaggctgaggcaggagaattgcttgagcccagaaagtcaagactgcagtgagccattattgcatcattgcgctccagcctgggccacaaagagagatctcatctctcaaaaataaataaataaacaaaaaaacaaacacaagttccctgaccttctttccctatcctgggcaactgattttctaacaataactagaatagaggcacagcctccctgatgtgcagatcctgcatcattcaaaatcccttctcttcccagaatcaccctgacactggcctgccccatggacttgaagaatttccccatggatgtccagacatgtatcatgcaactggaaagctgtgagtgtcttgcatgagtcctctagaaagaaccaggctcctttttacccatgggataggcagaaattcccacacagctgctcctaaccactagaccccaggagattactgtaataacccaaaatattcaatgaaggactttgcttttagaaaatgcattagaaatataacttcccttacattgcctaactgaggcccatgttttggagccagcagcattctccaaagggtcattgttccatgtctatggtaaatgtgaacggaggagaaatggcttgaataagtcatggtccttgaacccacaagatgttcactccagcaggggaggtaaacaactgactgcacaaataactctactaaagggcggcaagtgattggtgtgttgttagaagtacaaagcactgtggcctcgtggcagaaagcgtgcttccttctaatggagaaggaaagaggttattggagtagactttatggaggactgggattttaacagattggatagcagactcctttgattgcaaacagagaaaccaatctgactaacttaaaaatacagaaaccaaggcagagcacttaggcaacaggaactaatggaccatttccttggagcactacccgtgaggggaatcagcacaaaccaattctgaacctcttgttacttcactcaatagttgctgaagtgctggggcacagtctggcctagcttgagtcaccttttcacactttcccccgtctaccccagccagtggttagtcccaccaagagagcgtgcaatagagttgttccacagaggagtatctgctgtgagcaaaagaggaggctggcaaggatggtgtgcaggtgaaaatagcagatgtccactgcatttcaccatgggagtgagagggggaacaataggacaaactaatgcagaaggttgggaagagaggtggaagggctctgatgtagatataaataattaaccagttttttacctcttttgagaggaaaaaaaaggaacctggtctcacaagttccatcaagtgtctgatgtctctctcagtctctaaccctaaccaatcctgacatgcttcaaacaagtgcttctgagtggtgactgctccttcttctgatcccatcccagttggatatacgatgaatgacctcatctttgagtggcaggaacagggagccgtgcaggtagcagatggactaactctgccccagtttatcttgaaggaagagaaggacttgagatactgcaccaagcactacaacacaggtaggtacaagggccaccctcctcagatcccaccccccaaccaggaccagaggtcatttcagacacattcaatcattgatccaacagatcttatgaagattacctagtggttaagagaataggttttgaaacaaaaatgtggctctgacattttcttcctgtgagtcctggagtgagtaacttaagcttgggccatacctaattacgagggaagctggtaaatacagtcattattccaggtagcagaatggatcctatttctaaggcagaagtaaagaactgatattgggaagacacctagtagtctctgtcacagatgaactggcatttccaatagagcaaaagtagagagaatgctcacaatagacctcagcaagagggagctgagaggtgtcactgaaggttagtaaatagctagaaagggttcacttgcctgtgagctatgagaggtcagagaagccacgatggtgtagcttagctctctatttcccatgcttttgttggaagattgaatatctggatgactggggccagatcaagactggctttgcgtatcctgtctcaggctgagaacaagctcataaaagcatggaagaagaaagtcagtcaattggtataacagctggaaggatgggtaggaagctggggtctgaacccagatgcacagagtagagaggcatggcaagccagcaagaggaggaggtgaaagagagagattgagagaaaccatcgtaggctctggtgtaagtagaaagcccagtgaaggtacaggcagcctgggctgcagtctgtcttgggtagctgcctctttctgagtcacctcagagatgtttcagaacctccaaagatactctctttgttccttgagccataatggtattcccatagcagccatgaaagcaatgactcccaagtcaaatcaccacaactgaccctcacataccaagtcttttactctttatacagcattttcttttctttttagctttcttaaggtataactgaccaataacaattgcatatatcgaaggtatgcaacgtgatgttctgatatacatatgcattgtgaaataattaccacactcaagctaagtaacatatccatcaactcacatacttctcattgtgtgtgtgtgtatgtgtgtgtgtctagtaagaacactttaagatctaccctcttaaagacctaaatttaagattaagctaaaatgataaaacttctagaagacatgaggacaaatcttcctaatcttagatttggcaatagattcctagatataacaccaaaaacacaagcaataatgaaaaaacaatagatagatttgacttcataaatattaaaagtgcatcaaaagacactatcaagatagtgaagataaagaacccacagaatgggagaaaatacttgcaaatcataaatctgatggggtcaaatattcaaaatatatttaaaaactcttaaaatgtaagaaaaagaaaaaaaaggccaggcatggtggctcatgcctgtaatcccagcactttgggaggtcaaggcgggtggatgacttgaggccaggagttttagaccagcctaaccaacatggtgaaaccctgtctctactgaaaatacaaaaaaaaaaaaaaattagttgggcatggtggcacatacctgtaatcccagctactttggagactgagacaggagatcccttgaacccaggagacagaggctgcagtgagctgagatcacgccactgcactccagcctggatgacagagcaagactctatctcaaaaaagaaaaaaaaataagtaaaaaggagatctatcctcttagcaaatttcaagcacacaggacagcactgttaattctagtcacattgctgtacattagatctccagaacttattcatcttgcacaactgaaattctgtaccctttgaccaacatctcccaatttcccccatccctcagcctctagcaaccaccatgctacttttggcttctgtaagtatgactattttagattccacatataagtgagatcatacaatatatgtctttctgtgtctggcttatttcacttaatataaaaatgtcctccatcttcattcacattgtcataaatggcagaatttccttcttttttaaggctgaataatgtttcattttctttatctattcatccattgagaaatatatcatggtccagcaatcccacttctagatacatatccaaaggaaatgaaatcagtacctcaaagacatatctgcactcccatgttcactgcagtaatattcacaatagccaagatatggaaacaacctaaatgtacacagcatattctgattcatttcacttgctcttcaccattttcatttaagttagagctgaactctgtgctagaccctatggatgcaagaagaaaagactgacaagtccctgcctacagcttacagtccagggaactccaggaaattcgctattgtgcttcagtagacaggaactaagatcccaccataagactggccccatcccagttccagggatacacagacagggagcagacaagctgcctagtctagtgcagaagacagatagaaagagagactgacttgcccattcactcactgtattatatcttgaaggctctcatgatcatgtgaacagggctcagggaacacagaaaaagagcagcattctgtctgggagaatcttcacatttacactgccatggaggagaaggaagatttatttggctggttgtgggaaggaacaagggcattctgggcaaagggatgagcaagatcaaaagctcagaaacatgaaagttcagggcatgctcaaggcaagggatggcatatagggagtcatgattagggtgaagaaagatggggaaggggatagaaagactggttagagcttgattataaagggcaggctaaagagtttaaactttttcctgtaggtaatgggaactgccttgtatgaggaaagaaggatgagaccaaaggttttacaagaggaaataacaggaacaagtcatgttttgggaagataactggcagaaaggtagagaaagttctacttagtcaggcccattcttagcaagaaaatattgatgatgatgatgatgatgatgatggtaacagtgatgttggcaattgacaattctgaacatttacaatgtatgaggactgctaagtttttcataagcatcatctcattttatcctcacattaatcatataagtaactatatgatggaggtattattgttattatccccagtttactatacataaggaaacagatacagaacaattcaaatacttgtctaaggacacaggtagtgtgagactgaaccaggactctagccgaggttgttctaatcctaaagccttttgtcctattcaccaggctacactgccttctcactgcaatttcttgcaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaaggtaagtcccattgcccaagagcacagaacacctggacaaataaggacagcacctacttccttgctctgcctaaaacatggggagcaaaggaattattcactacttatttatctactatactttgcaggatcctgcagatctttgcaggttctacacttttctgatccatcaaaccttccaccagactcaacattatgttcaatacgagttgccagacaccacattctgctccactgtctaccaacaccagacacacattctgcttcatttactattaacactcaacttcacattctcctccattcacttttagggctaagtacaatattctgctcttttcaccattaatagtaaatactgtgtgtcagggatctccaacactaatctcatatctagagatttgatagaaagattcataggactcagcataaagttgtatttgcagctaagatttatttattttttaattttttgaattaaaaaaagacctttatattccaccctttgagttgcaattgggacaattgggagagggggaagagttggagtgggatgaagaactaggaggggctcgacggctggaggtcttgtccacttagtttttgtactggaagggctcattgccggtttcattgagaagacacgtgttgatgagggcttctgtcaccgaaaagggttcgcagtggcagaggggcaacagtcttcaaagtaacccttcttctcctggccaacagtccagggaatgtgtatgttggcactacgattggctacaccagcagaaaagtcgttgatgttggaggtttcatggaatccagctaggtgttgggctttgtccaggcctcccttgggatcataagcgtggatgtggtactggtgccactgcttagtttctcgatggcctcctcagtgtacttcagaccattctcctcccacatggccttggtgctgaagttggtatggcagcctgaacacttcctgttcccaggaatgggcttgggatcaaaggttgctatcactccaaagtcttcacatacatgatgcaaaatgaaacagcccacccagaaatgatctcccatgctgattctttcacagggtccggtttgaaattcccactgggcaggcatgacctcagcattagtacccaccatcttggctccagcatacaagcaggcctggtaatgggcctccacgatgtccctgccatgggctttgcctgctcccacactgcagtaatatggaccctggggtcctgggaagccattggaaggccaaccaaagtggtacccatctgtccccatgagggtatattcctgctccatgccaaaccagggtgctggttgctcaccatgtccattatccacttacaagtgtgcctcaaattggtcactgcaggctttcggttgtactcgaaaacttcacagaacaccagcttgtagggtccttactgaaggtatcccaaaacatggcaggaggcatgaaatgcatgtcactgttggagccttcagactgtaaaatactagagccatcaaaattctaggctaggcatggtggctcatgcctgtaatcccaggactctgggaggccaaggcagttggatcacctgaggtcaggagttggagaccagcctggccaacatagtgaaaccacgtctctactaaaaatacaaaaaattagctgggcgtagtcacacacacctgtaatcctagctactcgtgaggctgaggcaggagaatcgcttgaacctggcaggccgaggttgcaatgagctgaaatcatgccattgcactccagcctgggcaacaagagtgaaaactccatcagaaagaaaagaaagaaagagagagagaggacagaaagaaagaaagaaaaaaagaaagaaagaaagaaagaaaagaaaggaaggaaggaaggaaggaaggaaggaaggaaggaaggaaggaaaggaaaggaaaggaaaggaaaggaaaggaaaggaaaggaaaggaaaggaaaggaaaggaaaggaaaggaaaggaaaggaaaggaaaggaaacgaaaggaagaaaggaaggaaggaaggatggaaggaagggggagagagagagaaagggagggagggagggaaagaaagaaagaagagagagaaagaaaggaagagagagagagagaaagaaagaagggaaggaaggaaggaaggaaggaaggaaggaagaaaggaaggaaagaaagaaaagaaagaaaagaaagaaagaaagaaagaaagaaaagaaaagaaaagaaagaaagaaagaaagaaagaaagaaagaaagaaagaaagaaagaaagaaagaaagaaagaaagaaaagaaaagaaataaaaaggaaagaaaagaaagaaagaaatcccactcaggcaactcttccacacagttgggctcactgtccagagtctgggtcttgcagcgccatccttctccagtaccatcgatccagacatacatggcctggactttctcaccctgagacagggacatgtacacctgcttaatacctttgtttaagtgggaatgtgctgaggcggtcatggtggaaggtgttctgggcgctgagcaggcgggcgggtaaaggtaggccatgagagtgaggtgaggagaggagaggagaggagaggagaccgccgtgctgctcacacactccgctcttctcccattctcagctctccacagctaagatttattacagcaacatattcagaagatacagctagctcatcagggggaaagaacataggcagagactagaggaatccatgtgcaggcttccttactctcccgctcccatgaggggtcacacagaatgcactcttactccagcaacaacaatgcagacacgtgtgtgctgtgtttctgccccaaaagacagaaacacagaaactcttagtcaggcatggtggcccgcgcttgtaatcccagctactcaggaggctgaggtaggagaatcacctgaacccgagaggcggagattgcagtgagccaagatggtgccactgcactccagcctgggcaacagagtgagactccatctaaaaaaaaagaaaaagaaaaacagagtctgctctaagattcattagaggactcagcgtgccatgttttaactgggggctggtcacatcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcttgcattctgcttaattcactttttttttttttttgagacgaagtctcactccgttgcccaagctggagtgcagtggcactatctcggctcactgcaacctccaccctccacctcccgggttcaagcgattctcctgcctcagcctcccgggtagctgggactacaggcacgcgccgtcatgcctggctaatgtttgtatttttagtagagatgggatttcactatgttggccaggctggtcttgaactcctgacctcgtgatccacccaccttggcctcccaaagtgctgggattacttaattcagttttaacgctaaacataatgttccgtttcacttacggttaatgctagacaccatatactcctccattcacccctagttgaggtacaacattctgttcccttcactattaatacttgatacttcattctacttcactctcttttaatgctacatgctgcattctaccacattcactattattgtttgagtcacattctgctctattcactcaacaatagacacaatattctgctctattattaatgccagacaccacattgtgcttcctttagccttctgctaaaaacaatgttttgcaccatttccaattaatgctgcttaacattctgttttgatatagaaaagttgaaagaacatacaataaacaccctcacaccctttacccagattcaccagtcatcattttcccacatatactgtcttagtttaggtagacagatggataaatagatagatagatgggcaggtaggtaggtagatgcaatttttgctgaatcaacaaagacatggcaattcacctcaaaataaggaaggagaatcacaatgacattatcacatctttaaaaattaacattaactcaatggttattattgagttagaaataattcaatttgaaataattcaataatatcatctaatacagaaactttatttaaattctcccagttgtcaaaaaagtcatcagaaaatatgatgagggatccaatcaaggatccaattcatattgcacacagttgctctattttgtctcttttaacctagaacagtctcccagctgttttttgtttttcatgacactgactattccattaacttttaacgtgagacacaacattctgtttcatttgccatcagcagtagacaccacactctcctctattcacccttagaacaaaactcgacaatatgctctctgcagcattcacactagacctcaaattctgctacattcactacaaatgcttgaatccacattctctgatcactattaacacctgacaacacattctgctgtgtgcaattgtagcagcagacataatgttctgctttcttttccttatgttagattcaacattctgctccactcactattaatagttgatgccacattcttctctacctatggtttacactagactcaacattctgctgcatttgtggttaaaaatatttggctccatatgttattaacactcaactccaccttccccttcattcatactttttatttatttgcctttttaagcattagatttagttccttttagtatattcacaaagttgtacaaccctatctatacaactgcctatagatagtatctaattccagaacattttcatcacccagaaagaaaatccataccctccaacagtcactcctcattccccactcccaagagcctctggtaacaataaatggatacttaactacctgtataaatttgccttttctggacatctcgtataaatggaatcatacaatatgtggccttttacgattggcttctttcatttagtgtaatgttttcaaggttcatccatgctgtagaatgcatcagtacttcattcctttttatggctgaataatattccatggtatagatatatcacattttgttatccattcagcagttaggcatttggtttattttcactttggctattataaataatgctgctgtgaacatctgtgtacaagtttttgtgtggacatgtttttaattctcaaaggtatatatctagaagtgaaactgttgtgtcacatgttaactacatgcttaactttttgaggaactgccaaactgttttccaaagcagctataccattttatgatcccaccagggttccaacgtctgcacatcttcacaaacatatattattatctgttttttttaactatagccatttagtgggtgtgaaatggtattgcattgtggttttgatttgcattttgctaacgaataataatgctgagcattgtttcatgtgcttattgatcccttctgtatcttctttggtgaaatgtctgcatttctgctccactcactattaaaatcttttgctcacttttgttatttgtcttattgagttgtaatagttctttatgtattctggattttagacctttattagatataggatttgcacatattttctcttgttctatgtgccgtggtttagattcttttcccttccaaaccttgtattaaaatttaatccccaacattggagaagggtcctaatggaagtgtttggatcataggagtggattcctcatgaatagattaatgccttctcttaggggtgacttctcactatattcattgtttaaaaagagcctggccacaggtaatacacctatgtaacaaacctgcatgttctgcatatgtatcccaagacttaaaataaaatttaaaaataaataaaattttaaaaaatgatttttaaaaagaacctggcgtctcccacccacttcttgcttcctctctcaccatgtgatctctgcacatgatggcttcccttcactttctaccatgagtggaagcagcctgaggccctcaccagatgcccaatcttgaacttttccagacatcagaattgtgagccaaataaaccattttttctttataaattatcccatcttagatattcttttgaagtaacacaaaatggactaagactctatgggttttcttttcacttggttgatagtatcatttatgctcaaaagtttttaattttgataaagtctaatttatctgttttttcttttgttgcttacgcttttggtgtctttttttttctttttcttttttttttttttttttttgagatagagtactactctgtcacccaggctggagtgcagtggcacaatctcagctcaccgtaacctctccctcccaggtgcaagagattctccagcctcagcctcccgagtagctgaaattacaggcatgcaccaccatgcctggctaatttttatatttttagtagagatggggttttgtcatgttggccagcctggcctcgaacttctgacctcaagcaatctgcctgcctcagcctcccaaagtgctgggattacaggcgtgagccactgctcctggccttggtgtcattttttagaaactattgcctaatccaaggtcatgaagattaatacctgtattttcttctaagagtttcatagtttatctcttatgtttaggtctttggcacatttagatttatttatatatgtgatgtgagggaagaggtccaacttcattttttttttttaagacatagtctcactctgtcacccaggctagagtgcagtggcatgatcttgactcactgcaacctccgcctcctgagttcaagcgattcttctgcctcagcctccccagtagctgggattacaggcatgcaccaccacacctggctaatttttgtatttttactagagaaggggtttcaccatgttgtccaggctggtctcaaactcctgaccccaggtgatctgcctgccttggcctcccaaagtgctaggattacaggtgtgagccaccgtgcccagcccaacttcattctttcacgtgtgaatatccagttgtcccagcaccatttgttgagaagagtattcttttccctgttgaattgataccctcgtcaaaaaaatcaactgacctataaatggactggcttacttctggactctcaattctattgcattgatctatgtgttgatccttttgnnnnnnnnnnnnnnnnnnnnttggaagtgtgagtcctccaactttgttctactttttcaagaattgttttggctactctctgtctttttcatttgaacacaaatataaattttagaagcagcggccaggcatggtggctcacacctgtaatcccagcactttgggaggctgaggtgggcagatcacaaggtcaggagatctagaccatcctgactaacatggtgaaacctcgtctctactaaaaatacaaaaatattagccaggcatggtggcaggtgcctgtagtcccagctactcaggaggctgaggcaggagaatggcgtgaacccgggaggcagagcttgcagtgagctgagatcgcaccattgcactccagcctgggagagagagtgagactccatctcaaaaaaaaaaaaaaaaaaaaaatttagaagcagcttgtcaatttttgaaatgaaaaaaatagctggagttttaataaagaatgcattgactccatggaccaatcaggggagtattgccatcttaacaatattatgtcttccaattccatcaacatgggatttcttctcatttatttaggtcatctttaatttctttcaaaaaagatttctagttttcagtgtacaagtcttgcacttattttgttaaattatataacaggtgttgtacagatatattcttttatgctatataaattgaattgtttttaagtttaatttttaaattattcattctagtctatagaaatacaattgatttttgtatgttcatcttgtatccaataactttcctgaactcatttattaactctaggtcttttatacatccttaggattttctttatacaagaccatgtgatgtacaaatagagatggctttatttttttctttctcacctagatgtcatttatttctttttctcaactaatttccctggctagatctcccagtacaatgaagaatagaagtagtaagaacagatattcctgtctcattcctggtcttacagagaaagctttcagtttttcactgaaaactgaggttagctgtgggttttacatagatgccctttacagtttgaggaagttttctattcttaatgtgtggagtatttttaccatgaaagctgttgaattttgtcaaatcctgtttctgcatctatttagaggatcatgtgatatttttcctttattttattcatatggtaactgatttttgtatgttcaactaacattgcattcctgggatacatcccacttactcataacgtataattctttttcacatgtcactggatttggtttgctagtgttttcctgagagttttttttttttgtctgtattcataagagatgttgatacgtagttttctttattgtgatgtctttggtgttgttatcagggtaatacttgcttcttagaaagagttgggaaatgttctatccacttccacttctctgagagtataagaaggatttgtgtgaattctttaaatgtttggtagaattaatgaaagaagccatctggtcctggacaattctttgtcgaatttttattactaattcaatctccttacatgttatgtgtgtattcaaagtttctattttttttttttttttttttagatggagttttgctcttgtcatccaggctggagtgcagtggcacgatctcggctcacggcaacctccaactcctgggttcaagcaattctcctgcctcagcctcccaagtagctgggattacaggcacacgccaccacgctcagctaatttttgtatttttagtagagatggggtttctccatgttggccagactggtctcaaactcctgacctcagatgatccacccgtcttggcctcccaaagtgctgggattacaggcatgagccaccatgaatggcctctatttctttctgggtcagtgtctttttaggaatttgtccacctcatttaggttatcaaatttattggcatacagttgttcaaagtattcccttataatcctttttatttctgtaaagtcaatgataatgcctcctctttcactcttttagtaatctgattcttccctcattttttcttgaacagtatagttagaagttattcaattttgctaattttttcaaagaatcaacatttggtttcattgattttctctattatttttctactgttctacttattaccattccaatctttattattttcttccttctgcttgctttgactttagtttgccctcctagtttcttaaagtgcaaagttattgatttaggacctttcttctttttaaaataggtgtttacagttatacacttccctctaaaaatgattttagctgcatctcattagttgtagtatgttgtgttttcaattctcctcagagtattccttaatatatcttttatttattctttgatgcattgtttaatttattgttgtgagttttccaactttcttttggttattgatttttaatattccattgaaatcagaaaacatattttgtatgatttcaactattttaagtttgagacttgttttatgcataatagtatggtttattctgaaaatactccatggtgcacttcagaagaatgtacattcttctgttactgtgtggagtgttctataggtgttctttaggtctagttggtttacagtgtcaattaagtttttcatttccttggcaatcttctaattattctattcattataaaaagcagggttttgaagacaccaagtattattgttgaattatctatttattgcttcaattcaggcagttttgcttcatatattttggggctctgttgttagatgcatagatgtttataattgttatatttcttgatggattgactcatttattatcaaatgctcttcatctcttattaacaatttttttttcttaaagactggtttgtttgtgggttttttttttttctgatgttggtataatcacctaaaggcctcttttggttactgtttacatggtatgttttttccattcttctacttttatcctagttgtgtctttgaatctaaagtgtatcttttatagacagtatgtagttgcattttattttttaatccagtctgacaatctctaactttcaattagtttgtttagtctatttccacttaatttaattaatgtaataaaaaatgcgatttcgtataatttacatctgccactgtgttgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtgaaatcccatctttacaaaaaatacttttaaaaaattagctggatggaatggcatacagctgtagtcctagctacttgggaggctgaggtgggaggactgcttgaaccttggagattgaggcctgcagtgagccatgctggcaacactgcactccagcctgggtgacaaagcaagacactatcaaaaaaaaaaaaaacagtattttctagcgtgtcatcttaattccctggtcatttcttttactatttttttccagttatttttttcatgattgccctgaggattacaatttcatcttattttagaaacatctaattcagattattaatactaacttaattacaacagtgtcttagtttacttggactgctaaaagaaatgccacagatttggtggtttaaacaataaaaatttatttttcatagttctgaaacctgggaagtccaaaatcaaggtggcagctaattcagttgctggtgaaggttctttttcaggtttgcagatgaccactttcttgctttgtcctaacatggtagagaaagagttctggtatctcttcttccctaaatcctattgaattaaggccccacctgtaagatctcaccctaaagatctcacctctaagatctaaccctaaccctaaccctaagtctaacctaatcacttcctcataggccctgtctccaaatacagtcataatgggggtaaggacttcaacatacaaatgctaggggcacacaaatattcagttcataacaaacagtacgcaaaaaactttgctcctatatatatctcaattacctcccccttcctttgcactattatcatacaaattacatcttcattatatgttgattaacacaggtttacaatcattgatttactcaactgtcctttaaatcagataggagaaaaaagttataaacaaaaactgcattttttatattgtcttgaatatttacctatgcagttacctttactaatactccttatttcttcgtatgaatttgagttactgtctagcatccttttatttcagcctaaagggcgtcctttagtatttcttgtaggacagatctgctagcggaagtctctcagcttttgtttacctaaaaatgtatttttcatttttaagggatacagaattcttgagaaaaattggcagtcttttcctttcagcactttgaaaatgttatcccactatcttctgtacccgatggtgttaatgagaatacaactgttaatcttatcaagaatcccttgtacaaaaggagttgcttctcttttgctgttttaagattctgcctttgcaggagaatttcttgaacctgggaggtggaggttgcagtagcagagatctagccactgcactctagcctgggcaacagagcgagactccatctgaaaaaaaaagattctgactttgtcttctgacattttgattaggatgtgtctaggtgtggatctctttatcttacttggatttccctgtgcttcttagatgtatagattactatttttaatcaaatttgataagttttcaggcactatttttttaaatattctttctgtctccactgcaaattcctattaaacattatgttggtgcattacatggtttcccacaggtttctggggctgtttatttttcttcattctgttcctcagaccatataatctaaaattcactgattcttctttaagtttcctgattcttctgtcttcttaaatctactgttgattccatctagtgaagttttcatttcagttattttacttttcaactccagaatttctatttggttcttctttatcatttctttttttgagaaggactctcactctgttgcccaggctagagtgcggtgatacgatctcggctcactacaatctctgcctcctgtgttcaagcaattctccaatcttagcctcccgagtagctgggattacaggcatgcaccaccacacctggctaattttttctatttttagtagagacgaggtttcaccatgttggccaggctggtctcaaactcctgacctgaggtgatctacctgcctcagcctcccaaagtgctgggattacaggctatcatttctctttattaatatgctatatttggtgagacactgctctcatattttcctttagttgtttagacatagtttcctctagtttgttgaacatacttaaaataactgatttaaagtctttgtctattaagtccagcatctgggcttcctcagggacagcttcttttgactacttttctccctatgtatgagccatactttcctctttctttgcatgtcttagaatttttgttaaaaatggacattttatttaagttctgggatacatgtgcagaacatgcaggtttgttacataggtatacacacgtcatggtggtttgctgcacccatcaacccatcatctacgttaggtatttctcctaatgctatccctcccctagccccctaccacccaataggccctggtgtgtgatgttccctgccctgtgtccatgtattctcattgttgaactcccatttatgagtgagaacatgcagtatttggttttctgttcttgtgttagtttgccgagaataatggtttccagcttcatccatgtccccacaaaggacatgaactcatcctttttatggctgcatagtattccatagtgtatatgtgacacattttctttatcagtctatcattggtggccatttgggttggttccaaggctttgctattgtgaacagtgctgcaataaacatacgtgtgcatgtgtctttatagtagaatgatttataatcctttgggtatatacccagtattgggattgctgggtcaaattatatttctagttctagatccttcaggaattgccacactgtcttccacaatggttgaactaatttacattctcaccaacagtgtaaaagcattcctatttctccacatcctctccagcatctgttatttcctaactttttaatgatggccattctaactggcatgacatggtatctcattgtggtttttatttgcattgctctaatgaccagtggtgatgagcttgttttcatatgtttgttgactgcataaatgtcttcttttgagaagtgtctgttcatatcctttgcccactttttgatggggttgtttttcttataaatttgtttaagttctttatagattctgaatattagccctttgtcagatggatagattgcaaaaattttctcccattccgtaggttgcctgttcactctgatgatagttttttggttttttgttgttgttgttgttgtttgctgtgcagaagctctttagtttaattagatcccatttgtcaattttggcttttgttgccattgcttttggtgttttagtcatgaaggctttgtttgggcctatgtcctgaatggtattgcctaggttttcttctagggattttatggttttaggtcttacatttaagtcctcaatccatcttaatttttgtataaggtgtaaggaaggggtgcagtttcagttttctgcttaaggctagacagttttcccaacaccatttattgaatagggaatcctttccccattgcttgtttttgtcaagatcagatggttatagttatgtggcgttatttctgaggcctctgttctgttccgttggtctatatatcagttttggtaccagcatcatgctgttttggttactgcagccttgtagtatagcttgaagttgggtagtgtgatgcctccagctttgttctcttggcttaggattgtcttggttatgtgggctcttttttggttacatatgaaatttgaagtagttttttctaattctgtgaagaaagtcaatggtagcttgatggtgatagcaatgaatctataaattactttgggaagtatggccattttcacaatattaattcttcctatccatgagcatggaatgttcttccatttgtttgtgtcctctcttatttccttgagcagtggtttgtagttctccttgaagaggtccttcacatcccttgtaagctgtattcctaggtattctattctctttgcagcagttgtgaatgggagttcactcattatttgggtctctgtctattattggtgtataggaatacttgtgatttttgcacattgattttgtatcctgagactttgctaaagttgcttatcaacttaaagagattttgggctgagacaatggggttttctaaatatacaatcatgtcatctgcaaacagatataatttgacttcctctcttcctatttaaataccttttatttctttctcttgcctgactgccctggccagcacttccaatactatgttgaataggagtggtgagagagggaatccttgtcttgtgctggctttcaaagggaatgcttccagcttttgctcattctatatgatactggctgcaggtttgtcataaatagctcttattattttgagatacattccatcaatacccagtttattgagagtttttagcatgaaggggtgtggaattttatcaaaggccttttctgcatctattgagataatcatgggtttttggcattggttctgtctttatgatggattatgtctattgatttgcatatattgaaccagccttgcatcccagggatgaagctgaattgatggtcatggataagctttttgatgtgctgctggattcagtttgccagtaatttattgaggattttctaatcgatgttcatcaaggatattggtctgaaattctctttttttgttgtgtctctgccaggttttggtatcaggatgatgttggcctcataaaatgagttttggtatcaggatgatgctggcctcataaaatgagttagggaggagtccctctttttctattgtttggaatagtttcagaatgaatggtaccagctcctctttgtacctcttgtagaatttggctgtgaatccttctggtcctgggctttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcaggtggatagcctgaggtcaggagttcgagactagcctgaccaacatgaagaaaccccatctctactaaaaatacaaaattagccaagcatggtggcgcatgcctgtaatcccagctactcgggaggctgaggcaggagaatcgcttgaacccaggaggcggaggatttggcgagctgagatcgtgccattgcactccaccctggggggcaacaagagcaaaactctgtctcaaaagaaaaatatatatatatatatccctccatccctttattttgagcctatatgtgtctttgcacgtgagattggtcttctgaatacagcacactgatgagtcttgattctttatccaatttgccagtctgtgtcttttaactggggcattttgcctgtttacatttaagattaatattgttatgtgtgaatttgatcctatcattatgatgctagctggttattttgcccattagttgatgtggtttcttcatagtgtcaacggtcttcacaatttggcatgtttttgcagtggctggtaccggttgttcctttccatgtttagtgcttccttcaggagttcttgtgagacaggcctggtggagactaaatctctcagcatttgcttgtctgtaaaggattttgtttctcctttgcttatgaagcttagtttggctgggtatgaaattctgggttgaaaattcttttctttaagattgttgaatattggcccccagtctcttctggcttgtagggtttctgccgagagatccgctattagtctgatgggcttccctttctgggtaacctgacctttccctctggctgcccctaacattttttccttcatttcaacctttgtgaatctgacaattatgtgtcttgcggttggtcttctcgaggagtatctttgtggtgttctctgtatttcccgaatttgaatattggcctgtcttgctaggttggggaagttctcctggataataccccgaagagtgttttcaacttggttccattctccccgtcactttcaggtacaccaactgaacgtaggtttggtcttttcacagagtcctgtatttcttggaggctttgtttgttccttttcattcttttttctctaatcttgtcttcatgctttatttcactaaattgatcttcaatctctgatatcctttattccgcttgatcgattcagctatcgatacttgtgtatgcttcacgaagttcttgcgctgtgtttttcagctccatcaggtcatttatattcttctctaagcttgttattctagttagcaattcctctaaactcttttcaaggttcttagcttccttgccttggattagaatgctcctttagcttggaggagtttgctattccccaccttctgaagcctacttctgtcaatttgtcgaactcattctctgtccagttttgttcccttgctggcaaggagttgtgatcctttggaagagaaaaggcattctggtttttggaattttcagcctttttgtgctggcttttcctcttcttcatggatttatctacctttggcctttgacgcttgtgaccttcaaatgggatttctgtgtggatgtcctttttgttgattttgacgctattcctttctgtttgttagttttccttctaacagtcaggcctctgagctgcaggtctgctggagtttgctggaggtccactccagaccctgtgtgcctagttatcaccagtggagactgcagaacagcaaagattgctacctgttccttcctctggaagcttcatcccagaggggcacctgccaggtgccagccagagctctcctgtatgagttgtctttccactcctgcagggaggtgtctctccatcaggaggcacaggggtcagggacccacttgaggcagtctgtcccttagcagagctcgagtgctgtgctgggagatccactgctctcttcagagctggcaggcaggaacgtttaagtctgctgaagctgctcccacacgctgtcccttcccccaggtgctttgtcccagagagttggtagttttatctataagcccctgactggagctgctccttttctttcagagatgctctgcccagagaggaggaatctagagacacagcctggctacagaggctttgctgagctgtggtgtgctccacccagttcgaacttcctggcagctttgtttacactgtgagggggaaaccgcctactcaagcctcagtaatggtggacactcctccccccaccaagctcaagtgttccaggtcaacttcagactgctgtgctggcagcgagaatttcaagccagtggatcttagcttgctgggctccgtggggatgggatctgctgagctaaatcacttggctccctggcttcagccccctttccaggggagtgaatggttctgtcttgctggggttccaggtgccactggggtatgaaaaaacaaaactgcagctagctcggtgtctgtccaaacagctgcccagttttgtgcttgaaaaccagggccctggtggcacaggcacccgagggaatctccttttctgcgggttgcaaagacactgggaaaagagtagtatctggggccggagtgcaccatccctcatgacacagcccctcagggcttcccttggccaggggagggagatccccaaccccttgtgctttctgggtgaggtgacaccccactctgcttcagctcaccttctgtgggctgcacccactgtctaaccagtcccagtgagatgagctgggtacctcagttagaaatgcagaaatcactcgccttctgcattgatcttgctgggagctgcagaccggagctgttcctatttggccatcttgccagccaagtttggacattttaataatataatgtggcaactttgaaaatcaaattctaccctctcttcaggatttgttgctgttgctattcagtaacttttctgaattaattccgtaaagttcgtattatttgttttgtgggactactgaagtctctgctcaggttggtagtcagctaaaaatcagacaaaggtttcctaaatgcctggaaactataagtctcctagcctttgccaaggggctctctaccttaaacattctgtgaggcagtttacaactttgactcaggctccacttcctgcttgctcagactatcaaggttagccaaaggtgagagcctagagccatctcaagtcttcccgggaattcacacagctctaagcttgcacacagtttcccaagaatatgtcacagctttccaaagccccctataaacaactcattacccagcttttctttttcagctttttgattaacctattattttgccccaactgcctcaggtggcaattactattgattgcttttgaaaaatgtcctcaaagaaaaggttgttcacacggggcaaacttcaaatcaggtcaaagacagccttgtgagtggcatctttgagggaaccatgagatatatcaaatgatgataactctctgggaatgaggcattgaagaagctccaactgtgttctgctccatccaatggcttccagacagctgttggttttcaatgctactatggagctggatagattatgacaggaatagggcaaaacaccacaaagctccaagggaaatgaaaatacatgtctgtgcagaaacttgtacatggttgtttatagcagcattactcacagtagctaaaaggtagaaaatttaaatatccattacctgattaatggataaacagaatgttgtatatccataaaacagggtattattcagccataaaaaggaatgaaatactgatacatgttacgatgtgaatgaaccttgaaaatatgctaagtgaaagaggccaatcataaaaagccacatattgcattatttcattcatataaaatatggattagtggttgtttatggctgggggaatagagaggtgacagctaaaaggtaacatttctttttgaggtaatgaaaatgttctaaaattgactgatgatgatgattgcacatatgtgtgaatattctaaaaatcattaaactatacactttaaatgtgtgaattgtatggtatgtgaattatatctcaataacacttttaaacactgccacaaagcttgctgttcttattaagattcagctgattttcttgaataaatgttcacaggactgatataagcctttggtaattagtggagttctgaaagttggcactgacaattttttccagtgttctcattaattttttggaggaattttcaggtccttacgatgccatttttgctgacatcctccattcacttttaatgctcactacaacagtttgttccaatcacccttaaatgaaagacagcattctgttctaaatgataatgctaaatataccattgtcttctcttcagtactgtcataggtaccataatctatttacccccaatattctttccagtctgtctgatgcatttcttttctgttttcctctatacctccaccctaatatcccagctgagaagcagacagcagtgggtgatgtggggaattaccgaagagcagaaaatattccgccatgcttaatgttttacattcccctgctttcacctccctgtttctcctccacccccactctaggtgtcctatgtgaaagccattgacatttggatggcagtttgcctgctctttgtgttctcagccctattagaatatgctgccgttaactttgtgtctcggcaacataaggagctgctccgattcaggaggaagcggagacatcacaaggtaggcctttgggtcactgcctaaggagggacagctgttagtaaacaaaagagttctaagcagtattgtcttgtgttatttgtttcaatggtccatccttctcaatgtgcaaggcaggttagaaataggaattaaagacctagaggtctcagctttccctcccataaataatgccctaggtgggtctataggcagtcactcttcgaatcctaacagtaacactacagaaattatcaagttatacctaaaggcgcaactgattaactaaaagctgatggggtcaagaaaataactaactataaacctaaaagattgggaggtgtccactggcttttttctgcaagactgcattgttttaataggcttgattccagaagacaattgcaccacaaaaggtgagatcttaacgtagaatgcccaggttcaggcctttgcttcctgcctctaggaaagaggcaacaagcaagatctctgccagagtgggttctctctccatatgagggattgaataaaggaatatttgacagggcacctctgagaagttaccaacctctgttcacgaggttgtgcactgaccaaagaatgccaatggggagcatgcagcctgctggagcaaactgctccataccgtgggtccataactagttccccagaagatccaaccaccctagcttttttcttagttcttcaaacatacacacaggattttaaatatcttgttctctttccctgtactgctcttccagtgcactgtgtgtcctagcaaatgccacgttctacttgaacttaatttctaaacttctaaaaatgtatcctgatttaaaagcataaattcaatgatgtgatttttttaaagccgatctcttccaccaaatcgcaagctccataaaggcagagaccgtgtttggttttgctctgtgctatatccctggtgcctaacacaatgcctaacatatagtgagcatgcaataagtatttgttaaacaaatgaacaaagggataaacaaaagattaggttggtgcaaaaataattgcagtttttgccattaaaagcaataaagaagaagccttcagacagagagtctgaagtttttccactgacagattagggcaaccagggacccacacattatgacctgtcatagtgttgcaggtcacagtacatacctgcaatatgccaggtcctacaagctttagactgacctatttaaaatcgttgtctattaatcagtaaagctcaaaaataaaataaaacaaaacaaaatagttgtctgcccaggcgcaatgtgctgtgacaaaggaccctgcctctttagttttctttagtatgagactttgagctagcctacttgggcccaggttcttcatgtgcaaaatgcgtataaagggaaattctggtgagaattaaatcagaggatgccaaagtagctttaagttttgttcctgccgcacaagtgccaaggattaaaatgattacatatacacacatttccatcagtatgtttcttaaacatcagcaatctgattcaattaacttctggcagtttaccacagggaggaggccgacgttccaatacagaagatgtccatgggaattaagatatcaccatccttctaaactacattgaaggaggaaattgtcttgggttcagcaagccagatagaacttcttaaatgacccctagttttagttactctatattgtccatttaatacctagcctctgatgctttaaaaaaaaaaaaaaaagtctatttaagcaactggcatgatggcttgtgcctataatcccaactactaggaagactgaggtgagaggattgctttagcccaggagttccagaccaatgtgggcaacatagtgactttgtctcaaaaaaaaaaaaaaaaacagaaagaaagaaagaaactgaccaaacgtaagtatctctaggattttatttttccattttccctatacactagctgctttttgtaatttcatctgctagagacatttgttaaaaacactgatttgaaaagatcatgtccaagatattttactagcaccagcccctttgattgagcactgcacagctccagtagatgctgtttgtatggactaaaatgggaatggagcctcctgaagatatgtagtatggtgggcctatggtactttcaaaggctgcttctacgctccctaagtatctaccagtttgacacactaaaagaaaacaaacactatctctggccagataaagtgtgaataaggccactagctagatttgatcagattctcctgctctgttccctcctttgaagatacctcagcaatcaccctatccactccttccatgcaactgatgagagagacccacaatagcaaggccaagtcaccggtatcatgaggcactgatggcaaaggcaggagaggtgctaaaaaacccgaggttcttctccaaacattaaccataccaccatgagttcttatctgttcatcagtgtgtccatcctgaagcagataaaaattgtcctgcatttattagatcttaaataaaaactaagcctcatcccatggcgaaggtcaaaaactagtagccggaaggccagatttggtgtgcaaatatctgtactttggcctggagtgtttttaaaatctggacttaaggggtcagcatttaaaaaccacacttctggcttcactagaaaaaaaatcacagcatccagccacactgaatgtgcttcccataaggtattggtgcactggaactgcctttaggtagggaatgcattttccagttaataccatcccttctaaccagggatatttttcagccccaactcactttaccactcacatttctcctgcctgcctccttctatgcatttgaattaacgtaatctcattcataagggctcttaagttggcccaaatgtcagaaattacaatgatgcagaagtgagctcaccataaagaatagtttccttagagtaagccgctctggaagtgatttgtaccctagaggtgtacaagcttcttctgcagaaactctctttaacaggaagtttgcagaagggattttaagtcccagatggtgagtggagaggaactagctacatgcctgaatttctcagagcctgtgatcttggacagctttcccaactcccaccatcttcccatgttgcctcatttgttgtgcacaaagcatctggttctcgaattctctggccagcctccttaggcaaattatcaggaaaccatatctgtgagcaccagactcagcaggcatactactagcaacttccctgagctccagagtacactaccagatttcccctgctccagctctaagcagctccagatgcagttgggcatgcatttcctgccacctgctggttccaataagaatagcaagccttttaccagtcattcctagggaatttttctcccagacacaatatgaaattgataatcctctagctagatggggccttcaatccaaacctctactcctcctactcccatgtttaacagatgagaaaggcaaagaataattcacccaaagcagcataaaaagttaatttggtgcttccccctacgtaactaggtcccagtttaaaataaaaaataaaaataaaaatagaacaacaccccagctccagcaaggggagattttcattgaaatgcaatagagtcagacttagacccccttctaagtactaggtccagcaatttggctggctctccccaactcctctccttggccctggcattgaatcttctactgttgccctattcatagacaagtacttactgagcacctgtttgccaggcactgtaggtggcacatcctcttcctcctcacttttgcaatgaagatgttggacaagattcattcattttccaaggatttcttcagcatttaccatatgtctcaaacccttctggtgctaaaaatacaactccatttaaacaaacaacaacaacaaaaaaggacactaaagctggtgaagatatacaagtaaacatttgttcaacaaacatataccaagttttgagcttatgaaccagggactatgttcatatgttcagtgttgagagtgcagtgaacatgacagactttgcacggagcttataatctagtaagagacagacgctaatcaagaaattaccatacaatgtgataagagctttaaaaaaagacggagatatatacagagagcttatggagcacacagcaggagcggctagcctatacttgggagctcagagaaggcttctaaggaagaattaggtgaaagaggagttggagacaagagatggggttcagagtgtgttctaggcagggagaacaacttgcacaaaggcccagagttcaagaaaagaaccatgacattttcaaatataaggaaatatttcagtgactaaagcatagaacaccagatagaaatggcacaagatgagactgcaaaagcaggcagggtccaggttctaaggccttgtttatcatgttcaggattttaattaacctgaagtcagtggcagcctattaaaaggttctaagcaaaagatgaccaagatctgtgttataacgactcagatgggttgggtggtgggggcagattggaggctgttgcaatggtgggctggacacagtggctcacacctgtaatcccagaactttgtgaagccgaggcaggaggatctcgaggccaggagttcaagaccagactgggcaacatagcgagacccccatctctacaaacaagataaaacaaaacaaacaaatcagaaggtggcctaccctacaggagagatggagaggcaccagtgaatcctatactgagtttttctctgttggcccggtcctgcacaggaacaagcagaagacggtgttcttttcctgaaagcattatctagttgggcaatgtgagctgataaaacttcccaatgccaacattgaatcaacagctgagaccaaaacattagactctcaattcctcctcagagctcacatgcaacgataacaaagctggacatgaggagagcagacaatagtgcctccatgattcagaccagggcaagaccaccatgacctgggaaagagatgaactagaaggatcagggcagcaggcattttggtagtgagcataaggaagggacgtgagaaggcacaagagaaaatgtacaaacctggagggctgcaaagtatctggtgggggagaaggaaagcctggaaaggtaagttggagccaaatgatgaagggtcttgaatgaaaacttagtaaaaatccagaggtctgtctgaagttacaactgccagggatgtgggaacgtagaggcaggaagaagctgtggcttcccctggcttgtagaacggaagtgaggcccagagctcctgctccatcctggcccatagccatcccccttaccacccactcctgggagttattaactggggaatgggatggggaagagggcaaggaagcaacagaggcaaagcaggggatctgtccaaattgtcctctgaatttctaactaaaacccagtacaaccttgaatatgttctcaattataacctctgatggtcaaaagaaacttgtggagtagtggggagaatcttatcccccaggtagaagaaaaaatgaaataaaaatccccgagactcacagaaggaaattacttgcctatggtcatacaaccagcaattgatagagctgggacttgaacacaggtctccagactctaaaccacattcctatcccctgttttgcatctgtttcagcaggcaagtggcgcccctctataaggcagaactccccagccagccaaaaagcctccagaaacctagagtgatgcagtctggaaagcagggagaaccagataggcatggcctggcccccaagggagtgccttgcagggagggtgcctagcccctgtcttattttaagtagagccccatgttgaatctattccaggaggatgaagctggagaaggccgctttaacttctctgcctatgggatgggcccagcctgtctacaggccaaggatggcatctcagtcaagggcgccaacaacagtaacaccaccaacccccctcctgcaccatctaagtccccagaggagatgcgaaaactcttcatccagagggccaagaagatcgacaaaatatcccgcattggcttccccatggccttcctcattttcaacatgttctactggatcatctacaagattgtccgtagagaggacgtccacaaccagtgaagggtctgaaaggttgggggaggctgggagaggggaacgtgggaatagcacaggaatctgagagactaaggaagagaaggggaacggagggagggggcacacttacacaactctctctgcaatatgtgcaatagcaaaatgcagtgatgcatgaattttacaatgtggcactatttaacctcagatgggctgtgggcggggggtcaggagggacttttctaatacagcaactgagggctgggaggaaaggagggggtaagggcagggggtgggggattggggaaataatagctttcaaaaatctgtccatgggctgtgcagttttcctgtttggaaggagagcgcagtctgccccagagcagaaagaaagtaatgtaatatatgatatatattcatgcttaatattaatgcaaaaccccaaaaacaaaagatttgtttcttaacctatcagcctagtaactgcttaaatttttaaagtcacggaagtaacggacaatttttcccagagtggaaacagtcacaaataagcttgctctggtgtatgtcccatatcatacccctccaaacgccatacctgtcttcaaactgacccaggcggacacatgccaaaaagccattttgcctctgcttcaagagggctgtgtggtatgggaatgggtagtggaaatggggacaggtagagagacgagaagggagtgactaaagagacggacatttcagaggccaaggattgagaatgtaggtaaccccagctcaaccctcacatctcaaggctgaggaccacaattgcccctctctgagccctcttgcttctgtgcttcaacaacgccccactcacccttcaccagcacccagaaatggccaatgtggttttctcattatattgccaatatgcaatcttttttatggttaaaaaaagtaataatcttgaaagataatatgcagatagactgagtgtaaacaggtacttttttcaaatgactatttttttggagagtctctttggaactgcaactgagtgcatgtttgggaaggtggggtcagtggtgtgaaatatatttattatctagtggttctacagagtaaagttttaagaggtgaaagggcagtgttgagtctactgccgattaggtataaatgggtggagagagatggtaatgtggtaatgtttagaaaatgtttgttatattttgacatatcatatatcataatgtgcaaagtttggggggctgaccccgttatatttttgtaagtctgttttttttccttttaggtgctttaacatttaggaaagttagacaagtatttctctttccttttaattctgaagtgccagaattgtcctgggacaggtagggcactccagaaaaaaagaaggaccagcagacgaatttagtttgggggtggggtgggtgggcatggtcctactgacagaaatggatatcacagatgggaggtctgcaaggtggagacagcaggcctctctgtccaatgtcaacagcactatgcctgaaataatggcaccattgtctgaagcattttccctgctttggcccatggccagagtactggggttccatttctttctttgcactttagtgtctgagctttggatcaaaggtgtatgtagaatgttgagatagctgacaatcagtttgtactgaggcctggggtttcacatgtgtcttttaaaaatctccaacttaaggcaggatggaggaggagtggtaagcagagaagagacactggaagcctaacttttccctaaagcaccttcccatagaggattttctcccattcccacagcacaataactaatacaggcctaaagtagcaggtcatggcaaagatctaaagagatttacataaggaaaatgcactatgcagccaaaaaagggtttggctttgaggcttgaatggtaaaggtgtttacatccaggtccggggaaaataaattattgccttcccttctcttggcctgtgtagaccaaaaagctaaactgtattacagctttggatgatatgagatagaacctggaatctattttattaagaaatcttgggagat

SEQ ID NO: 16345 - DNA, 19787 bp, Human
gtacttatggctcaatgcagccttgacctcctgagctcaagtgatgctcccacctcagtctcctgagtagctgggaccacaggcatatgccaccacacccggctaatttttgtattttttgtagagccagggtttcaccatgtttcttagtctggtctcaaactcctgggctcaagtgatcctcccacttaggcctctcaaagcaatgcgattacaggtatgagccactgcatctggcccaggaataatctctaagatattttataaagtgagaaaagcaggatgcaaaactgtgtatactatgccttttgtttaagaaggagaggtcagggtaggaggaagacctacttttcactgtacgctactttgtgttatttgaaaattaaacagtaggtacattgggattccacctgcaaatcctacacttatccaagataacttctagtaacattggctgtggttcatttcatgcttattttaatgtaaatacacggaatgtatgtatatatttatgcaggaactacagtctggcatattttcttctcctctttaataggtctttatttgtgatctttaacagatctttataaagctgtcttctctttaaattgctgtctctaggcttagccatccccccaacccatacccctaattctctaaaacatgccgtgggtggttcgccctgtgtactgttgctttgggaaggatttccttccctcatgtccactctccgccttccctcatggcaatctagctatccctagccccagggcacagttgtacccaggactaccaagatgctaagccttgcccgtacaggacctaatgtgccagtaccctctttccctctcctcctcgcccccttcccttccatctttagggaattcctggcaggttgggtaggggatgaatggttaaggggtattttgtgagcagcggaagacccagtgccagggaggccaacagagggcctagcaattagagaatacttatatatatttttggtgcctaccatgtgccaagcaatgtattaagaagtttgcacacattacatgtattccaacaatactgcaaagtaggtttcttggagggaaccatgtgtcgttgtttgcctgaaacagtcatggtgtttgcctgttgtcctggcaaaattattaatagcatctcctttctctagcaaaaggttcagataaaaaattgtatagtgaccttaactgtccccatcttatacgtgaggatattgaggcttagagaggtaagttcatctgcccagggtcacatggctaataaatgatagggctgagattaaaactctagtcagtatggctctgctagggactgaactctgacatggacatgaattgtgtccccgcaaattcctatgttgataccctaacccccaatgcgactgtatttagagacaaagcctgtaacagggcgataaaggctaaccgaggtccagattattgccttctccccaggccgcctctcttccacaaccgcccccaccccactgcagtcagggcccttcctcctctgtcacaacagctctgctaaccctgcactatcactgcctgcgtccttcgcagcctcctgctgctgctcttccaccgctgcgtcctcgttggctggcgcttaataaaaattgactcggtgaataaatgagtgaaactgtccttttagggatggatggatgatgtcctgttcaaggcggtgcccttctctggcattccctaacacaagcttgacccgaagtaggcgttctgaaaaaggccgacagtcgatggaggccaacgcagcgcccctctcacctcctctctccgtccaggccgggtgaccacgggcccggcccgcagaaaggaggcggcgcggccggcagggatcaggactggagggggcggagcctccctcgcggccgggcccggagtgggaggggcctccgggaccaggcctctagtgcgcactctcggaagcgcagccgaacccgccctccgaatccagagaggcgctgctgacaccgccgccacaccgccgccacaccgccgctgcctcagtcatgccggtgagtggttgcgccgtccccgccacgcagacttgcagtcccgggttgcttctcggctgcacagccgcttgaccggatgctgatcttgaagggctcaggcggcggccggagccgctgttgtcccctagcttaccccacccagcccccagcttttgcgacccttcagaaaatgggatccgaagggagtttaatctgggagccaggcttcaaaacgtcggagctggaaggcctccaggggcgacaagcccacaccttccctgcgtacacagagaaacagaaccagagagggggcaggggatgggggagttggtggccagcgggaactgagacgcctagtccctgagccttcctcctggctgccctgcccgcggagctggcctgaaggagggcggtggggaggctctggacaagggagtggacccggttatttcctcacggaccgggcaggttttcagaggttcatgcttttcttaatttccctgcccactctggcctacttttcagatcaactctgggcgacactgaatggagacactttctcagcctgaacccatgagccccagagaggttcaggaacccccccgcacagtcaccagttgctcagtggctgtgtctgggaagtcagtcttagcctgcctttgcagatcactcagtcttatcacatatattgttgctcgtggcctcgttttttatataaagaattgaggcctttggcagataaaaatataaaaagcccagtaacttattccaggtcgtgttgaagttggcagagccaggattcagctccttatccttaggctccccatctctccaggcctgaccacatgggaggtgccaggcaaaagcagtcacaccggcttgggaagatgctctgatctcagttgcatcttggttagggtcatgtggtgtttagcattttcttcagggtgcctaattcatggctctgggccaggtggatacccagaggtatcccacagttgccatgtgtctttgcatcctgtctttagggagctggcaggtgagcctgaggcctcctgggcagagccactgacatctcaggtgtcatttcctgtgggtcttgccaggtgccttgagacaaatcctccaacaacaaagtatggataaggaatctgatagaatcagccctaccagttgggcaagtcagcctgtggcaatggtagaagacagtattaattgccctggggcttggggagtgaaggccaccaggattttttgtggggggtggcaatgaggaaaaggctagcttgatcatcactgtattctgtatcttctggggattttgacaaaaaaccctctggagcagatgatgggaatgaggagggcacttggcaccatgtaccacaagataacagctgaaggaaagagggtgttagtcaagggatttcctcaaaactggaaagggaagaaaaaaatatatctatatacacatactggaaggggaagagtgtgttacctgagagttttctcagacaaatgcccgagagcacagggtttggaatcccagaaacctctgaaaatctgtgccccagcttgccaactgggtgacctcaggcaagttgctttatctcactgccttgatttcctcatctgtaagatagggacaaaaactttgacctcacaggactgttgttagtattaactggaaaaatgccagtaaaatatgtcacacagccactgatatatctagtccccaagaaatggtagctcctgtgtagacgtaggacaggtgggctagagctataggcaggtgaggccgggcatggtggctcacgcctgtaatcccagcactttgggaggcccaggcgggcagatcactttaatgcaggagcttgagaccaactttggcaacatgatgaaaccctggctctacaaaaaatacaaaaaattagccagacgtggtggcccgtgcctatagtcccagctacttgggaggctgaagtgggaggattgctggagcctgggaggttgaggctgcagtgagccgtgatcgtgccactgcattccagcttgggtgacagagtgaaagtgaaaccctgtctcaaaagaaaaaaaaaaaaggaaggaaggagagagaaagaaaagaaagaaagaaagaagagaagagaagagaaaactataggcaggcagctttcaatcccattttaacaagatctcagtggttaagcattgaggttttagaggctgactatgttcaattcaggccctactcagccgaatcaccgtgagtgtgtgaactaacccctaaatctcagtttcctcatctgtcaagaagggataataataggccaggtgcggcgggtaatgcctgtaatcccagcactttgggaggctaaggcaggcagatcacaaagtcaggactttgagaccagcctggccaacatggtgaaaccccgtctctactaaatatacaaaaaaattagccgggcatggtggcggacgcctgtagtcccagctactcgggagtctgaggcaggagaatcgcttgaacccaggaggcggaggttgcagtgagctgagatcgtgccactgcactgcagcctgggtgacactgtgagactcagtctcaaaaaaaaaaaaaaaaaaaaagaatcatcccacttactgactttaaaaacctactttaaacctactggcttttaaaatctacccattttataagtctttataaaagaccccagaggccatgaggaaccagaactacccagttatgcatctggtggtagagccaatcttgagattctcctataaagaagtgattactctgtccatgaaatagattttccatcaccctcaaatttatttttgcccctcagaggtggaggaggagagcactgaactgtaatgtttatacccagaagctggtttctggcttctgacctttatactgtgggggatgggacctactccctgtagtcagcgacagaaagtttcaggtatctgttgactttaggtccttgggcagcaaaaaactgtgctccctaaaaatgtgtttctagtttcagagcttctgctgagagtcagggttatgagggctggcggtgtactttgcttttccagaaccagcaagatttccctggagcgaagaaagcctaggttcatattccatactcagtagttatttgccacatgactgcaagctacctagtgaactcttgggaacttcactttcctcctgagtgaaataagataaatagctctctttccaggctcagtgaggactaacttagatactgtacaaagataatttgacatgtaatagacaatcagtagatttagctcttatgttgatcttgcaaacccttcaaagctttggctcagtatataagtacaaaccatagatgaattgattttctgctggttatcctagagcaagactcagcaaacttttttttttacacggcaccgatagtaaacattttagtcttcacaaaccatagggtctctggtacaactactcaactctgccattctagtgcaaaagtaaacaaatgagtttggctgtagttttttgtttttgtgtttctttttttttttttttttttttggacggtgtctcgctctcttgccaggctggagtgcaatggcatggtcttggctcactgcaacctccgcctcctgggtcaagcgattctcctgcctcagcctcttgagtagctgggactacaggcgcatgccaccactaccagctaatttttgtatttttagtagagatggggtttcaccatgttggccagaatggtctcgatctcttgacctcgtgatcctcccgcctcagcctcccaaaaatgctgggattacaggcatgagccaccacacctggcccgatttgggctatgttttaacaaaactctttgtaaaacaggtagtttgtagtgtgccaatccatgttccagagcatcatcatttttttttccaaaacaatttttttcttttaaattaaatggagccatgatctcactgtattgcccaggctagtctcaaactcctgggtttaagtgattttcctgcctcagcctcctaagtagctgggattacaggcacctgccaccatgcctggctaattttttttctatttttagtagagaaacaggttttgccatgttggccagactggtctcaaacttgtgacctcaggtgatctacctgcctcagcctcccaaagtgttgagattataggcatgagccacattgcccagcctaaaaaaactttttaatagaggagagcatcatctcagactgtaatgtggggaggaatgacttgggtgtcttgttaaaatgaggattctgattccggacttctgggaagggacctgagattctgcatttctgacaggctctcaggtgatgctcatattgttgggctgaggaccacattttaaagacaagattttgtaatacttactacaaatccttctttccagaatctgttattgttgctgtctgtgaatagtcaggaaacaagatgaaaaaatcagagatgtttagaagaaaggaaagactgaccattttctttaagacagattttgcagatttggccttaataaaaggagtggtttactagtcacaaaggtcaaacagtctgcactggaaaatcgagctgcttaattcttggtcttcgtttcctctgtagagcacagtgacaatccagactcagcggtgtttagagacttggaaagagtttgagaagccacttagccactttattttcaggtttgtagttttgcctcccgttctctccccagtaggttaaaaatggggagtggcagggcccgctccacatccacagagtcagttgaggcaggtgtctgggagctgcactttccacaaggtccccagattcttcctatgcacactaaagttgaaaaaaattgagttagctaatacccttttggtatagattagggaactggagcccttctggagcagagattttgcctgtggttttctagcaagatatatcactacacccaggattccaactgaggtaatagacttcaaatattttgaagtgctccatgaaaaatgtagccattgatttttgaagggaaacaggagagacaaatggaagaaattaataatccaatagctaaccttttacccaacggaacctagtactaggctctaatttccttaatgtgttagttatctattgctccttagtaattatcccaaaactttgtagtataaaacaacaaatatatttatagtaactcacacagtttctgagagtcaggaatttgggaacagcttggcctagtggctccagctcagaggctctcataaagctgcagtgagatgttggctggagctgcattcatctgaaggcttgactggagctggagaatccacttccaacatgtctcactcacatgcttgttagctcgagggttcaatctctcactttgtggacctctccttgtggttgctggaatttctttgtaatttagtagctgacttcctctagtgcaagtgaccccagaaatggagcaagacagaagtcacagtgtcctttatgacattgtgatagcttcagaagccacataacctcacttcaagccatattctataagacacacagaccaacccgagacatgtggaatgggattactcaagggcataaataccagaggcagagatcattgaggccatcttggatgctggctaaccgtacttaaaatcctgtgttcatcccattcacaaatctagagagggactcttaccctcaattttcagatgtggaaactaaggcacagagaagtaacatattgatgatcatgcaactagtagtgccagagctggtatctgaagccatatttatctgatttcagatggtctcatttccagagattttaaaataaagtattggtataagtaatccttgtgtgaaagcaaagcaaaagatccagaagttcaaaccagccatgtcaattatccattgactcaaaaataagttttaagcacctactctgtccaggcactgttccaagtattaggaatccagtagtgaactgaacaaaacctctgtcttctgggagcttaccttcagacccttgatctgttagatatcctagagactgtagaatgtagagcttacatgaagactaggagccggggatcccttcctgcctggcctccaacccactggggaacccaggcaatcctttctttccctggacccagatgctgcctctgagaatgcggcccttggatgaaagcagaatcacctggggtaatgagtagacataacagattccccagcccagacctgctgaccagaacctgtagtttttgcaagctgtaggtgactctagtgcagaaaataattttgtggttcataagtgggcccaccagatcagcattgctcagagtatgggggcccatccctgtcagagttactggtggccctgagacaaagctcatagctcaagaatcagtgttttgaaggtaggactgggaaaaagcattttaaactagatctccaggtgattctatttactatgtgccagacactgctaaaggatttatagggatgattccattgaatacaacttgtgaggtagaaactcttagctactctatagttgaagagacgggctcagaaacaggcttctgatgagtctgatgccaaccaggtcctgcccagtctctctgtcttctgtcttgaccctgagtgggcctgtctgctggcactgtgtgggggtcactctacagggctcgggtcatggtccccctgtgtttgtttcagaagcacgagttctctgtggacatgacctgtggaggctgtgctgaagctgtctctcgggtcctcaataagcttggaggtgagtgagtggccctgagttgggtgcacttatgccatgttcagatgcatgcagatgttgcaggagagacttagggttaagctgatcataacagtaaaactaaaatatattgagtacttagcacgtgccaactactcttgttattttcttagtggcttatgtgaatcacatcatttaatcctcaccacggccatttcagatagttttttttttactagctccatgttaaacaggagacagctgaagttcagaaacattaaataacttatctgggatcacatggtcagtaaatggcagagctgggatttagccaaattaactagtactgccaggagtagctctggagccatggcagtactagttcatatgttggtcatctccagtgtgtactgcatgacacatctgagtgtcattttctattgaatttttttttttttttttttttttgagacagagtttcgctcttcttgctcagcctggagtgcaatggtgcaatctcggcttgttgcaacctccgcctcccaggttcaagcaattctcttgcctcagccttccaagtagctgggattacaggcatgcaccaccacgcctggctcattttgtattttcagtacagacggggtttctccatgttggtcaggctggtctcgaacccctgacctcaggtgatctgcccgcctcggcctcccaaagtgctgggattacaggcgcgagccaccctacgcagcctctattaaggttttttaaatggggctgggcacggtggctcacacctgtgatcccagcatttcggaaggctgaggcaggcagattgcctgagctcaggagttcccgagaccagcctgggcaacatggtaaaatgccatctctacaaaaaataccaaaaaaattagccaggcatggtgttacatgcctgtactcacagctaatttagggggctgaggtgggaagatcgcttgagcctgggaggttaaggccacagtgagcctagatcgtgccactgcactgcagtgggggcaacagagcaagaccctgtctccaaaaaaaaaaaaaaaaaaagaaagaaaaaaaggaaagatttaaaaaaaggtaaaaatttttaaaattttgtctttttctgtttctttacttcaaaaaaaaaaatttaaattaattttgaatcactcacatgcagattttttttttttttttttttgagatgaagtctcactctgtttgttgcccaggctggagtgcagtggcatgatctcagctcattgcagcctctgcctcctgggttcaggcgatttccggtgaatttttgtacttttcatagatatggatttcaccatgttggccaggctggtcttgaactcttgacctcaagtaatccgcctgctttggtctcccaaagtgctagggttacaggcatgagccaccgcacctggccacatgcagatattcttaaagcacctcttttgaacaatcagtctcatccagccttgtcattttacagctggggaaactgaggcccagagaggactgggatctggtcctgggactcagtgaggtaataactgagttgtgatcagagttttggcaatgccagtgctcagtcagccttctaagattttttcttttctttttcttccacatgaactatcacacaatcttctaaaattttcttttttaaaaccctaaataataatgacattaagttttcaaatggcttccacatggacgtgatctcattagcagtcctctgagctgtactttccatctttggaatggggatgtcgatgccagtgtccaggaggttaagtgacttgcccgtagtcccgcagcaagtcagtggctggcctctagccctgtaaactgggatcttaatctgaaagaaactgaaacagtggaaagaacctagctgctgacttgtcatgtgactgtgggcccttctttctcgggcctgggtttccccagctgtggtatgggaatgtatatcttgtatgtctgtatcagcttttgctgttgatgcttttttttttctttttctttttttttttttttggagatggagtttgctctttcacccaggctagagtggagtgaagtggcatgatctctgctcactgcaacctgctccactctgccccgggttcaagcgattctcctgcctcagcctcccgagtagctgggattataggtgcccgccaccacgcctggctaattttttttttttttctgaggcagaatttcgctcttgttgcccaggctagagtgcaatggcgtgatctcagcccaccgcaacctccacctcccaggttcaagcgattctcctgcctcagcctcctgagtatctgggattacaggctcaggccaccatgcccggctaattttgtatttttagtagagacggggtttctctatcttggccaggctggtctcaaactcctgaccttaggtgacctgcccaccttggtcccccaaagtgctgggattacaggcgtgagccaccgtgcccagcctgttgatgctttaaaaatgaaactgtacaggagctcctcaaatacaaagcagcaggctctggatgaagtggggatgggcctaatttcgtttgacagctcaaagacatctacccatcccaggaacttcatccaggctggagtgcagtggcgcggtcttggctcactgcagcctcaacttcccaggctcaagccatcctcccacctcagcctcctgagtagctgggactacaggaccacacccggctatttttttgtttttgtttttgttttttgtagagacagggtcttgctttgttatgcaggctgggaaaccatatgttttgtttgtttgtttgtttgttttgagagggagtctcactctgtctcccaggctggagtgcagtggcatgatcttggctcactgcaacctctgcctcccaggttcaagtgattctcctgccccagcctcccgagaagctgggattacaggcacatgccacacactgagctaatttttgtatttttagtagagatggggtttcaccacgttagccaggctggtcttgaacttgtgacctcaagtgatccactcgcctcagcctcccaaagtgctgggattacagacatgagccaccacgcctggccaaccatatgatttttaaggccccttgctggaagatctgcctttaagcttcggcaggtttctgcccatcttttcctactgtccctgcttgggtggcctcttgagaagggtcaggagggttttttgagttgcttatggccctaaaagaacagtggtagggctgaggaatcacagactgatggcatccttgagctggaaaggccacaggagctggccagccctgactccttcatgtacagatgaggtagctgaggcctgtgagaagcaggaccctcctcccaccgactccctgcccatggtcacccagcaagtcaatggtgaggccaggcctagaacctatcaagagttttcctttctttttgcactcttttgtcagagtaaaactctgggtcctcccatgtgctgctggggagctgtaaattggcatagccatttaggagggcgattttgcaatgtctattaaacattcaaaatgtgccaaatatctgttgccccacaatttccattctgtgaattcatggtataacaatatttttataagtgttttaagacaagttcaaatatgtttactataacattgtgatagtggtgaaaaattagaagcatcctcaatgacctttaacagtggattaattaagtggatgtgtggtacgtccacactgtggaagattgtagcttttaaaaaaagaatagggccgggcactgtggctcacgcctatagtcccaacactttgggaggccaatgcaggtggatcacctgagatcaggaattcaagaccaacctggccaacatggcgaaaccccatctctactaaaaatacaaaaattagctcagtgtggtggctcatgcctgtaatcccagccactcgggaggctggctgaggcagaagaatcgcttgaacccgggagtcaggctacaatgagctgagattgtgccactgcactccagcctgggtgacacagcgagactctgtgtcaaaaaaaaaaaaaaagaatggaccgggtgcagtggctcacacctgtagtcccagcactttgggaagccaaggcaggcggatcgcttgagcctagaagttcaagaccagcctgggcaatatgcgaaaccctgtctctacataaaatacaaaacttaaccaggcatagtggcatgtgcctgtagtcacaacaacttgggaggctgagaagggaggatcacctgagcccaggtattcaaggatacagtgatttgtgattgtgccactgcactccagcctgtataacacagtgagaccctgtctctaaataaataaataaataaaaatgaataaataaagagaaaagtaaaatattagcaagacctgtttatatagtgtgatgcgatttggaggaattatttttcatttgtctatctaggacaaagtctagatagaagccagactgttcacagtgatctctaggggcaggatcagtagggggccttactgcttctacttttatttagaaatgtttgcttttttgaaaaaaaaaaaaaaagtgtctatattacttttgcaattaaaaaaaaaaggtggctgggcacggtggctcatgcctatactcccagcactttgggaggccaaggcgggcagatcacttgagattaggagtttgagaccagcctgggcaacatgacaaaaccctgtctctactaaaaatacaaaaattaaccaggtgtggtggcatacgcctgtaatcccagctgctccaaaggctgaggcatgacaatcacttgaacccaggaggtggaggttgcagtgagctgagatcatgccactgcactccagcctgggcaacagagtgagtctctgtctcacaaagccctagtatagaacagagatcagcacatgggccaaatcctgctcacagcctgtttttgtatgttcaggaatagagttataaaaaaaatacacagaatatacaacagagtctatatgtgacccacaatgcctaaaacatttgctttctggcctgttacagaagaagtttgccgatccctgctctagaggaaagggcaagggtggttgtgagtagtaatttagagcctgaactctttcttgctgtaactgggagggtctgtgcttcctctccccataccccatttcctcttcctgcaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggtgggtaaggccccagcacttgctgaacaaacctacagctcacacctctcatcagagcgaacaccttggcctttgagagcttgagtggagcgggagagccctctgggttcttttcaatccactgtccaccttctttggagtggttacaaatattttattattgtctaatgcaaatcacaagttcagggaattcttacagaccctgtgagtggacagagcactgtgtaatgtctcccagagtcctctttcagacttgagggttgcagttcatggttagcagggtttaagtttacagtatgtgaccctaagcagtgcacctttgacttctttatttgttcattggtttgagacagtgtttcactatatggcccaggctggagggtagtaactcttcataggtgtgatcatagtgcactatagcctttaactcctgggctcaagtgatgctcctgcctcagccttctaagtaactggaactataggcacctatcaccacacatggctctggctttgataaactgactatctcatcagagttgacacttgtgccttgggccttgttctcctgtgccctgaccaagtgagttaattcagactgtgccgctctctctacttgaaactgttgtcagcttcctgagcatgccctctgtccagactggtacaaaaacaatagcatgtttgagctagatgttcccttcacttttatgtaatccagtgatgcagtaaggggcactgtgccagcactcttcgctctggaaccaggcagaccttactcattgatccagccacagtctcagcagggcactcctggctgccactgcccatgtagtgcatttgactcgtgaattacaatgatcgccacacctctgatgtggtttggtgccctgacgtgactgagaaaaatgaggccaagagaggggaagtgattcaaccagagtcccaccctggtgagtagcagaggcaggaagaaagtcagatatcctgaatcggagttctgtaactgttactggtggcattgtccctgtgaatgggcccacagagaccccctggacagaggctagccacactgactggtaggtcctctttgaggatagcctccttcccaaaggcatacatttggaacctgagtcatagcagtgttctgtgtatgtggtaacatcacatgcaagttacaagatgtcagatgcatctgttttcgtcatgcactttccatccatagatagaacccatattcaggaatgaacccaggatgaataatgaggaatctaggattctaattccaactttcctcatttcacactgactttggggactttttacattacagagatttggtcttcccatcggtaaaatggggctaaaacctccaacctgctttcctgccttgtggggactgctgtgcaatctctccacatatgaaagtttatcctctagggaagtaaaacatcagcggtttccagcatgttgaagaacagtgtttcttacatcattcctccacccctagggttttgtagggagggtgagtggatggggctttggaccctccatagctcccaaacggtcctgtgtcatattgggcttcccgtaagactgtattttataaaaacgctctgtaacaagaaggaatggaggcagagaaggaaaaaaatactcttcctgaactagctatatacatggggagccctaatgcacacatcttggattagaaactccaggcctgggcatacgaacttttttaactaaaaaagtaatatctgttggatgtaaaccatgtgtagcttaatgtgtttttctcatagaaaacatgttttctcatgttattttattgagatgaaattcacaagacataataactattttaacccatttatgctgaatattgcaaagttttttatgtgaaaaatcaaaccttggtgatgaccttgaacagtaggatataaataactcctgcaagcttagcgttccaataatggaacactaggcataaatgggttaaagtctatcatttagtggcatttggtgtgttcacaatgttgtatgaccaccatctctctctagtttcaaaattttttcatcatctcagaaacacaccctgtatccattaagaagtcactccccactacccatctctccatcccctggcagccactaatttgctttctgctactctggatttgcctaccctggacatgtcatataaaaagaattacattatatgtgacctttttgtgtctgcctttttccatgtagcataatgttttcaagattcattcaagtcatagcatgtgttgtaaatcattccttccaatacttaataattttcatggtacttttaatctactttagattttttatgataggaagtttcaaacatgtgtaagtagagtaatagaatgaatccccaagtacccgtcactcagatccaacagttagtatttatttcaccaaggcctgttattttttgataaaagtgctctgtgacaagaaggaattaaggaagagaaggaaaaaaactcttctggagctatctgtatccatgtgggggagccctaatgcacacatcttggattagaaactccactgtcctcattgtttcatctgggtgatgaaacacccagattattttgaagcaaattctagacatcatgcccactccctcctgcccagattattttgaagcaaattctagacatcatgcaatcttacctgtacatatttcagtaaccatgtattgtttggaaaggctcctggaaattcagatgcacagtactcagtaagaatcacccaataagccagctttagtccacatgctcaggcagcatgtctttgaagtctgttttaagaggctcctcagtgactgatttgaagccaggcttgggaacctcaaagatagagtgtttattggttttgaagtcaccttgatcatctgactcttggcagatttatttgccatgattttgttcattgcctttccaacctgtaacaggatagagagtgctgttgactgggtatcctggcagccctggaaattccccagaagagggctttggcagtgattggcttagcaaggttaatgcgttccagccaacctaagtataacagacttcatgggagcagtgtgcagggctggacactggggctctagtcctgctcctgcatctgcaccctgcgttttccacctcacccctgccttttagtgcaagactcttagtgcacccctgcgtcacccctgtctcttagtgcatttattgcctttgcaatgtcgctatgtccacaccagatggcacctttgttccatctaactttccatctttcctaggatgctgatcctcccgctggcttccagacagacctgggacttggcagtcatgccgggtgatggtgttcctgcggagaccctcagttgtcctattccttcctagcttccctgcaataaaatcaagctgcttttgttggagatgttgtcttgcctggtcttggtgttgcttgctcacatgtaggtggttatgcttacttgggttggagttttgagagttcccacctgggagtcagacaccctgtagattctgattctttgctgtgtgatctttagcaaatcacttcccctctctgggcctcattttttcctcacctataaagtggaggcattgacccagaacagtgatcccctttcttttcaccagtttcatagactctatattttgaaaaaatttgtctatcaagtgaattgcacaagagattatcaaatgttaagcaagtggaatagtaggaagaggctgtggagacaaactgcctgggatagagttcaagctccagtacctcctagctgggccacttaacctctcagtgtccacagacaaaatgtgatgatagcatctactgcaaatggtggttgtggggattaaatgaaatgaaacatgtaaattaattacagcagtgattgctggttaaaaaatcactcagaaaatattagtgattcatttttggctttttgtttgtttgttttgagatggggtttcactctgtcacccaggctggagtgcagtggcgcaatcagggctcactgcagttttgacctcccgggctcaagcaatactcccaccttagcctcccaagtagctggcactacaggcacatgtcatcatgcccagttaaccttgttttttttttagtttttttctagaaatggggttttgctatgttgcccaggttggtcttgaactgctgagctcaagcaatcctcctgccttggcctcccaaaggggcttgaactcctgccctcaggtgatccacctgcctcagcctccgaaagttctgggattacaggcatgagccactgcacctggctgccactcatttttaaaatatttcattagtcaaaaatctgtcaaaatggccatttgaattccagtcaggctaagtcaggctgagactagtcaggttggaatgcagtggcatgatcatagctcactgtaacctctaacttccgggatcaagtaatcctcctgcttcagcctcctgagtagatcttatatactcttaaaaatttttgaggatctcggctgggtgcagtggctcacgtctgtaatcctagcactttgggaggccgaggcaggtggattacctgaagtcaagagtttgggaccagcctggccaacatggtgaaaccccgtctctactaaaaatacaaaagttagtcgggcgtggtggcacatgcctgtaatcccatgtactcgggaggctgaggcaggagaatcgcttgaacccggggggtggaggttgcagtgagccaagattgcaccacttcactgcagcctgggtgaaagagtgaaactctgtctcaaaaaaaatttaaaaattattatcaaacagttttggttatgtgggttatactacattagaaattaaaacaggaatttttaaaacaaaaatacccaggcacacatcccattagtcattaggactagatgaagtcactgcattcctttagactctagaaaactttaccgtacaattgttaaggaggaaaaggcatcttacagaagcttttaaattgaacctcatgtgccttctgaaaggctcttgggggtcacatgttgagaatcaccactttagccatttattgggcacttactggggacccagggctgctggagactggaataagatctggctctgcatttgaccagctcagacatggaagcagccacctcatctatctcatggacagtttcctcatctgcccaatgcataattgctgcacctcggggaactgagtagccagaaataacactttatttcaactctaaactggttgcaagcataatttccatccctttctatcccattatgaaagtactaaacaaatctcagggccatttctgccttcgtggcccctccggggtgcagggactccttcccagcccaccaggtaaatgtgtttcttgaccaccagat

SEQ ID NO: 16346 - DNA, 50797 bp, Human
ggctggtctcaaacttctggccccaggtggtccttgccgcttggcctcccaaagtgctgggattacaggcatgagccactgctcctggcctctgttatgttcacttttaaaaagcaatacatagacattgttaaaagagatcaggccaggcttggtggctcacgcctataatcccagcactttgagagactgaggagggcagatcacaagggcaggagttcgagaccagcctggccaacatggtgaaacccatctctactaaaaatacgaaaattagccaggtgtggtgccgtgcacctgtaatcccagctactcaggaggctgaggcaggagaatcgcttgaacccgggaggtggaggttgcagggagctgagattgcgccactgcactccagcctgggtaacagagcgagactccatctcaaaaaaaagagatcaaattgcccagacctgcttaaagtggaaagtagtggtcctttgtttctcttctccttctcttaagaagattgttaaactttcatctgttgccctcctgagtgctcattagccagctccctacccgcttctcttatacttcccaaatcagttacatctctttttgcatttatttttacgtatcatatctttgttccttcactgtagaccctgtctcctgatatcctccacccgcattccttatccattttcaatgagatatgtgtcctgttttcctgtgtgttcctgtcttttttttttttttttttttttttgagacagggcttgccctgtcacccaggctggagtgcagtggtgcaaccttggctcactgcagcctccacctcctgagttcaagcaatcctctcgcctcagcctcccaagtagctgggactataggcatgtgccaccatgtccagctattttttttttattttttttaatagagatcgggtctcactatgttacctaggctggtctcgaactcctgggctcaaattatcctcccacctcagcttcccaaagtgccagaattataggcatgagctaccacgaccagcctgaaaaatccagtctttacagtggcctcaggcaccggtctcagatcctacatcctaccacaccactccctgctaccacaccagccacactgagctcgtggtggttcctcacttgcaccaccccgcggtgtgccccagtcgcactcgtgagatcctctgacccctccacctgggactacaccccttgtcactttcctgaccaagccttgtcttttctctgtagttcttatctcagcctgatgagtgcatttgttattcattcccattacagcataagctctagagaaacagaatttaaaaaattgctcatatttctgcatgcacagtgcccagagcaatgcctgactaggataggtgctaaatgagtgcatactcacttgttcaggaatgacagtccttcagatattgcagcaggtggttggaagcactttgagtcctatctgcaggcggtcaagctctgggttctgaagccatccttgttgacttgaaaagggggcatgcatggtgcagatagtatagactctgggatctagaaattgttgaattcagttctaagctgtgtgatcttggctcatttattgcgatgctccagcctcagtttcctctctataaaaaaggagaatctgatgtgtggaaggatttctgagagtagtaactgagacggtgctgagacaggtaccctgcctagtgtggaggagtcaaggggtcagtggtgggtcagtgccatgcccgccctcccttggggatccgcgtccctttcccatactgctgtgaatgtctggacaccatctagtctgtccattgtcttctgaaaaaaatgtgattggccttgagctgggtcattgggtctgatttaacctgaagggctgggggcagctggaaaacagcagagggaggaaatgtaagggaaagaaaggggatggttagagttggggggaatctcacatgctgtctttcttctctacagtggattctgctgcgaaccggagaccatggccaaaccagcacaggtaaggggcctctctttcctgaaggtggtactcagccttctctgggcctgggatcctcctggagccactaggcctgctacagagacccctggtaccttcagcttgaaaaaaggaggaaaggttcttaggctttgcttgctcctgttacaagtcatggctcttcagatgcaggtcaccataatgtaatataacccacaatatcctaagcagaaaaggatgtgtattggcttatctgacagagaggcccagggcttcaggtctggttgaatccaggggtttccaaatgatagtgtcaagattctgcctgtgtgagctgggcttcttccggtggcttcattcttgggtaggttcttccttgcattggcatggtagtcatcagcagctccaggcttccattctgctgtcttggcagcccagggagaaaacaacataactcatgcccagtgattccaggggaaggcccaggtctggttctcattggctgtgcctgagtaacctgttctttcttggagcaaggaggtggagttggtcccacctgaactgtttggcctgacgaagggaaatggatacttgacaggtagaaagacatccttgttgacttctctgctctggatatagaaatgttctctgtcacacccatttgggattgaatttccttggcttgggagactctaacctcagtctctcatgtctgactgttctgccgggcaatagaattggaggcacctgagaacttttactcccatgtggctgagactaggttctggccatggtcagaggtaggattctgacctcgactgtgctctgttgaggctgggcacggtgactctcacctataatcccagcactttgggaggctgaagtgagcagatcacttgagcgcaggatttcgacaccagcctggacaatatggcagaaccctgtctctagaaaaaatacaaaggtggcatgtacttgtagtcccagctgcttaggaggctaaggtgggaaactcacctgatcccaggagattgaggctgtgatgagctgagatcatgccactgcactccagcctgggctacagagcaagtctcaaaaaacaaaaaaccccactctactctgttggggtttgcctgagggtgctgtctgttggctggcgttggagaaagccatgcagtcagtgtgacgatgggattggcagggagaagaaacttggggatcttgaagaaaatcatgggactgggccccgttgtcccttactccaacccagaactactggccacagaatgcacagacagaagctgtctgtgaggtctttgggcctcctgttccccttacggaatggttgaattcagtaataataaaactccatccatccttgacatcatgactgcccccagtgaacctgggcttataggatattcacagtttctgaagagcacaggatgttataggatcagtaccctcagagaagtcctagctgtggccttcctcacagccactgaggagtatactgtgtgtacaagtggcctctctgaccaggaggagaaaatgttactgattacgggcaaaaatccaaggtggaactttcactgttccccatttcctatgtgtagtcatactagagctacttcctgaaaggcatttgaactgcaggattctagatgatccaagtggacaggccaggccctggaagatcagagaggccaggacctagggtgcagatctttggaccttggtccagtgctcctgggccatgccttctgcctggctgatctgtggtttcttgttgccatggactagggttcagtagacctcctgcaagtgagtcccagggtggcagggccttagggaaccctcctcctatgggatgagttggcaccctccatgcacagtgttctggtggggcagtaaaggagctctggggcatgcaggagggcaccccacctaggttgaggagagaggggaggctgcctagggagagctactcaggggaggaacaagggggctcagagtggtctaggcagggacaactgggacagaggctagaaggagagcaaatgcagcgtgctcaggggagtaaaagtaatttggtatgcttggggtgcagtggtttgggggagaggtgagggttgcagaagacaataacagagaaatgtgaaaaaagcctccctgccgttgagctgcagttgttccttccagttattagctcggctttcaattattagcttgaatctggtgtcctccaaaactccaacacacgcacacatgcatgcatgtatacacacgtgtgcatgcacacagcaaactgctccctcttctctggcctagacaccccccagttccttccactgtggttattgtgctgttctccctatctctccttttggaagaggagaacttgaggcccaaagacatgaagaagtaggatggtgccatggaagacccaggaggcatggcgctgtggcctccatttcacagggacgttctgggtttgaatgcaataatgaacataaaaacaccttgaggacagggcaggataggcaggtgcttgtgcctgggacttctaggagctgtggaggtgagacctaggtcagcaccggccaaggcagctctcagctggagtcctggccatgtacctgtctctctggggacatcatctctgctcccaagaggccactaggactcctgctccagcagcagcctgggtggggcccagccccacagagccccagggcccggctgctcaccagctggcaccaggacctgctgaatatttcagggtggaaagtcccttctctgctgtcccctgccttgatcctgggttcccgcagccgggaacctgtctgccggaggtgtgacaggcagtcagggtggggtgggtgaggagaagcctgtgtggttgcacaggtggcgcttagagatgcagaattcatgaagttggtgtgagaatgacacggtgggaagcctgggcctggatgatttgaggggctgtctctgtatctccaaatgtgactagtgctaagccccccacctttgcttctagtggctatgatcctgtggggtcccaggacaactaatctagtaggtcatcacttggaaggtcttattagtcccgtgcaaagaactgtgcaggagcccgagcttgctgctcaagaagcttgtctctaagtgagcgtttggatcaaggcttgtgtaggtcattaagcacccttcccccagcatggcacttcagccccttctccagacactgctgtgaccacccacattgtatgagggggagaacagtggagggggaggagcagcaataggaaattggggtctgcgtgctgcctcatcctccgcccttcatcctggggacatgcttccctcttctccgcatcccttcccggcagcttacaatcccatgactttagcgactttgggcatctaactgtgagctctgaagaatcagactctatcttaagtacttgtcaccacccacacacccctgccccagcagacaagttaaaatagtttctagatcccacatatcaaccagacaggtatttgtatgaaatacctgtcacatgaaccatatgaaatctgctgctatttgactgtttttaatctacatacaaggcaagttacatggctcaacgtagtaaagaatgccagatactagggacagggttgtgagtggtcagctgagtttaatgggtaaggaaaaccacactaggatgttagagtcttgcccttacccaggtcctgacttaggtgttgtgcccaggccagcccagcaggactagagctgcccttacaagagtctgaattgtttatccccatcatcttctccagcctcatctctttgccttccccgcttctagtggatgatcttagtgacagccagcatctgctctgagccctgcagactctgggctggctttcccgaatgccccttgcttccctccaggtctttgtcatgtgtctcctctgtgtgatgccttcttcctcttcgccttcccctccctactctactccttggggccagcctgttgctcatccctcaggactcagcttagacgtcacctccagaaagccttctctgatctgcttggaatatattcgcagtcattcatccatccatttatgaaacatattcagtgagtgcttgattgctccaggccctgtacttggtgctagaaatgtgtcagtgagcaagagagacacagtccctgccctcccggaacttcgaaaggaaatatttcctgggtcccatgctgcccttagcatcgtatccgccacactgtcttgtagttgaagctgtcatgtatctctaccagattctgagttcttagtggtccctggtcctaagcatctacttagtagactctcagtaaatgttgcttgcttgcttgattgaatgaatgaatggtagggtagccctagctgccctggaattgtgagtatctgaatgtgagaagcacttaggatgctgtggattggacagcattgctgcctttttatagccttgaatatagggtcgaaatggcatagaggcaaacagcacagggcaataactcaaatgcttcagtattcaaggagaggggcaggctggcatggttgaccaggaggaagcagtgggctatgtggtggttgtcccttcttatctccagctcccacccagatggaatctgaggggaagggagagatggtctgttagaaagagccttggattcccttcccagctgggcctctgacttgctgtgtggtcttgacatgtcacctgccctctctgttctgggtcttctgggacacaagtggtaatagacctaccttcctcatttagttctcagcttgtggttcccaaagtcctttccctctcttattccaagtgagccgtgggagggacatcctatgactgaaggggattggagactggtgctgctgtggattaggacaggttggtcagacaggtggaaggaaaaacagccatgaatcatggcaacaggctagcctgcagagggcccggacagaccctggaggacctgcccctggtggcatctttcaaagcttaatatttccacactggtcccaggaggtcctgacattggagacagcattgctagggatccagtgccagggaggtctcccttcactgtcttccccttcggcgtcctccatctcagagcttgggccgtcatgggtgtctccatccattcatttagcccagtcacagttacttccagcctgtatgccaagcctgtgctagagctggggctccacggttcttcttaggcagaatgatttgtcttattcacgacagtctccattctccatggactcaataactgagtgggaagctgaactaaaaggtctttaaggatcgttgcaaagaaataattttgagcctctgaaccttcttgtttcctttttttttttttgagacagagtcagtctcattctgtcgcccaggctggaatgcagtgatgcgatctgagctcactacaacctctgcctcccaggttcaagtgattctcctgacccagcctcctgagtagctgagattacaggtgcctgccaccatgcctggctaatttttgtatttttagctgaaacagggtttcattacattggccaggctggtctctgactccctacctcaagtggtctcccgtctagcctcccaaagtgctgggattacaggcatgagccactgtgcccaggcacctcttgtttctccatccatcctagtagctaatattgcctgctgtgcttttttgatatcgctggactggaggtgtccagaaagaaagagaaaaggatttagaagtgaaattcctggaggaccccagttgtttcgtgttcttgttcattttattcatgtggcaaatacttgagtatttggtcaatctctgtgcagtgggcagatggatctggtatctgctctcagaggtttctggatcaaactgcccaccggggtggagaaggcagcaggaatttctcaagctccggccgtgaggtctgaagtaaggccaaggggagcgctggcagtaaagcccccatcctgcgctcactgagctccttgcaaggcgccctgctctgggtattcggcatgtgttactctttaagtctctgcccaggggcgtgatcaggttgcaggggattcccaggtggcaggaagagagctgtgttcctttctggtcagaactttaaatagtaactccacgccgacgcatgcatacctcagaggagccagcctctgcagacagagaccagagagcatccagaggcctggccggggtcctgcagtgcagacgttgggaggcacggagacggggagagggggaggcggtccaggactcactctgctccacctctgactccttgaaggcaagatctgtgtggcccaccctccattccctcttttttggattctttcctgatttcccgcagctggatcagcctctgctgttttcccacattaccttatttttgtcttaatgtatttactacaagctttatagtaattgatgtgcttgtctgtctctgccactgggccaggagctcgtgaaagacaggaattgggtcccctttctccccaattcctcagccattagtgtagggcctagcacaaatgaagtgccttgtcactgtgctgtgtgctcggtgacaggctctggcatcctccactctgccagctctcagctgctctcccagaccccccacttttcagtgccatgtaactgacccacatctgacttctctgtgaaccagtcccattgtgcattcaggttcaggttcgatgtctaagatcccctggctctctgccgcttctctccttcccctcaaagaccaagccagcttgtcctcagatgccagttcacagcgcagtttactgggcccagaggggcagtgccttgtcttggcattgaaatgagagtgtctctgggccccctgtgcccaggaccccaccctcagtagctggcacctgcaaggttcctggagctggagagcagagcggggctggagagcagagggaaaaggtctgagttctgtgtgacctcccacaagtggctcttctttgggcttggcttctgtgatagaaataatcttaagagcgtctacaaatggctacactaatgacattcacagaggtgaaagtgtaaacataaaatgccataaaaatatgaggggctggctgggtgcactggttcatgcctgtaatcccagcactttgggaggccaatgtgggaggactgcttgaggccaggcattcaaaactagccagggcaatagagtgagaccccatctcttaaaatatatatataaatatatatatatatatttgactcttgctattcttgcagggatcattttcatctcctatactcagccaggcttttttaccctctcctggatgctttggaaggtggtgcagggctgcaggccttggccaagcccccctcccttggggaaatggcactgtcctttgggcgggttgcagcaggtggtatgggaaagtcatccacaccgctccccagggtgtatgtggccagcactggattttgcagggaaagcagctcagcctggaccagggtaggcatctgacctgaggttggggctgggagcttggtctcagtccggggttggcagctcaccctctacttttttctccacagggtgccaagtaccggggctccatccatgacttcccaggctttgaccccaaccaggatgccgaggctctgtacactgccatgaagggctttggtgggtgccaggcttcatgggagcttgaggggtatcccccaaatgtagacacagcccagagcccttctggtggtggtggtagggtctgtgaaatggtgaagtgcacttattcatttttttggtctcctctttttattaattttcatgatgttataataaatgtttcagaaaaaaagtataaagaataatagaaatttcacccatagatttaccaccaaatttaagaactagtgcttcattagcatagttgaagtttccttggtagatccccctcctgataatgccgcccgctgcctttgcccagaggcagccacaatccgaaggtggtgcttatgttcttctttgtcttgtggtggaaagaaccctgtactgggtgttaggatacctgggttttctaagccaggttcattgtgagaccttggacaagttcttgcccctctctgggccttaatttcctgatttgtgcagtgaggagctggatcaggggccttctgagcacagatattgtgtgtgctgtgtccactttcagtcgtgacttaataaatccccatgaccctctgccctgacaccagcacctgatgagtggaaggctcatgctgaggcctgcagggagctactaggcctgtgtccagggaaggaagtggccctggtgggcttcctggaggcagggtgggtaggatgatgattgctctcccctattccaggcagtgacaaggaggccatactggacataatcacctcacggagcaacaggcagaggcaggaggtctgccagagctacaagtccctctacggcaaggtaaccacagcaaccggagggcccatggggtgcgggtggaagaatgatttcattcacctgtgtgctcgttcaggttatttcctggatatggcactccaggttagcctgtgggctgacaccttaccctgctctttttcttctcatcagctgggcgtctttcagcctttaatacacccacagcacctgctgtatgctgggctcgtgctaggtgttagggctgcactagtgaataagatgggtgaggtgtcaactctgtggactgccagatagtgagagagatacacagtaaacgaggaaacagacagtggtggggaagtggcacagggctgtggacctgaccctgcatagccgtttgctagcagcatgacatggagtaagacctctgttgtttctgagcctgtctcttagggttggtaacagtacatacctccaagggtgatgatttaatgagattacttagcccagcacctgccagagtaagtgctcattaagtgtaattcttaccgttgtaactactcttcctctttcctcttctatctcctcttcttccccacctgccaggacctcattgctgatttaaagtatgaattgacgggcaagtttgaacggttgattgtgggcctgatgaggccacctgcctattgtgatgccaaagaaattaaagatgccatctcggtaagaagtgggggtgtatgtggtgttggggtggggatgtggttaatgggaagattctgggctcttccaaaagcaactggtgagccccatacccacccagcacatgtgtcctgcttcaaagacacatctaaatttatcccagaggagcatcccgatccgcacacagagagatgcagacagatgtcaacatgatgcagacccccttaccaggagcttgtagtccaaggatacaggttatagggacatggagacaaattgtgtccaacactcctgaggccaagggcacactaaaggtaatcaacatgaccctgggccaagggttgtttgagagggcatcttgaaggataataggatcaagttaagccccaaagcccagagaggatttggtggatagcagtgtcaaggtcattgcagggtgtaaaaatggcaggagaagttgtggatctgtgtttagggtatgaagagtagttcagcccggttgaggtagaggtagagaattgccccctaggaaaaagagaggcaaagccctttaagtgtatctagcactttacagtctataaagtgctatgatctttgtcttctatgagctattaagcatgaattcattttataaactgatgcacttagcaatgtgagattattatcttctcaatctccctgtgagtttggcagagcaactaatatcatctacattttacagatgagaaaactgaggcccaaaaagatagtttctgaagagaattcacaaagctggaggaggcagaactagaacctttgtgttttagtccattctcacatcgctataaagaaacacctgagattgggtaatttataaagaaaagaggttgaattggctcatggttctgcaggctgaacaggaagcattgtggcttctgcttccggggaggcctcaagaagcttccagtcttggcagaaggcaaagagggagcaggcatctcacatggtgggagcaggagcaaggcgggaggtggggaagtgctacatacttttaaacaaccagatctcacaagaacttacgatcgtgagaacagtagcaaggagatggtgctaactattcatgagaaaccgcccccatgatccaaccacctcccaccaggccccacttccaacattcaggtctacgattcgacatgagatttggtggggaaacacatccaaatcatatgaccatgtcttatgagtctcaaggcagcagttcccaatcagtgcctaagagctgggtaggaacctcctgagtcctggggtgtcatagctctggccactccctgatcccaacctgtgtccagtgacctcccatccctgcccttaattcatgcgctctttttctacccccagggcattggcactgatgagaagtgcctcattgagatcttggcttcccggaccaatgagcagatgcaccagctggtggcagcatacaaagatggtgagatgggcaggaggggccgcttaggatcttcagatacaaaatgaggatgattgcaacagtggggacactaagattctagccatctaccttctctcctcctttcctctgatccatttgtccacccatttatctacccaataagtacttgctctgtgctgggtgatgtgctaggttctcgggataaaaccaaaggggtccctctctcttaggccaatgagataatgagataatgaaggagacacacaataaacaggtgaacagataaacacagtgatgatggattttagctaagtgttgtacaggaaataaggtaacaagaatcaaacttttaccagtgaggtcttgggaggaaatgaggaaccaatcgtataaagaatggagagaagatccttccaacagaggtcacggcaagtgcaaaggccctgaaatagaaatgagcctggtagccggtacaaggctagacaggtagaggacagggcaggatcacacagggcctgcaggccaagagagagatggtgttttattctgagtctaatgagaagttggggagtatgatgatcagatatgggttttaagacagccatccttgttgccgtgggttggaaaggaattgagaatagaggaggagagaaccatcggaaagctgtagccactgtccaggtgggccgtcatggtataggtgggctagagagaatgaacagattccatttcatcatatcatggtcagtacgaagagctgtgaaaatataccctgggtcttgccatgatggacgtgtagactgggttttggaattcttaaaaatatctgatcattttgggggcagcagggccctttatcctagatccctgaggtctctggggatgagactagagcttgcgttcctttctgcagcctacgagcgggacctggaggctgacatcatcggcgacacctctggccacttccagaagatgcttgtggtcctgctccaggttggttcacagcctatttttttcctctggagcttgggatagcttttgtctggctcatctgggtgtagatctgaatgtccagggtctggtcagcttcccctggtttgcacaggcaggtgtatttggctaatcctctttctctttggcacacagtcctctcgtgcccaggagtgtcttctgctgtgattttcttcctctctccacactcgctcctcccgctcctctctgggcctccttcctgccattgcttctgcagctgcacatgcagcatttctggaccccagcattcctgtggctgctgtgtggagtctcccacatccgagccttattgcctcctcaccgcccgcccaaagtatatcacaaagagactattaggaggctacaaattggtgtctgtggctgaattcaacctgccaagttggattttttgtttgttttcccataaaatgtgttttaagaaagaaagcaaaacaagtttgagttagttgctaacatttaaaaattgtgagattttgctcaaaaaccagatttctggattattttaatgtattgaaagttgcggtagcagcagacctgcattctgcacgactgcagtgggctggagagcatatgcgtcctgcccgtttcaccgtgaatgttatctacctggctctgtaggtatctctgtgaccacaggcacgatgggaacaggcattgagatgtctcaagctcagctccaaggaccaaatggttatgaaactttatatataaattaagccaccactatgtttcctcgttcccccatttcccttttataccagctcctcccaactctgttcctctcattgccataacaatcccatattaaccagctggggaatgatcaggagaaacctcaggagtgggacagtgtgacctgtgccccattttcaaagctgcttgttctggagaggagtgtcctatccctgtatcttggagtcaagcgttttgtatcctcaaggtttgacaccaagcagcagcgcggcacacattgtaagcttgccagctctgtcttctgctcagtcccaaagagaaccctgggggtttgagatcctggaatgcacaatccagggggaagaggggatggccatagacctctccaggccacctgcagacctctgcccacgtaagaaggagttgagtactgctcgcccctcttccctttgtgcatcctcctatgtgtaagcttcctctatcagatgaggcaaagggcatgggcagaacaacagaagcaccattaggatttggtgactttgtagcttgtgagctcagatcttgggacctgagtcccaaatccttattggtgaattctttaagttaaggtataagagctcctaatagaatgcaaatgttcagatcctttgcccctgtggaatcgttgctggaggagtgtcatgggccatgcaggatctgtggcagggaccctcgagaacctggggccctgtcctcagagaggtcctcagggcaaggctctgcctacctctgggctggggacacctggaagaaccttggttgttcttgggactctcctgtgtggacccagccctgacgaggaagggaaaggccagagggagggtcccttttgattggctcacaaaatagatactgtggtcttcatgcaatagcagtcactgcttctggacacatctgggccaccagggttttcctgctttccctgtctccaccactggcatccaggcctccctcctgactttgcagtgtttgaaacacatgttctttgtctttctgcccagggaaccagggaggaggatgacgtagtgagcgaggacctggtacaacaggatgtccaggtaaacaagcaccactgaaagtccctgaggcacagcagaagagccttgggaggggagaggttggggccctgggaagggctggaggtgaagtcatttgcatcaaataccagaaataacccagccacagctgtcatgtataccggtgctttgttgaagaaaagatataagttatctttcaaaggtatatcccatatgtaatattggtatattggtgaggtgtactttggagctttctttattcattcagtttttagatattattgaagtaaaatacctagcatgtgctaggcactctgccaagcatttagaaatcactaatgaacaaaatcaagtggtaccgggagagacaggcatacattaatcacacaaacaccttctctatcaatatactgtacattgcaggtgttttgagtacccagtacatgccagcagcactacaggggctgatacagagaatgctatgacatagtccctgttgttgaggagctcatgcaatagtgtggagatagacaggtgaagaaatcattatcatatacagtagatcaaagtgataaagaagtagaaagctatgggagcctaggagagggaggaaaggagggaaatagaactgtgcctgggggcatcgggaagtactttgagaaaaaaatggaatacttaatctgggccttgaaggttgagtaggagtttctccagaaagtaaggaagaaaggcatataggtatagtcatgtaccacataatggtgttttggttaatgatggaccacatatatgatgctagtcccataagattatggaccagatatgtgatgctagtcctataagattataaccccatattttcactgtgccttttctatgattatttctgtttggatacacaaattcttgccattgtgttgcagttgcctacagtattcggtaagataacacgctgaacaggtaggtgtgccgcctaggagcaataggctataccacggagtctgggtgtgtagtaggctatgccatctaggtgtgtgcaagtgctctatgatcacacaatggcaaagtcgcctaacaatggcagttctcagaatgtatccccatcattaaatgatgcatgactgttttatttgcaaaggtcttcaggctaccaattactcgtgtgttcagggatcaggcagcagttctgagtggcttggtcagtgtgtcctgtctcctgaggtttcctctttcagtcaagtgccacctcttccccttcaggacctatacgaggcaggggaactgaaatggggaacagatgaagcccagttcatttacatcttgggaaatcgcagcaagcagcatcttcggttgggtaagctccagagaagacctgaagctgctcccttgggttgatgccaataatgcctttctttatctcttttcttttctttaccactaatggaacatgatacctacttcattcccaacccaaactttagtcctgagtttattaggttggtgcaaaagtaactgcggtttttgccgtttttaaaggaatggcaaaaaccgcaattacttttgcaccaacctaatatcagacagcagtttgtatagtccctcagcaaagtcattaacaggatgcttggccttccatctcagtgccagtcctgtctccatgttaggggatgagacacagtctctcaccagctatgaagctcatctgcacagcgctggtgatgtgcgtgacctcccagtcgcctccatcatagcaccagccctagcttcatggtggacagtcgtcctggccactgtgcccccctgctcttgaagtcctcatttcttctcgggggtacagaggcactctcaaacctccctgtctctctgtctgacgcagtgttcgatgagtatctgaagaccacagggaagccgattgaagccagcatccgaggggagctgtctggggactttgagaagctaatgctggccgtaggtatgtcctgacgttgcattcctgggggctttaggggattctggaacactggcctaggaacaaggggctgagaatggaaaggggaattacatggtatagaattgggaaggagaaaaccatgtgggccgtgaattctaaaggtttctccagggcagcatggctgaggctggggacgggaagggggtttgagcctcaggtactgacttcctccagctcccttctccaccactggcagggggacaaagagctctgaacttgggttgaggataatgatgatcataatagttgacttttgttgagcatctagtgcatgccaggcactgtgctgagtgtgtaatctttaaaaaagacccagcagtggccactgccatgatctctatttcacagatgaggaaactgagtctcaccaggctgatcatttcctgaggggtagttttgtaatgagttgggggtactgagaacgtgaggatgtgaggaactggctagtcagtggtggagccaagattcaaaccagggcttctcccacatgggcttggagcaagtcacttctgcttgctggacctcagtttcctcatctgttaagtggggtgcagggtgtgggggcaggaaggatggactgccttaattgcctccccagaagcccttccaattctggcattccagcagttagcatgtctgagtcagggatatgttgtgtgtttgtatttcttgggggaaacctgcagctcctttatcgtccctcccagagccatcccctgccctccctgtttgaagtagtcagccagtgggactcacggtgattcagtgggattcacaatgattcagctgccagtacctttctggtgtagcaggtctaaaaaacaccttttcctccttcgccccagaccctacccccaccccagctcaattccctgttaaaaccaaaaggactagaaagataaaggcggtctttgtgatggacttcaaaaggattatttcaacaagattatttcctgtttattccctgggtgtgcggtaaaagtgggttggtctggggtgatctggggctgtgagctatcaggaacggtggttcttcctgtattgagctaggtggccctcaaggaatagaaacaaagagggagtcaggccatcccatcccccttctgaggcagccagaataactctacctcttcctccctcttcacagtgaagtgtatccggagcaccccggaatattttgctgaaaggctcttcaaggctatgaaggtgcgtggtggggctgatgtgaatggggtttggggagaggactattgggagtctttgacaagtccttgggatccagtggccaaagagagcccttcagggatggccacaggactgaccctggtgaaggtgctctgtcgcaggtgagctgtagagccaggaatgctgctggtcacatgtcctgccacctgcatacctgcctgacgtcatgagtcaacagatgaacttagggtggcagcctgcacctgatccctccagccaaatgggttggcggctcggactttgaagaagtattaaccagaatgtttttatacagcgtatgtaggcaagaccactttggccttgcctgctaagactcatgatgctcaccctgtgacagttccactctgggtgtgtttctgagaaagcttcccaggcttttacacatatgacgcacaaagaaactggtatttttgtgatgcactggaggaaatgaatgcagttatttgctgccagaggccagaggcctgaggcccgagacacaggagcttgggcctttctggccctggttggccattccgaaaggacaaagtagactgtcggccattctctgcccaccagtgtgccataatgaggttgggcagctcagccctagagagatgtttgcctgtatgcatgaattcattaagaatgcccatcacaaggctgagtgcatgcagtggctcacacctatgatcccagcactctgggaggccaaagtgggaggatcacttgaggcccaaagttcaagaccagcctgggcaacatagtaagacccttgtctctacaaaaataacaaatagaactagccagggactgtggcacatacctgtagtcctaactactcgggaggctgaggcaggaggatttcttgagcacagggcccctgggtttgaggcttcagtgaacgcagtgctatgtgatcacgccactgtactctagcctggacaacagagtgagaccctgcctcttcaaaaaaaaaagaaaaagaaaaaaaaaacttataacagtattgcttatattaggaaaaagctagaaacaacccagtgaccatcaggaatagtacagcaaaaacctaaatgcacagtggtatatttgcagagttccaaaatgtgtaaatctaagtgtattgcttagagttacaaagctatggtaaaattataaggaaaatcaagtgtggaaattatacatgaagagagaagaggtttataacagtgagagggccgggcatggtggctcatgtgtgtaatcgtagcattttgggaggccaaggcagcccttgaggccagttcaagaccagcctggccaacatggcaaaaccccatctctactaaaaatacaaaaattagccaggcgtagtggtgggtacctgtactcccagctgctcaggaagctgaggcaggagaattgcttgagtctggaaggcagaggttgtagtgagctgagatcgtaccactgcactccagcctggacaagagtgagacactgtctcagaaacaaacaaacaaacaaacaaacaaacaaaacagtaagaggagcatagagagagcttcaatgggaatggcaatgtctgcttcttttgctctaaattttaactttttattatgaaaataggattttcaactaagctgggagctatcagcactctagcctcctctcaagtccatgttccccaaacccacttgtcttgcagggcctggggactcgggacaacaccctgatccgcatcatggtctcccgtagtgagttggacatgctcgacattcgggagatcttccggaccaagtatgagaagtccctctacagcatgatcaaggtcagcagagctcatgggggcagagaagggagcaaagagctttttgccaagacagagggcttggggactattcccaggaaaaggaaatgtcctaggaagtgggagtctcttggacattccaggagctcctgccttgtggctcattcaaggaatttaaggatattcaacagaaaagcaagtgttaggggtgtttgtgagtggtaaggctacagaaggaggcaggggctgggtcatgaaggacacgcaagctgaattaagtgcgaggactctgccccaagggcagtgatagttcagtctcctggaagaaggctgggaaacactgaagaacacaaatgagggttaaaggggaacctttggcctgggccgggtgattggtgatgactctgggacatccggcccctgaggctttatcaggagacatatgtaaagctaggggttttccctttttttttttttttttggatgactgaaataaaactttatggggtgacagagaaagagatccaagttgtattctccaaagtatgtttccaaagggtaatttttttaggtgttatgtgcaaaatgttctatgggaaaataagtttgtaacaaaccacaataagcaaagataaataagccagtttctttacctcagaacttctcacagcctttcacattttgaagtccattatgaagccccaagagggatatggaatatgcatctatacggatatgtgcatctgtgtaatatatatttgtttgatttttttgcatttcccaatatttttgctcatggaaccccatttccatgcatatttcatgtggaaggactgggctggggactgtctggtggcagtgctgtgctggggcactggcttgaaagggcagcgagcatctcttctcaactccgcatattggtagcaaagtcatattggtaacttgaaattgtccattgctagaagtatttacaccacagaaataggcaaatgctataaattagggcttcctccaacctgcccgctgagaaccagttattcaatattaaccagcacaggagggccagggctgctatgaataagtgttcattcagccttcccctctttcaggctgtgcagaaccttcacctccttgtctgagaggagcccagggctgggtgagaggtaacctttctttctttctcttcagaatgacacctctggcgagtacaagaagactctgctgaagctgtctgggggagatgatgagtaagtggcttcttggcccctggctggagggcatggccttggggtgccaggcggggactctcctggctcgcatcctgatgggtggattggatgagctggggattcccctgagccaggagcgtcgcacaagtgaaaggcggcttttgctggtagctgctgtgcttgtgggtctgtgtgtctgagagtgtgggggtctgaacgtgagcgtggtctcctgtatatggagatgtctgctcttgtgaacttggaaagtcagtctggggttgtggactaggaaccagaatatgagcatccaatccctgctatttcatagccatttctcggtttcatcacctgttaaatgggaaaaggacacattcctgctctgcctactcatttatgcagcatatttgtgttaagtgccttctgggtgcagaccctgtgaggaagcccctgatgaaggccacagcgcagaagggtatagaccagtttccagaagggagcagtcctgtgctggggagaactggctgtgccacatagaaagcatatataaaagcacacagagatgccctagcccagaccaaggggagactctttggagatacacggtgagacccaaggaggaaggggaagagccaggtgaagagggtctggggacagtgtttgggtggaggaaatcacctatagaaaagccgaggagtgagaaggagtggcctgattcattcatatgtccgaagtcatgcatttatggagtactagagagagaaataaggcagagaagtgggagggcctgggggcctcttcccagaatgttaaattgggacattacttgaccagatttgtgtttgagaaagggaacaggctgcgctctgatttcctttctctggatcttataaagatccaattacagaagggatgcaagaatttcctgtgaacctttggtaaggaccataggggttgatgcagttcagcagatattactgagctcctgatgcatccaggcactttgcaggaggagatgcagggctggcatggccatagcttgctcaatggcctctttgagaggggagagttggatagaagccattcaaattctaaggaagaaaggggaggctgaaggattggaaaaatcctatcctgcttggactctgcagccaggaaggctgcccttaaaagccagcattggccggacacagtggctcagcgcctgtaatcccagcactttgggaggctgaggcgggcggatcacctgaggtcaggagttcaagaccagcctggccaacatggcgaaaccccatctctactaaaaatacaagaattagccaggcgtgatggcgggtgcctgtaatcctagctacttgggagactgaggcaggagaatcgcttgaacctgggaggcagaggttgcagtgagctgagatcgagccactgcaccccagcctggatgacaagagcaaaactccgtctcaaataaaaataaaaaaggcagcattgcagggggtctcaagagatggaaggttctcagaaatggagggaggactctggcgaatggaggaggcataggctggagagaaagaaagcttaatgtgtgtgtggtgtgtgcatgtgtgtgtatgtgttggggtgtgtgtgtgtgtgtgtgtgtgtgttggtgtgagtgttgcccatgatgacattccttcctgtcctctccctaaacccctccattccagtgctgctggccagttcttcccggaggcagcgcaggtggcctatcagatgtgggaacttagtgcagtggcccgagtagaggtcagaccttcccctcctcctgcttgacctcttgaccacagcttctctgcttgcaccttcctgctgctctggttggcacccagctgccccctggcggccaacccgacacgttgattctcacatctgaagcttccttttctcccttggagtggtgaactggtggaggggcgcacctggtttctgcattagcttctgacacgctggaaagggttctggcccacttactaacagggcttgctgaaatggagacctggctggttccatggaggggcctgtcccgtctggagtcgaaacagttggcctcagagacatgaaagctgagaacagatgggcatccctgggtgcactggaggatttcaggttgtcctcctgagcatcctcagactgggggtccacaaaggacaggaatgaaaggtttcactaaagtactttaggcaaaccattccagagactgcaacacttggtccacacaaaaaagcatgggaccttggagctctctgttacttattcgctatgtaacctttggaaggtgccccctccctctgggcctctatgtctccatctttaaagtgaggggttaacatggcaatctcggtgatctcttagggctcttgagctctgatgttctaggacagtgttccccaaatgataaggcaagagatctttgcagatgattgtaggtgatgtgagaagtgaatttagtttggcagggttgaataacgctgaactccacagagtgaatgagaaaggcactcctttccaatttcatcagcgtttctgattacgtcaaagaggaagtcttggtttggtgccgccgtctctgcaacacttgctgattttcctttttcacaaagagaaagctgagagagctcgctttaagtttcagagcttctggcaagtagaggcatcatgttaaatttcatggtatatcacctcttttgtttttattatgttgatttttgtggtaaattgtcagtttatgatacatggtatcaacttcctaattcatggtagttatataaaattaatttcatccattcctttttttttttttttttttgagacagggtctcactctgttatccaggctggagtacagtggcatgatcatggctcactgccacctccccaggctcaggtgatccttccacttagcttcccaagtagctgggacctcaggtggacaccaccacacctggctaatttgtgtagagacagggtttcaccatgttgcctgggctcatcttgaaccaatgggctcaagcgatcctcctgccttggcctcccaaagtgctgagattacaggcatgagccattgtgccaagcctcattaatccacttaacaattattttttgagtgtgcctattatgtcagacactgttgtaggcacctgggatatgtaacaggataaaacggatacaattccttgccttttgggagtaattttaaatgcacttcaaaaattgatgcatttaagtagacagaaaagaagttgaattacataaaaccattaagagatggcatagtgtgtgtgctaatttggaatagtgaaagtcctttaggagtgactgaaatttgggaaactctgttctggtatttcagaacttttctgctgccttttcagggggaatgactctttaagaggcagagggggcctcgggggcagggtaggattcagaagaattggggatgccccggtggaataagcagccaaggggcactagaaccgaggcagatcccgtggcaggcgggagcctagccaatttctcttgatcaggacttgccctgctcccagccctgagtccctctctccctctctctatatctttctgtctctttctctctctctctcagctctcgtgcagggtctgtctgctgtggcttcacctctgcctctttccccacccacgccgcttggtttgggctcatggggtgagcttcccaccctcgcatgctgtctttcagcctggtccccaggggggccttcagacacctgctgagtctctttctgcttctcacagctgaagggaactgtgcgcccagccaatgacttcaaccctgacgcagatgccaaagcgctgcggaaagccatgaagggactcggtatgggggatgggaagggagcagggttggtctccagggcagcaggtgtggtgggtttggccgtgggctggcaggggatggagtgaggtttcaaattagagtctgcaggatgaggaaggcttgatctcaagtttccaccctcctagctcccagagtatagagaggaggggcaggagagggttcataaggaacttggcagaagccctttccagggaccaaggtgtcccccagcctcctggaagcagtatcctggcactgaagaaagtaccaggtcacaaaattggcatggtgccctggctctgctgctgactcaccgtgtgactctgggtgagcctctccgccactctgggtctgaatttccctatgtgtaaaatcagggctgtggaccctggaacccaagagccctcattctgtggtgggagtgtgccctgctgggcaggtctttcagacctatatttggcaccaatgggaagagtactgcacccacaggttcagatcagctgggcctgtgctcagaaagtccagcctgggacaggccatctagggtttggctttctttgcctttctgccccatctgtctgacagcaactcccaggaggctttaggttaagtccatcacctcctgagcctcctttccatgtgtctcatgggaatgatgatacctgccaagctcgcctgggactgtaggatgctagaggtaaaaatgccatgaaagacccctgtgctgggtctgtggttgatggcattaatctgagaagcaggaagtgatattctaatgccttccagagtcaacctgctgtggttagagggactcagggtccagcttccagagagctgaagagaaaggacatagagttgctaacaggacttggactgtcagggttggaaggatcccttggtgactactccagcctcttcatgttacagatgtggaaaccaagtcccatcaagggaaggggacttgcccagggtgggcagccattgccagagccagaactagaactcagaggcactgactcccaacccagtgctctctacctcccagctgtcctttttcctcagcgtgtcaaaaggaaagggagggaggagtccagcagaaatcagtggcctgagccataggcaagcggactgcagggactcaggagcacatggccgcttagccaggcttctaccctgacaaagatcgatgaggggccatcagtgggcggtgcatggggaaagccgagagccacaggccttcttctgaggcatgtggctttggtgactcagggactgacgaagacacaatcatcgatatcatcacgcaccgcagcaatgtccagcggcagcagatccggcagaccttcaagtctcactttggccgggtaaggacctcctcctgggctctctgtgcaacatgcatgcaccttgcctgattgagctcagcctgtccccatcggttctgcacagttgggcaccagggtcttcatggcagagggaccctgtgtggtcatatgatctcagagtgtctccagcactgggtttgggcagacatatctttccatgcccccagttccttgtgatgggcaacacttgtgtgagttgctcagtggactcagaggcacagcatggggccaagatcagggctatgagttgttttcagtgtgctttgggcatcttgcaattcctctgcacagacagagctggcttcaaggccccaactgagtgtcagggattattgcacattggtggcatctggcttaggttgatgcatttccccctgagtggaaacagtgtccttcagctctgctgccttcccgttcctgtctcctgtgtcaaggagagtgggtcttcctcctggttgttttttccctaccctctttggcttcatctaaataataagtacaacatcagcaaagacagacacaagcttccatgatccctcatgtggaacccctgttttctctttccatctctcccatcctgagtcatgtgtgggcaagtgctgatgttggcatgactgtggctctgccctttgcaggacttaatgactgacctgaagtctgagatctctggagacctggcaaggctgattctggggctcatgatgccaccggcccattacgatgccaagcagttgaagaaggccatggaggtacagtgtggcaccagggggtctagtgtctgcgggtgccaatagggatacaggtgatcctcataagcccaggtggattagctgtaacttcttggtagaactcctcccatactcagttcaaactggcataaacacaaaaggagatgttggctcctataactgaaaactacaggactagctctgagtccagagactcaaatgatgttctgtggacccttggctcacccctgtcttggctctgctgtcctcccttctggcttcactctcaggcagcctttctcctcatggtggcatatgtccatcccgccagctagcggctccagcagaaagagttccttcttcctaggagctccaacaacaggcttggcatttactccaagttgattcagcttaagtcacatgcccactggtgtcagaagggtctcgtggagccgctggaggaagtggggtgggtctcgaacgaaagcaccagcagttggagtctgtactccagcctagacctgccactcactcacagtgtgactgggccattccttacacttcccaatcctctgtgccttcatctgggaaatggaaatggtcacctctgcccttcaaactaggacaggtcaatcaaggtcacaggtatgaagggcattgttaactccgaagacctgaccctacattaaacaagaaagcattatgtcctggcccagaagttgctagaactgctttgcttcccaaggtaccaattgtactaatggctactgtttataaagagcatatggtaactctcccaggttaggtacattagttcaattagttgcctcctcaagccacaaggcagggctcttattttgtccccattttacagatgaggaaactgagacttggaggttaagttgcttggtcatggtcatagagctatgaagtagcaaagctgaggttcagaccagtctttctgactctagagcctgtcttgacaaccgcataaaaccagtagtgcttttggccccttgcgcattaagaggagggcagcaatggggagctagaggactttataaaaacattgcctaggctaagcagattgagatgattgtttcttaaaatacctaagccaaaaagcaaacgatctaaagacacagggttcagaaatagaagagatcgatgaggtaacccaactgaatcctttccattttcaaagtttccaagtgggaaacagagaggctcagagagtcagtgagttagggggagacgagggctagacccagtctcaggactttcttgattgcctcaccacacacctgcttctaacaaagaaatgattgaagatctcaatcaggatgaatctcctaggatctgagaaggcaggaccattagagcactaggcagtaacctctttgaggacagagaacatgtcttgcctcttgcctttctctttttttttttgagacggagtctcgctctttcgcccaggctggagtgcagtggtgtgatctcggttcactgcaacctccacctcccaggttcaagcgattctcctgcctcagcctcctgagtagctgggattacaggcgcacgccaccacgaccagctaatttttttgtctttctagtagagaaggggtttcaccatgtttgccagcgtggtcttgaactcctgacctcaagtgatctgccctcttcagcttcctaaagtgctgggattacaggtgtgagccaccacgcccggacttttttttttttttttttgtagttgtagccccagcaccttgcacagtggctagcacataataggtgtcttaacaagtacctgaatgagtgaattagtcattgactcattcagtcaatcaatcagtcaatcttgcctgcctcctctcctccctgatagtttccctgcttccctgtgtgcagatctttgcatgacaggtccccagcctgccttagtccagggcatgtaacgcctcagttcataaatcactcctcaaatccaagagtaaacaaatgtaagccagccatgatggctcacgtctgtattcctaaaactttgggcttgagtccaggagttccagaccagcctggacaatatggtgaagccctgtctctacaaaaaatacaaaaattagccaagcatggtggcatgcttctgtggccccagctacttgggaggctgaagtaggagaatcacctgagtctgggaggcggaggttgcagtgagccgtaatcatgccactgcactccagcctgggcgacagagcaagactctgtctcaaaagaaaaaaaatttagcattttatcttaagcacaaaactttttttcttctaacaaaataatacatgttcactgtggagacttgaagaaatagagtaaaaaagaagaaaatagcaatcatctgtgatccttcactcacacagagaccaaactgctagttaacactgtgaggcatgtgcgtgtccttctgttctcttccaatacttacaagtagaaatttctattcagatgttcatgtgtatatgtggtgttatacacacacgcctatataccttttctgtttggggggctggaaggcaaagcagttcacatgggaggttctggggatcttgagaggctggcatagtcagccttggttgtgccaaggtcttgggcctgagggccatgtctggaggtgaggagaaaatccaggaatgcttggcctgagctttagccgtccgggccccatggacctctgcacaggaggtcagaactatggctgagatcatctttgccttgacattccagggagccggcacagatgaaaaggctcttattgaaatcctggccactcggaccaatgctgaaatccgggccatcaatgaggcctataaggagggtgagtttgggaggcctgggcccagatgctgggagaacagccaggccccccaacttccaaccccagcccacagctctgcccaggactctggcctgtctcctttccctcagtccttgaggatttgataagcctcttgggtgtgcccatccctgtgtctggggaaaagacaggtgtcctggtaggacaaaggcctggaggtagaaaagggcttggctggaagtgggaacagagaacattctggcctgctggagagagggagggcgactctaggggtgtgtagtccatgcagttctacagggccccacagccagaagggccccacacttggttgcaagctatgctgtcactgtccagaaattcttcatttttaagcgagtggccccatattttcattctgaagaatcttgagtaccagtcaaaaatgtttaaatcggctaggtgcagtggctcacacctgtaatcccagcactttgggagtctcaggcaggcggattgcttgagcccaggacttcgagaccagcctgggcgacatggcaaaaccccgtctctacaaaaaatataaaaattggctgggtgcggtggttcacccctgtaatcccagcactttgggaggccgagatggtggatcccttgaggtcagaagttcaagaccaacttggctaacatggtgagaccccgtctctactaaaaatgcaaaaattagccaggcgtggtggcatgcgcctgtagccccagctacttaggaggctgaggcaggaggatcacttgaacctgggaagcagaggttgcagtgagccgatatcacgccactgcactccaacctgggagacagaatgagactccatctcaaaaaaaacaaaaaacaaaaaaattagctaagtgtggtggcatgtgcctatagtcccagctactcaggagactgaggtgggaggatcacctgagcccagggaggtcgaggctgtagtgagccttgatcatgccaactgcactccagcctgggtgacagagtgagaccctgtcttgaaaaaaaaaaaaaaagtttacattttttatcttataagcagctttaaaatggcagaatttttgagtacaggagtgacatagtcagagctctgcttttgggtttagcaactgccatgcaggagggaaggtagaagagagaatgacaacagggaggtgacttaagaggctgttaaatattaaaggcgagatgcaatgggacctcaactgggacagagctgaggggatggaggggagatgatgggttgatgggaatgcccattgtcttacaaaatcagcaggaggatggctggatgcccccatgagccagttacaaaccctttcatccccacctccccctgccaatactgccctggctcaagcctgagtttcctggacctccctccccgcaaccaaatccttcttggccagcagctacccacaccccctttctctgcctcagactatcacaagtccctggaggatgctctgagctcagacacatctggccacttcaggaggatcctcatttctctggccacggtgagtgaattcatgggccccaggtcggcttgcccatcgggaggcctgggaggaagggaaggtttactgagtggagggcacaggggagttagaagtgcactcctgatggagagggggtgtctccccacttgcctccttagagttccaccgcctacccctgttgttcccttgtcaaagttggcgtggtaccaccttctccagacagtcctccctggtggcccttgtcctggcttgttgggcccccagctcacaggacaaagccatatgggtgaccctctcctgtgttgttacctgggagcttctgtcaccatctcttgaattcccataaccaaaatggcagaccctcattgacagttaccgagagcttgctgtgtgtcaggcattggtgctaagtgtcttgcacacattctcagttaatgaccacaacagcctaccttatagaggcaggattttcgtccctgtgtagctgatgaggaagagcattcagagaggtgaaaatgagcagggtgtgtggtggtacagagatggagatgggtcgatgtttggggactgaactttcttgctgctcctgctgcaggggcatcgtgaggagggaggagaaaacctggaccaggcacgggaagatgcccaggtaagacccccagcccaccccagtcacctctgccgggtgtccctgagatgtaggtccagcttatgcgtgtctacgccgggccctgtctgtgagtgaaggctcctggcaggggcgtggttggtttgattggttgatacttagactgtagaaatgaggtttagaagtgtggtgctggtattactggcatttcctaggtgaatagcaggaccctcagagctggcagggacctgcagatcacccaggtcaaagccctcatgttacagtgggaaaatggaggtccagaaagggcaaatgacttctgaaagtcacacagcaaatcagtggccccagtagaattgacccctagagagctggtctgggaacttgctgagaagagggcctgagtgctaaaggcctcggtttattatctgtaaaatgggaccgagattggagggagtgtcctgggacgagcctagaaagtaagttcctcaagggctggaatcttcattttgttcactgatatatccaaagtaacacatgatcagtgctcaataaatatttgttgaatgaatagcagggaaaagggttctctaggagtctcttggctgctctgcctcagccctgctccttagcctagtgagcttgaggtctggaaatggcttcttctggaggttggacaaccccaaattcattttccctgagggttctatggctgggcagtccctactgaggccagtgcattgtcccccactgacctgcaccttgatcccagcacccagtagcctgacccaggtccatgtctccatctcttctgactgcctcattttcccgcccccaaaagctgtgtccagggatgtggggcacagacaccacagacttttatagacatccagcccccttcttttatagttggtgagttgaaaagagcactgatggattgagagtcagggaaccaacttttctgttcccaggtcccataacagaagtgtggtttgctacaacagcatctgagctagaaaaatctttagctggaacctgacagttacagaattgtaattataatttttagaatgcatactatatattgagaacgatgccaagattattctatacgtttttatgttctccctttttactagaagaaaatgaagctccttaacctcttcaatgaaagaatttctaagtggtggtggttttatttgaactcaggcttgcctgatgccagagtctatgcttaattccatttacagtaatatcttccaagacccagtagagttaaggtcccctgcagcttccacatcaaatagctgttgttgtccagttgtccaacccttgctttggaatatggttgtcaaaagctgcagggttacatttaaatgtatggcatttcagctacattgtgggcacatggatgggggttaggctgagaacccagccagacactagggtggcttgctgaggccacatttcattcactcattcaacagacgtttattaagtattactgtgaacagcctcgtgtgctgctgagagttttttaaaaatctcagctctcaccccaaatccatcctccaaccctgaattgatcttccagggaatgcttctgcctggtgcctggtttgccaatgaggctgtgcttccaattgccgctagcagggggcagtggtgggccttgctgacagctgcttcgcaaaaggagagaagtggagagagagaacccgggtggaaatagctaagggacccttgagcgagatccctgcccaactcggctgcttctccagatttaggatgctagacccaagctcattttcttataactagcagtacattcttttatagaaactagaaaataaggagaagccaaaaaagactccataacctaatagtaataagcattgtcagtattgtggcatacattattctagttgcttctctatgtatatataaaagtggattctttatttctgacagttaaaaattaatactatgtgaatattgttgcatttttaaatcaacgatatcatttaatggctatatactgttccatatctgaatctaccatgttatttaaccagccttcttcctagtagcaaactcttttatcacattcatgaattattcattagaatgaatttccagagatgaaatggaaatgtgggagcaaaatgtatataaaaattaagggcatttgatagggccgagtcaagctcccccttagataacgcacatgagtacttggcagtttgtatttgcctgttttacactgcctccctggcggtctctcactctggatgtctagaacaccctcaagctcttagaagtctgggactgttattaaccagttgaacatatgtccaatttccaactgtggccccacagtgattgttaattgcttcccctttcactctgttgtccaattagagcaataaattataaataattattatagacctaccatgaaatgaaggattgtggtcatttttagataatcaatactcagacttttttttttttttttttttttttttttttaagacggagtctcgctctgttgcccaggctggagtgcggtggcgcaatcttggctcactgcaacgtctgcctcctgggttcaagcaattctcctgcctcagactcccaagtagctgggattacaagctcccaacaccatgcccagctaatttttttgtatttttagtagagacaggatttcatcatgttggccaggctggttatgaactcctgacctcaagtgatccgcccgcctcagcctcccaaagtgctaggattacaggcgtgagccaccatgcctggcccaggcttttaaaaatataacagctttcttgaaatagaattcatttaccccactattgacccatttaaagtgtacaatttggtggtttttagtatcttcacagacttaatgcaaccatcaccacaatcaattttagaacattttttcacccccaaaagaaactccatacacattagctgtgactcctcatatcctactaaccccccagccctaagcaaccactaatctactttctgtctctccagatgtgcctcttccaaacacctcatgtcaatacagtgatattaatacgtggccttttggactggcttcttcacttaagaaaacactaacctaaacactatgttaaacacttaacagtgttttcacgggtcatccgtgttgtagcatgttggtactcccttttcattgccaaataatagtctattatccattcatcagctgatggacatttgggttatttccaccttttggctattatgactaatgctgctctaaacatttgtgtacaagtttttgtgtgcacatatgttttcatttctcttagatagaattgctgggtcatatgagaactctaagtttaaccatttgaggaactgtccagattaatttttgcatgaagtagctaggctaataagaacaagcttttgtggtgaatattaatttagtgtcccaccactttttttttacattacagatattattatcttaaagatgctttgaaaaaccgagtatgtctagggtactctgacccgcgtaagtgagaacaattgggactttggattcttttctgttaaattttttaaacatgtccctctctctctctttttaaaaatgataccgttttatttagcataagtttttacaaatttttgataaaatacatatcaactttaccatattaatcattttatatatttatttattttgagatggagttttcctcttgttgcccaggctggagtgcagtgttgcaatttggctcactacaacctccacctcccggattcaagtgattctcctgcctcaccctcctgagtagctgggattacaggcacctgccaccacacccggctaattttttgtatttttagtagagacagggtttcaccatgttggccagactggtctcaaactcctgacctcaggtgatcaacctgcctcagcctcccaaagtgctgagattacaggcgtgagccatcatgcctggccaatcattttaaagtatacagttcagtggcattaagtacattcacattgttgggcagctgtcaccaccagccacctccaaaactgttttcgtcatgcaaaaccaaaactctggacccactcaacagtcactccccattctcccttcccccagcccctggcaaccaccattctttctatgtctgtgaatttgactggggacttcatgtaagtgaaattatacagtatttatgcttttatgactggctttctttacctagtatgatgtcctcagggttcaactaggtttttgttttgtgatgtttgagatagggttgagacccaggttggagtgcagtggcacaatcttggctcactgcaacctccaccttctaggcccaagcaatcctcccacctcagccccccaagtagctgggaataacggcgtgcgccaccatgctcagctaattttttggtagagtagggtttctccacgttatcccggctggtctcaaactcataggctcaagtgatcctcccaccttggcttcccaatgtcctgggattacaggtgtgagctactgtgcctggcataggttgtttttaatacagaaaaatattttaaaaaccagaagcagcccataatcctagtagccttgataactcttatttaacatttaaatttaaaatgaaataatatctttgcatctttaagaaattttcaggaagaataaaaaaaatgcgaaagctttccctcatagtccctctcctcaaaggtgtctcgacagtttcttaagtacttcccaggaagtatgagaaagtgagtgtctatttttttttgaatctagataaaagaaacactatattacacaaaaatatgctatactttacttctttacttaatttaaatggaaactctccttatcagcattgtagataatcttatcctttgtaaaaactgcatggattgtttccattgattggataagtcatagcctgtttaacaagtcaatctcaggatggtttacagtttttctctagtatgaaaaatgctgaccaggtgcagtgcctataatcccagcactttgggaggctgaggcgggtggattacctaaggtcaggagttcgagaccagcctggccaccatggcaataccccatctctactaaaaatacaaaaaaaaaaaaattaactgggctggtggcatgcacatgtaatcccagctactcaggaggctgaggcaggagaatcgcttgaacctgggaggtggaggttgcagtgagctgagatcgcaccactgcactctttgggaggccaaggcaggaggattgcttgaggctagactggacaacaaagtgagaccccttctctacaaaaaataaaaaaattagctggatgtggtggcacacacctgtagtcccagctactcaggaggctgaggcaggagaatcgcttgagcccaggaggtcaaggttgcagtgagccgagattgtgccaatgtactccagcctgggcaacagagcaagaccctgtctccaaaaattaaaaagaatgctgcagtgaacagtcttgtattctatcgtggaaggcttttgccagtatacctgtagggcaaattcctagcaatataattgcttgatcaaatggcatatgccttttaacttttaacggacattgccaattatgcaatgaaaagaagaggaaggtttccagagtataggctattgtgaagtttataaagagttcagtctatccaatagaataaagtcagcagagtttctgggggaacggcgaaagcaatacgcagcctaggtacatgagcctgggtattttgttcccaggctctccaagtcacagctatttgcctaacaaaatagtgtcctaaccacagaattttgtgctctgcatagtgcagtgattaaaagtaacccttgtaaaatgactttcccatcactgtttgctgtgtgcctccaggcaggtcagctccccttaaggcctcagctggccagtctttcctgtctgtaacatgaaggctaaaattacatgtctcttgccttggaactctgaatatgctaaagggtgcagagaactttgcactgctcacatttacatctcagtggttctgtaaggaagtggcagggattatttccactttcagacaaagaaacaggcctggaatctcctctgggttttggggtgcgaagggcagagttccccatttctgtgtctttctcttacccttcaagtgaacacgtttttagttattgccaggcctatccgcattctgagctccagcccaaaaggtcataggaaggtatttttatcttgtccctaccccccttcctttcgcatcccgggttctctcaggtctcttgggacctctcccactcccagccaggcccctcaccctgcaccccagggccccagcaccagcctccccaacctcctctgactcttgcctcccttctctccctcctctctcccctccctgctctcaggtggctgctgagatcttggtgagtgtcctgttcttcatttgggttttaacggcctctgagtaaagtccgcctttactgggccgagcggggcagtatcgagcagtgatttgggagcttgctgtgcggcttctctctctccccttccgggccctgcttggtaaaagataggccaggcaagtgtttcccaaacttcagctaatcatctctggcacgatttgtgctgtgtaaccaccagctattaatactgatctttaaatcgactcactcttaaacccaaaatgagttaaggggaatttactatcagtataaatagaactagtagctagctagaagacaatcatggaaacactaatgtgcagtgtgatcgggtgtgtttgcccttgaccccgcttggggaaacactggccaggccatcttctctgcatatgaccccatacacccttcccagaggggcttgcagaaaggttgagggatggaaggggaactcccagttgctatgctcagagtctatgtgggtcctcctaggagccccagccccacggtcctgaggctaggatggaagtacccagtgctaaggccatctttgtcagttcacagggtccttgtgaactggagaggggagtatagaagccattgtgcttgaggaaggaagaggggaccagtctcggcccccttggatggctgggtgagcccagcttctgactgccctcagcccaggcaaagacatgaaagtgaataataaccaaggctttctcatgtctcccctcccaaatccttgctccaactggggctctgcaggaaatagcagacacacccagtggagacaaaacttccttggagacacgtttcatgacgatcctgtgtacccggagctatccgcacctccggagaggtgaggcctgacctcctcccttcccagctcagcaggaagatcccagaatctgatgagagcctctcagctctctgtggcaagaggagcccgttgcccacccacctcctccttaacccagcagtagcgtgtcatgggtgacggcgactctggagccctgggttctagtcctggctctaccacttatacctcaccttctttctcctccttagggaagcaggtgggatgcccgggattaggtatagcaactggatttcacctcaaaggccaactctgattggtagtagctgcctagagtgctgtgttaaggattctggggtcccgcgtcatgattcactggcgatgcctgccaggagcaaggcagcgagaggtggtggtggcacaagacccacatagacatctttgaaccacaggctgccgcatgctcagggcacacctgtatgcagtggccctggcactcggtaatcatgaagtgtcctgcactgagacatttacattttaatgtctggcactacattaaatgtctacatttaatgtctggcacttctcagtatttaaggtgctttaacatagtggctaaaagaatggacttgggcactggacggccttgatttgaatcccccacttaacagccatgtgacctcaggcaagtcaccgaatctctgcgcctgagctcccttacgtaggaatcagggttttagctctacccgagatgattgttgtgaagatacaaaaaacataacacacataaagcactggcgcaatgcctgactcagtgagtgtttcctgagtgttatcattgtgtcttcatcccaagcggacacaggaggaagaggaggcccaggaaggagagggatcacccaaggtccctcagtgagctggggcagaaccatgactaggacccgtgctccttttactaccccagcctgggttcccagaacttggccgaggttctaagaccattggccaggcacggggactggcgtgggacagatttggctctgagcccacggcagccttgatgtcagagcttctctatcgggatgatcttgcccaatgcatttaggcctgggctgtggccatatttgctgcccttccactttctcaggcacagcctgtgggaggcactgggtggggctgaggaggggtcctccgcctcctgcactgaagctcacccccacctctggggcttctcttgtggccagtcttccaggagttcatcaagatgaccaactatgacgtggagcacaccatcaagaaggagatgtctggggatgtcagggatgcatttgtggccattggtaactggcagggactaagggaagggctgggggcactgggaacttgaacagattctctggaagaatagaaccttggcagcctccgaagctactactggaaagtaaacactgtcacagttcgcctccaggggtgctgccaaatgtgtgattgtgcaggaatgtcatgaggtctgtgcgaggctgcaggagagggtgagaaaataactgttgctagggaagaaccaggaagactggggcaggcaggggagggggcacgctgtcctgcacaactagggtgtatacacacacacaccacacacacacttgacacacacacctaacatatacaagacacatactatacacacacacattctcacatgtgacacacactcatacataaaacacgttacatatgcatgtgacaggtgcacaccacacatacacacatcacacacagaacacattatatatacacatacatgctacacccccacaagacactacacctacacacacaccactcacacactatgcacacatgacccatgcacaccacatatacgcagcacacatgcacacacatacaagacacatacacgctagatgcagatgacacacacacagaccctcgtctcctctcagtacctggctttttggttacgcttatataatttgagctcttgactttgaaaaggtttttcccttttggatcttaattccaccgtgtataaatatggatgagtggatatgggttagggctgaagttattctcattaatattcatcattagtggtatcttgtttcatttactataaaacacattgcatcaatgcacttttaaaaaatcttaccaagaggtatccgtggaagattttcacataattgccttcaattataaaacacatcttgatttcagagacactaaaatgtgggggaaaggtgtgttagatttgggtgaagtagaggtggtggtaggggtgttgtttagcacgtgatgggcctttaccacccaggagcaatatctaggaggcgggatagcccgacgaataaaagcatggaatccaggttgaatccctgctctgccacttactcactatatgtccttgggcaggtcacaaaacctctgtgtctcaatttcctcctttgtaaagtggagataacaacagtgcccagcccatagggtggattttgtgaggctgaaattagttaattatatgtaaagcacttggaacggtgcctcttggcatgtaatactcactggacaagggttagtttgtatttgtattgttgtttcccaccaagccctgcgcaaagttagttgcacgcaggtttagttacattctcatcaggtgctcttaaccagcttattttacaaaagaggacactgagttcagagaggcttatagcagtagaaccaggactcaaaccacaggctgcctacctccaaagctcatgttcttaacaccagaataattagcctttggagacactttcagattcctaccctcctcgtgtatttccctcttccctttctcctcccaccttgaacaggtatacacgtgcaaacacacaccacaacacaccatttcacactcctccatccaatggcaggcatcggggtcccatgtgacagatggacaggctcagtttttaggaagacttgtggggttggttacagaggagagaagtttctgcccagcgtgcttcttagccagactgataaagccctaggtctgaagtcagggaaggcttcctggaggtgatgtcatgactgggggcatggacatcaagtacagccttgaaggatgggatttgatttagagagataatgtagtgaagggcagataggaaatgcatctatccaggaaggacagagagacacaggaatttgcagtttgttctgggaatgggggagcaagggccatgaggttgcaaaggaggccaggagctttgacattcaagccaaggagcttgggatttgtttgggaggtagtagggagatatgtaaggagctggagatgggaggtgtgtgatgtgatcttttccacagggttcctgagcctgttgcagaggagtcttgcttgactctgccactggggtacgcaactccagcctcttgccgtctgttctcattatatccagagtcattccagctatagtactggtgtctggttcctcctttttaagctgtctgagacacctgtgcgtgggctctggagccttgcagtcaagcagctgtgaagggctagagaaccctaggctttgagaaagggcggggttggtgaaaccaggcaggcattatctgcagccagggtagggagcaggggctgccaatcctgcaagattgttcaggccctggggaaacactcagccccagggatttgcatggtcccttaaattttaccaacggacagtcattctttggagcaatatttctctaaatcagtaactctcaagcattaggctgcaccagagtagggtggccaaccatcctgatttgcgcaaggctttcagtgctgttaggttggtgcaaaagtcattgcagttttgccattgaaagtgatggcaaaaattgtaattactttggcaccaacctaataaaacctggagtgtcccaggcaaactaggacaagctggtcactcacctctagagtttcagattcagcatctctggaatctggaatctgaggcatgagaatctgcctttcttccaagttttcaagtgatgctaatgttgttggtccggaaaccacactttgagaaccactgctcaaaatctttccaaaatctgagtctttagggtggagcctaaaccctgagttttaaacaagctttttgggtgattccaatgcatttaaaaatttgaggccccgtgccttgggttcatgaggagttaattacctttgaatcctctcctgaccttggttagctgtaagcaccttagaaggaagagagttgcaaccaattgagagccaggcctaaggatgggccagaggaggaagcatggggaaggggagcaaaggtgtcgtctgagcatgaccctggggttgacaatgatctgcagacccatgcagggatagacgaggtggggagatgggggaggccggtccagagtctgggttcacagcctctgaccacgttccccgcatctctctgctcttcctaccagttcaaagtgtcaagaacaagcctctcttctttgccgacaaactttacaaatccatgaaggtaagaaaacatgctggcgttcctttcccttcaagcactgacttacatacacacacaaacacacagatgtgcaccatcccccagatcaggattcctggcagctgtttcttcccatttgacatttattagcatctgcccttgtctggctctaggatggtatttcccagttgggggtgatttcccccgccttcccccgccccggaggatatttggcaatatccagacacatttttggtcatcacaacttggagattgttgctaccagcatctggtggggagagaacagggatgctgttaaacaacctcagtgcaaaggataagcttgcgcaacaaagaattatccagccccaaatgccaaggttgagaaatgtgctctggaggcacacagggctgggtaggacacagtctctgccctctcagagctcacaatctatccggggacacagggtctcctaggacaaatagtcatcaaaggtcacaagcgctcccctctgagtctagtcctgcccttctgggagagcccaagccacactggccaccctctcagccactggagtctcaactgcagatagcctgggcaggtgggagggtaggaaggaacctgagaccctcaccctacagtctccaaatgtgacagccattcattgagcactcacgatgtgtcaagcctgtgccaagggcttcatctctctgaccacagctgaccctcatggcagtcctgtgaaattgtggtagcatcctcatttgatagaggaggaaactcaggcctaggtagggtaaaacgttgcccacatttacatagctcctaagaggcagagctgggactcgaacctagctctgactcctaggctggtgcttgtcgctccctgggggcagaggcagctctggctgcccacacattccatgccctgtgcctgctccttgggcccggtggtagtttcctagggctggtgtaacacattccagaaattgggtgacaacagaaatttattctcatagttctggaggccaaaagcccaaaatcaaggtgtcgcctgggttgggtcctcctggaggctctgggggagaagcactcccctgcctctcctagcttctggtggttgccagaagtccttggtgtttcctggctgtgaatgcatcactccggtctctgcctctgtcctcacctagccacttttctgtgtgtatgtctgtgccctccctcttctaaagatattggttattggtttaggcttcaatctaattcagtatgccttcatcttaactaattacatgtgcaaataccttatttccaaattacatcatgttctgagtttccaggtggacatggggacactattcaacccacacacatcttttttgcgtgtcagtctggccagtcctgggcacagagggattttggtcaggactgtttgcagaagacagaggtggaacatccgccctgtttttggaaggaacaagggagaaaggcagatgggataccactgtttcttgcctgactgggctctatctctccttccgcctgtgtctccctcctgcctggctccaccagggtgctggcacagatgagaagactctgaccaggatcatggtatcccgcagtgagattgacctgctcaacatccggagggaattcattgagaaatatgacaagtctctccaccaagccattgaggtaaggggaggggctagaggttagcaggaagcgggtgagtgtcagatccctaatataagattagaagtctttattcccatggacttttttccagtgggttaccgcttagaacagccaggatattgaaatgaaagggggtctgtattgcattgtttataccgaaatcaattccaaaagaatcaaaggtttataattaaagatttccaaataaaacaagagcccattttttgctttttttaaagcaatgttatggaagtataacttacatatcatgggcaggcatggtggctcacacctgtaatcacagcacgttggaaggccaaggcaggtggatcacttgaggtcaggagttcaagaccagcctggccaacatggtgaaaccctgtctctactaaaaatacaaaaattagctgggtgtgttggctcatgcctgtaatcccagctactcaggaggctgaggcaagagaatcgcttgaacccaggaggtagaggttgcagtgagctgagatcacgccactgcactccagcctgggcaacagagcaagactccatctcaaaaacagacaaacaaacaaacgaaaaacttacatatcataaaattcacctgttttaagggtacaattcaacagtttttagtaaatttactgagttgtacaaccattcccataatgcagctggtttccaaacacttctatcatcccactaagctctctcatacctgtttatctagttccatccccagccataggcaaccaccaagctactttgtgtctctgtagatttgccttttctgaatatttcatataaatggaatcacctaatatgtgaccctttgtgtctgactttttgtttgtttgtttgtttttgagacggagtcttgctctgtcgcccaggctggagtgcagcagtgccatctcatctcactgcaacgtccacctcctgggtttaagcaattctcctgcctcagcctcccgagtagctgggactgcaggcatgcatcactatgcctggctaatttttgtatttttagtacagacagggtttcactgtgttggccaggctggttgctagctcctgacctcaagtgatccacctgccttggcctcccaaagtgctgggattacaggtgtgagccaccacacctggctgcgtctgacttttttgacatatggagcttatatttttgctctttgagatcagccaagatcttaaagtctgatgcttggttctacttggctaacgagactatgggcatctcagaggcagtctcttacagacttagtaggaatgtaagtaaattgttggcacattttgatactatattatgttttaaaatcatacatcaaaaaatacaaggacaaacaaaatcccgaaaaccatgtctcataacaatgataggagtccctcagaagggagatccataccataccatgggtcaggaagtttggcctccccagtctgaacgtataccagaccactgtgatgtgtggtgagcgtgatggtgtttgtacccattcccagcaatggcttggcagttagcactcaatgttgtttgttcaaataagaaatcacctaacacgatatgccaagggccatgggggagggtatcagcagagtgccaggggaaccaagggaggccagagttcactgtgcctcctgacgcaagagagtggccagagtgcttctcagaggagagggccctgctggcaaatgggattgggggtgcacaggggcatgttggacaggggagtgacaggtggagagaggactgagatgctcctgggggaaaggaacaggtgaagctgcagagctctgcacaggtcagatcccaaagggccttgaagccaggccgggagcttgcatatcttcctggggataaacaaaagggacgtggtcacatttatgtgtctgggagatcccagtagcctacatgtggcatgggatcctatgttggtcatggagagaagccgagggagatgtccagacagatgggcagccgggaggagggggcattgagactggaaggactgttttcactcactctgctctctgcctctgccagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacatttccagtgagggcctctgtcttctacctagagcctgcagcctggattttcctcattagagcttgaggttgtaaagtctgtccaggagcgagttacgtctttaaattcttgcaaggtgtttcccgggaagcgcacaggagaatctgagtttgcagcaagcctgggaaggctggcccagccctgctccgggcctcaggttccccctcatcccctctcgctgtctggacatttctgtatgctcttcatccatttcaaccaagcccaaacttcctcttttgaactatgcaagggtgcccgatgtgatcttgatctggagaggtgcatggaaagtttccttcatgcaggtcactgataagcaagtaggcgcaactgcagttcctctgccttccctcccccgctgccctacttctggtctgtggctttggtctaagattgtccagtgaccatggcatggggctggctgctggccaaagggcacttctccctaccctggctgaccagactagtttattgcaggttagcgcgtgtttgttttcttttctttcttttctttttcttctttttttttttttttgagatggactttcgctcttgttgcccaggctggagtgcaatggcatgaatttggctcactgccacctctgcctcccgggttcaagcgattctcctgcctcagcttcccgagtagctgggattacagacatgtgctaccacacctggctaattttgtatttttaatagagatggagtttctccatgttggtcaggctggtctcgaactcctgatctcaggtgatccacccgccttggcctcccaaagtgctgggattacaggcgtgagccaccgtgcgcggcgcatgtgtttgttttcatagctgtgaagacagcaacaggcaggtgagagagtctggtctcgtccctccctcacttgtgacctcagaccagccattgccctcactgggcctcagttactccaactttatagtggggggttggatccaacaattttgaagagctctctcttaatctctgacataatgagtctgaaacaaagaaaagttaccttaccgtgtctttacttcctttcttctgggctgtgaactcaagtgccttgagggccagctaagagctttttgggatatttgtctaacttaattgaactgttactgaaagataaattaacaaaatggttcagagttttggattaagacctttgtaactaactgaccgtcagcacaggagcttcggtttccttctctgtaaaacagggctcctcattccaattccacctatcctgtagccttgtgggaataaaaggaggcaccacgtggaggtgcttggcagggtgcgtgcctggctcggagtcagtctcactacctgccccgaaccaggctcagttgtaggggctgaaaggtggagcccatgatgctttatggctttgatttcatgaagtccgtcagctgcagatcacaaaggcatttgaacccaaaaagaaaagtgccttaaaatatatactgagggaaatgggcttggggcagaaaggaaagaagagtggaatcagggaatagaagtgaggagagcccatggagctgagggga

SEQ ID NO: 16347 - DNA, 50797 bp, Human; identical to SEQ ID NO: 16346

SEQ ID NO: 16348 - DNA, 51252 bp, Human
acattggtagtgtttggccagtgtacttgtaacacacctcataaataccctgttgtcacgacacagcatgattcaacctttgatctgattaaatttgagggacacacgaagactacttgtcctcctcctacttacaaaaatgagtgtctaatagactatgtatgaatgtttctgcttcgcagctcttgcaagtcccagcttttataggatctttaggtcataaacgcggctgctttattaaaagccgtttactgtgcccggtgaaagggacgttctagctgcggctgaggctcgcttgcatttgtaacttgcaaagcccaaggagatctttaagagccacattatctaaagaaattttgctggttatttttcaagcaagaaatgtcaaaccaaagtaaattttctagggctttattttagagcctgcgatttatgcgtttgaaatttcttgcctaataaactttaaagtttgttgcccaggcgtcaaaactgtgtaaatcctgtattgaacagctatctttggtctttctggggcgagtgaattagtgaagggtaatcgccagatgtttgcaacatatatatttttaaaggctgctttacctacaatccaactaatgtcagaggtaaccaagggtaaatattcctcttcctaataatttggactggagattaactgggactcagccaatgttgatcttcgtctaataacagatgcagcggacccgatgtgaaacctctggcacctattattttaataccaaacctacctgtattttattgtccacctcccctttaaaaggaaccaagggtgacacgtatccttgacactacctatgatcgtttaaaaagtggaatgatttgcagatccccccctccctcctcctatgccacccccacccctaaaacccccactttttctcccgtatacttttccgtgccttcctccacccaagtcggaggagcgctcactcgctcggccactcggcgaactcgatcagctgtatctgggaaatgaaaaaagaaaaagaaaaaaaaaaaaaaagacctgcgtcctggaagagctagtgtgagccgggcgccgctcgcgccgtctcccgctttgcatagtgcccgcagatggctcgctccggcccaggcgcggcgatccagtcgtcccgaagctgtggcagggtgggggtgggggtgggggccggggatggaggccggggagggggagcgcagggcccctctcccctcctctcttcccagcccctcacccccaccccttttatatttttttttcctcccaagttctcttgccttgctatccccccttgaatccgaaggcgcctcgcgattgggtgctggggccgggtacgtcagatagactgtgacgtgcagtcttcctgtttccttcagctgtgtcttaaagtaaatcttgttgtggagcggagccctcagctgagggagcgctctgaaataatacaccattgcagccggggaaagcagagcggcgcaaaagagctctcgccgggtccgcctgctccctctccgcttcgctcctcttctcttctttacccttctcctctctcctcctctgctgctctctcctctcctccgctcttctctctcctcctctcctgctctctcctcttcccttagctcctcttcttttcttctcctcttcttccctctcctcgcctctcccctgctcctcttctctcgtctcccctcccctcccgcctctctctcccctctccctctcccactcgccccgctcgctcgctcgctgtcgcacagactcaccgtcccttgtccaattatcatattcatcacccgcaagatatcaccgtgtgtgcactcgcgtgttttcctctctctgccgggggaaaaaaaaagagagagagagatagagagagagagagagagagagagagagaggctcggtcccactgctccctacaccgcgtaagtatcttcttcttcccctcgtgagtccctccccttttccagaatcacttgcactgtcttgttcttgaatgagaaaggaagaaaagagcctcccattactcagacccgtgtaaacattattccccccaggagaaaatggtgttattcaaatgaatcataataaaatagcctctaaacagtttctaagcgggagcctccgtggaactcagcgctccgctcctcccagttcctaagagtaagtgatcctcttggcttttatttctttctctttcctgctggtggctgggggtggcggtggcgatgggggggaggctgatgttgctggacttgtcgctgatcttgtcaccttttgtgtactgtttctggggtgtgaggaggcgtttgctccctttccttctttctcctgctctctcttctcaggagagaggaccgcgagagggaccgggtcgcttttttgttcgtggagatccccgctttccgccaaaccccatccttccgatctccccaggctaaaactccggggccggtccccttgtcctttctctttgtcttgtttattatagctgcctttcttcccggctcttccaatttgcttgtcatttgcatacctttcacttctccttttttaaccccagcagaggaccgggaactgggaggaggagagagggaggtgggggggcgctctgttactttcgtctcaaaacgctgtcgaagccgaattgtggaaatccggcttggaggggtgcggtgatgggtcccgggaaacgcgcgcggcgcccctcttccgagctcctggacccagggctgggtcaagttgagtagggtaaggcggcaccgggaggctcggggggtcgcgtggcggtgggattgggacaccagcacgaggaggaccggaggatcgcggtccgggtaagagtagggggttcttgggcagcagaaatgggaggcgatgaatctcccagccatcgctggcagactatggtgttgggcagcttcggtctggtctcgtctgggtggtacctaccgttttgccccagttaggaggactggggagggaggacaggagaggtgagagtaattgttactgggaagactagtgaggagggcgggaagagggagggaagagctgctatcttgcctgagcagatcaggagggggacgcagtgggcggggggagacatcacccaaagtccagtttagcaagttgttgattcttctggtgtgccagcccgttactcctcctgctgaagctgaaggttggtggagtgatggagcgtggggatggtaaaggaggagtaagtagctttccacagactcccaggtctctggccccttcccagcttcttgggaaattgagagccctccaggcagacagagaacagaactagaaggaggggtggtgcttagtcttaaatagctcaaggaggcaggttggagtgtgaaactgctgttcttggcaacccagaaggctactctgcctgggggaaggctggaaactcacctgcttgtttttatttttccgagaagatctgtgctgtctccttgagcttataaaaacagaggaagcacagggtggcctcctcgcaaagtcaaggctagaagactcccttctcctgttctcttttccactcatgccctcccttatttaaaaaaaaaaaaaaagaaagaaaagaaaaaaaaaagaactcatttcctttcctaacctaggtaggcagaaatctattagcagagtgcgcatgggcagggcctgacaggtgtgttgtgtcaagaaagacaggtgcaaatttcctctgtgtctgtgtgtgtctgtacagctctagaccacaatgcttgctcgagggttagagaggtttatgaatttatggttgtcctggttaataggattgtctgggctaatgggaattgggctgttgttcttttgagccctgccatgtgagttcttggggtggggggtgggggcaagttggtatgtgtttgtttatttttcttaaggatattggcagtctactgctgaggctgtgtcccaggcttctgtctgccagtcagcccaaagcacccccactttaggcagcaggtggagggagactgacttttcctttgcttcctaccagtttatgcctatctcccaggtctgtgcttggcagagagagagagagagagagaactgtcgtgtgtgtgtgtgtgtgtgtgtgtgtgtgtgtttgtgtgtgtgtggtgtatgctttggatagcaatgagtggtgtgtaactgccaagaattccaaagtcagtttgaaagtgttactgttgttaaagcttatctttttaagcatgctttctccttgcccagaaagaataggtatgtacataaactctttcaagtcatatgttaaataatctcataaagtagaatgagcctgtcattgtcccagacatgtgccaaatgtcctagatatgaatttgatggagaaagaaaatctcaagtacatgagaaggtaactgtgcttttctattctgatgcaagatgtgagaagtcagttctacagggaatttcttgcaagaacttctgagtatttccaaaatgaaattttttgtgtgtgttgagggaggaaaacgagagtattcacattaacttgtccatgggttaaaacatggacatgtatatgtaatagtaaaataggtgaagctaaggactgtggcttgatgtgtgaggaaagttgttgggaattcaatgtaagcactatatctggcttcttaaaacttgaccttttaaaattatctttaaacagactacttctgtagactgagttgcacaggaataggttggttggcaaatggtttttgctcattggctttgtgtttgggtagttattgtttccatgaaaatgagatcgtatgtgtcatttattctgtagacttcaacattaacgtccccccacctcccaaacacacacacacacacccaatactttccttggatgcttttgaagttctttggtaattaaaatgtcatctatgcctatgttcatttgctttatttttaataggggttatctgtgcttggcacttattgatattttatgtgtccattatgcagaattctatttagtttaatcaccaccttgtgggaaaaaaaagtcatgcatacataacatgcatctttgttctcactttattcatttcctagcatcattcctctataagcagcacatgctatcttaaaacctaagctggcttattctgtaagttgccagacttcctctttatttgtttaaaactcaaacaggcctcttttcatgaatgtcttatatcattttagggattgtcttgaatttgcagtgttaatataagaagttttaggtttcagattaacaaaagaaattataaaatgtgactgatgttataatatgaaaatagattgtgcatgatgtatcattataggattttaattaagtacctgtgtaacttggaaaggaaccatatacataaggaatttctcagacttattgcctgtgcattctcaaaggacatttagagagttcaattttctgcaaaaagaaaaaagtgtattttcttaagattatttcacactctgtcttatttacctatctgataagttgttactttttaaacaagtagaaattaatattttaggcatgtctcagaaaatgttctgtgttcattttgcaggtgaaaagtgtgtggaatttttgatgggatgggagaatcttaaatgaaatcttaaatgatttgagaagtatattatgacaggaaatttaaaaacctgataacgcaatcttagttaatttaggtattaacttatgtcaagtgagttcttcaaaataaatatcaaaggttttcttaacctgatagggagcagaaatatctccaatatctctgaagaaaaagttgctaattagcagaaacaaattcttgaatgtagtgaaggggacaatttaatgattcaggggctacttaaatcagaccatctgatttttcccctttgaatcactaatttccagattgatttgaaatattctttgttaatgatatcctatttgaaatttcataaccaggttgacccaagtagattagaggcccatacaaagatgattttctaaaagaagtcaagtgtaggcttgcacaatttcttcaaataattttatcaacaaagacagatcatctaaataatccaagcaggaaaccatgccaaccttacactctccctgcctcataaaagatttgtctgaactatctggataattaccgtaatgaaacacttctttgtccagaatctggactccagatagatgcagtaaaagttgaatcctcctccccgaaataacttctttattaaagtagagcacttaaccactttatacttcacgctgcagtgttcctttgaaattctttactgaaaattctttcctcctaaccttaagtcatcagtttccttagaattttgcatgttaaagagaatgtcagataattcagatattaaaggagactcttttggagtagttaaaacctgttttgattatacctggatgtttattcttctaatatctttttctgggaggaatctgctatgttaagatatgcattgtataagaattactaaagcatttgtgtaggttatatacgaagtgatgcaacaaaatatttaatgatgaaaaactctatatagactttcacattaattaaagaggggtttacaggaatagagtaagtgtatccgatcaataatacatttgggttcaaattctcatcagtatttttctgcatccttgctgatttggacatccaccagtgttgatcaaaagcttcatattgcctagtgaaactgaaaattaatgttaaaatgcaaatatgatatgcatcaataataattgcaggtgaaacatgatagcttaatacatatcttgagaaataaaggagtttaaaaaatatcaatgataaagtcattccatggcttcctttaaattctgaactggaatatcatggaagcacttgggaaatgtttttaagagatttaatttatattatggtaacgtaacagtacattttcttatgtggtaaatatattcatatagatatcttgtttatgaaatgtgatgctaataaagtgctgtgtcaaccggttattattatttaatcatgcctatagcttccatgggttatggttccagtgtgtgctaccactatacttttatttctaaattaaatctaagctatatggagagatatatttatttgtgcctattaatataatgccttgtcctggattatataatttatcttatttttcccatttgttttgtcttatttgttatgttccagctggacattttacaacaagacctaaaagtatttaaattcttttagcccaagacagatacaaatcgttatttaatctaaaaatgttgactgaaatagaattacaaaattagtttagtttggtgaatatcaagggagttatatcttgttcttaacagactccacaagcatttctttccaccttaggaagagcacagccctcctcttggctccagcatggggcagggatgcagctgttgatacctaggctagatgagaggaagtgcagttgacgcagaggtaaatggcagttggaaaaggaaggatgcctggggatgaccttgtgctcatcagcgacaccagtctgtcctttccaagcctctgtggcagagctgctcttcccacagcaaggatggcaggaggaaagtccagtttgggtgttagggtgaacagggagagaaaaaatactgcaaaaagtttgtttgacattttgattggagatccatgtgctttgcaggtgatagtcaagagaaaaggatttgcatacaaatagaaaagatgtaaaatttaaaaataagggcaataagctctattttggggaaggtgatatacacacagaaaaaagtcttccttgtaaccgccccccatgcaagtgtttctttgattaacagagctttgaaatgattcatcctttttcttgtctcagcctctccttgttctttctgtcatctgacagctaacctgatttatcagatctaatgtgtttgtgtagtatttgtcactgcatttttgtattcctgaaaccaattttattattagtgtttgaaagggtctcaatcattctgaattcaattttgaacccaatgttgtagttcttgagaactccatctccattctaagttcaggaaattttatcctgaagcatgcaaaaagtatttcattctcaagcatgcaaatatatatatatatatatatatatataaagaggtatcattttgctttcatgataccctaaagcaggctcttttaaaatgttttatctttctatagaaaccaggagcaaagatttcatgaggaaatcactgtcacttaaaaaaatatacatattgttgccatctaagcattgagcattttcttgatttttacaggttatttcatgctgaaattatgcctatttgcatggatagtcattctttaaagctagccacagatgcagtcctagggagcacgtagatgtttttacaggtgaaccgaaagagatgggagccgttccagacactctgcatgctgcctttggcaatggaccctgttattgtgaagatgtgctctgttaagcaaacgtgaagtttaatattagataaacccaacgtgaaaaaaattttcattttcttcataaaatgttaattataaacaaaaagatgtgacatcttatatgtctacaaaatttgggattagcatcactagttaataagttacacaatgtcaagtgccttttatgaaattcaaagaaggatgttctctttttatactgtgtttccaagaaacaatggaagttcatatacaaagaaatatttccctttctcacacatttgatggacattattttctttcttctttatatatcttctttcagttttttctgtttttttttttcctttaatttggcacaggaaataaggttcacaaatcctgtatgttaaagagtttctttgggcattggacatattattttggcagatttaaacagaaggaaactagtcctgaagatatatttatctttatctcggtcaataacttattattcctcatattgatttctaaaatgtggtaacatccttgttttgcagtgaatccaactttgtaataatttgtcattaaaaggacattatgaaaatgtataaatattcttatagttacattaagatatatcaacagatatcatcttcacctatgattttacaagtaaaaaatgcatagctaagctaaataagcagacttataaaatgactattgtgcatttatttcaatgctaaactgaccatttatgtttgaaagatgctgctgctaagggtgttctccttcccattttacatatgacaaaaatattgtaaaattcaagaataaaagctctctattatatatttgcatttattttagagtccttttcctttaatagcgttaaaaccacactaattgtaatgcagaaatgcaatttttcatgtgaatttctcatagtctcaaaatttaaccttatttcttaagtatagagcagtttcatcttccttataatatgaatctcaatgcccaaaatttaatcaattggttgtcagaggctgtgttcttataatctactgtttcttctgaagataaacagtatcattttaggcatttgtgagagagaatcatattactggtgcttaagcagtttttgcttaatttttttttaatcttaatccatcttaaaccagtggagcagaaatatttaaaaatgtttcatttcaagcagagtgcataataaattgcaataattgtaatgtgccataaatcccagagcctatgcattttgcatttgattcaggattgaggtcaggaaatttggagaaatttaaagaaaatgattcatcagtccttttgttctgttggccagggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatatccttttattttcccctcgaggaaaaaacaaaccaaaaaaggtttcccaaaaggttgggtttacacaatatctagagtaatgtagattagtatcttcttaagaaggcaacctttcccattattcaaaggaataggcttttatcagcatgcgtgtgccattcctgattgcagaaaagcttaaaactaagccaacatctttgcagcttccacaagttgttcactgccttgaggagctcctatttaatatgtgctttctcagcagtgttttttttctgctgttcttcctgcattatcttcttatccctatctcttaaaaaaaataaagaagtagatttagagatgagaaaacagtctcattgtaaatactgattgaattctctcagatattttttaaagatggtaagtttaatagaataaggagaaaagtcagttttcagatccctaagatcccataagaagaattctcagtgtaaaccatctgcaaggcttctggtccgtttaaagacagcccgatgaaatcttaggaagagcgctttacaagtgggaggttgaggaggaagaaaaatggatgtgggtggggagttagtctctctttcatctttaagtgagacttttttttttaaggaaatatacaggtactgatttattcagacagcatcggtctctctcccgttcacccaaggtctgttctttgggtctggtgcagctgcctctatgcatgattaacctctgttcagccatacacagaaatcttttgtcccaacatacacaaagcaaattattttggaaagcgagagagcacaattaaatataaaactcagctgtattcgacttaaaaatggctctttttatgattcttttaaattctgaaactgacgtttatgtagagataacagttatatttttttattaggcctatcccgaactccagctatttttaactgaagatttttttttctctctgtatatcggttctttctgtaaattttttaaaaatcttgtggtcgttggtcttttgggagtagtaaaatagtagcatttgggggcaggtggaggcatgtttcttatataataaacagatggatataaaatttagcaattaagttggctgtgactaaatttaggattttgagcaattgtcttgatgactagagattgacattttcatatctaagcccactccagaggctgccacgtaagtgcaaagtcccagctatgggtggaaatatgttttcctggttagtggaggtcgtacttcaagccacctctcaggataatagtgtagatttctgatagggtgaactactagggccctaatcatgagtcctgcttgggcagttaaacatggagtctctcttatactgagcaagagaagaacattgtaacagaaagggaagagaaagatgtgggagatttctacatatacgtagaaatggagttttagcttggttgttgatttcacttggaccttttgaagatctaaaattcaatccaccagccatgaatcaaagctgcaccaagcaccatgccttacatattataagcaggcagtaaatattgatcaaatgattggaatatcgctgttggtgatgagaaaggcaaagtaagaagacacaatggcttgaatggtttttgtgccctttgcaaaaagagcatcttcagaggttcatgtaaggctaatgtctagggctaagaccccattgcaccccagagatctcttaacttcattttgaaccaggtagttgtgatagtgggttctttctgtctctctctctctcttacacacacacacacacacacacagacacacacacacagagtaaagtgacatgcgtgccaattttggtgaatatttaaagatttaatgccaggtttcaaaactcctgtaagtccacactaagctctttagttcaagatgccagtttatggtttttctttaaattagacttttcattataaccagatcattataattatggctgtgctttttgtttttagtcttctaggaaaaaaatcttttagattgctttaagtgttggctatgttcattgtctcaacctctccaaatccccggaggaattttgaggatttgaattgaaataagttccttttattttgatacatatcaaaggctttaaagaaaatatagttgcttcttcttcagaggcatgacttctcctttcttctatcaacataactttctgtcgagcggtgattctgttgggaaacacccgtgttcatgtgaaatgttagttgctcacactcagaattgtttctttcatatagctaaataatgtcggcctctcgtggcaattagtgattacattttccaccttttggccttctatgctcctattcttttcccccctctactattaatacattgcacttttaaccatttatctcattggtatattatttctcaggaagagtaagataggcaaacaaccttttctatagttcccacaattctgaaaccagtgaggatctgttggtttgtagagagattgggcccacttttctcctgtctctacctctgtatggcagtgtgttcttcccttgatttaactgttagtgtgtaggcaaaattctcaagcttttactttgaagaaatatctgggaatcacagtgagtgatgtcttacttcaattttagggatacggggccatatatgatccggttgtacagttattcctcgaaaagatcaatagaaatgggcagaaatgtaatgaaatggtacaactgtgattgctattattatgttttaatttttcgttcatggctttccaaactgttatatataatttaatttttcaggaaaaattatctcccactccaaaaggtaccatctgttttttgaacaaagtagctaagataagaactattaagaacaccagcttatcaggtcaacccattctacattcaccacattaaacatatatgttctgtaggatagaacacactacctcattatcccatctagtagaagggaaatagtgaatgtgtatgcaagttaaactgaatttcagtgcacctgctccaagggctcatgtcttggattttaaaaatatgttcagtatctttgcaaatgaatctgtttaatcaaatattaagttttattcaaattccaaaagaaacagtcagccaattgcttttcttcatgatgttccttgtcattcatcctctttgcatctcaagaaaaatagcctagtttaggccccaaacatttgcatgcacccagttaaagcacaagaggagtagtataagccgttaagacgtgcaggtgaagaaattgagcctgttctctgaaacagccggctttttctactcaacttttagggagaatgttagaaagacttgaagtttagaaaggaaaatggtttagtaatttgaaattaaaatccaaccaggaaccatagattagaaatgaatttctgaaatttgaaaccatccacagaaattgatcttatacatttttagaagtcttgtggaggctatagtacttatattagctagagcaaaacatgtagattaaagactaaaagactttgggctcctacactacccccctcccctgaaaaaaattataaagtaagtaaattaaaaaaaaaaaatccctacactacacagccctccgattatggtgaacttcctagtgggagttacgacttgctctatcactgtcattatgtgagagagtttagatcttttctccccattttagtttctagggggaaaacctcttagaaacttagcaaattagggaataaggcagaactaaaattctttaggtttcaaatgttttggaaaatgtaagtagtctcaacccatttgctgggaactgcagcacgtacaatctctagctacaatccagagtttagctggaaaaaaagaattttcttcctccgctttcacagcttattattctcccatttgcctttttgctgcctccgctgctcctcccgtggctgctgtttaggtaaggttatattgtacttggtaaacagacaacacttaggttctcaggttgtttgaacactgctttacgttcagctgcagtaccctgcttctctgatcttttatattcccgagcagatgtctttcattaatttatggatttatcatcttttcttttttttttcttttttcttttttttttttttttacacctggcagctgtctcaagtttcaacagttattgtctattttgcattacacatagaattgaatgtcatctgtcttcacaaagctatggctaagagaattgaggcacagccacatgagctgctgggacagatcttgtttgcgttccatcccccctcaccccactcccctttacctccttaatatttatttgtgctcattttctttcctggccttgaatggagcttagctcgtgttcagtacagctgtatgtttactgaatctattccatcatgagtcattgtgcgtgtgtaagtatcctggaaacagctagtgctttcttggaagaacagttgcttttcagcacaagcacttaaaagggaaattaaccaattggtcagttcagatttattttgaggagaaaaaaaggattatctaactgttgccttttaaatgtttcattagttatttttaatagtttattagaaacatatattttatgggaattttatcttaattacacaataagcaagagataaagattaattctgtgttccatttcaactgatcagttccaagtattaccaacaggaaacattttaaagcaaaaatgaacttgagaaatccaaatcagaataattttttgttagataaaaagcctctaaatactgatcaaaataaaatggatattttactttttttagataaaaagaacaaaaacatcttagcataaattagatgtattaaaagcttcaggaagttttggtagctcagtgcccatctaagaaacacagaaaaacactttgtattttgtatgacaccaaattttaaaagatttgtgacttccaattaaatgcatgacgttgtcttaatgtagccatctgaaagaaaagattagaacccagatctgagagtgtctgtcaaagtttggacttgcctaaaactcttatcacaaggcagtcgcagacagcttgcaactattatttcacttatccatttggacagatggtcctgaagtgtgctgggctcctttagtcttctgtatcagtctaatggaggttactggagggcctttcagccctctccttggcacaagaagtatgtcagtcataaattatcgtctttgtaatcattaaggatctcaaacaaaaacacaagttcagttaagctgctttggcttacagatataaaatcaaaatttctttctttagtgtttattttcagtttaacaaaaaataaaaaaataaaaaacctgcactacttaacttttctatttacagaccaaggtgatctttttaaaattgcatgggatattaaagggaatgttaattgaacaaattctcagcagaatatttggttaaacaccctgttataagtagtcaagagcttatccatattaatttgattatgcttctctagtaactttctggtttccctccattcttaagattagtcacgctagacttgatgaaggtcatttggaaaattttacctttcctaaatatctgtgtttatttgacatttctgcctaaggggtgaaatttttgttgggtagttgtgtgagtgtgtttgtgtgtgtgtttgcacacacaagcacactttcttttcttttttttcttatttttcttagacactcttctaaaagaaaatccttagagaagcttctaggaagggcccttaattgaccttgtgggggaccacattgattttctccacgtgcatcttcatttctgataaattataaagccattaatttgctgaggaaatggcagggccaggctgcggcacagatgtgaccagagccatcccagctctgagtctgctgaggagtgccaagaatctgggggagaatcaggaagcctggattgttatggttagcctcacattctcttgggaactgttttagttgctgctgtttacagatctaaaaggtaatgatgtttccagataaataggccttcttattttgggtaagtggccatttattgatctgctaacccacatgtattgatttgttagccccaactactgcgtcactctcaaaggagttaactataaatccaagacaggcaaattgtatttggttttggaccattgctttcacaaaagcaacagccccctccctgtcctctccatgccaaaactactcttcccaagttttagctattatttaaaaggaaaaacaattaaaaggatataataagataaaaagcaagtgagtcaagatgctccattagattaacactaaaaggtaaaatgtgaaacttgcatagcagtgttcaaaataatgcattttatattttcatgtacattagtagaataatttgctttaaactgcagagtgtggagagaagaacaaacagaactgtaattgcaaggaagaaaaaaaaacctcttatgacaagagttgtgtagtacatgttgggtgcatttgtctccttagcaacaagtgaatgtatagatagcctaccgacctaaagcaaggaaaatattttgccatcctcaccctaaagtagccaagattctgcaactcaattgtgcatcctcaccattgcatgtggcaacctctgacaggcgacggtcactgagcaaatggcagcaagttagcaatggatgccatagccagtgtcatataccttccagcactcccaccgcagcttgatggacccccagactctatggaggtggggactggagggagggaggtgggagtccttgtgcttacagaattgcttttccttaaccaattgcatcctacatgcaggaaggattgtcacccaatcacttgaaaaaagcaaagctcatgtttttttatacccgttatcccagctccaatatgctgaagacctacttctccgacgtaaaggtagggactttttttattcttaattttttcattttctatgcatgtggcagtaatttgaactcccggaagttaatggagatgaatgtggaattggtttattcctacacctgtgttataattgatttaatgcacttgtctttttgtctaaaggtgtgttaagcaaagatgccacttgtgtattaagattggaagactggtgttaataagttgcatgggtttccaatgtagtctgaaaaacttagcctctgtctttatatgtttgagtagcttctttgaagaaatttcagctggtaatggatgggtgtgctttagagaatgttttttccctcccctcagcaacagtaaactgtttctgtttttgtttctgttggtttccccatatttgtgcttatgaaagcaaactctagcacctctttttccccctgtcgaaaaggagcgtacattgaaattctctatgcagtagctgcttaaaaacaaaagtgatgattgtctcttatttacaacttaatttgttgttgatgtagagtacactgagcataaggagaatgaataaagtgacagattcaggacacattattcaaatgaggatatgaaagctgtcggcctacagctgcagcctccctcattctacagaatattgggacctcctggttctctctgtgtgtgtatgcgtgtgtgtgtgtgtgtgtgtatgtgtctgtgtctgtgtgtgggttttaagtaattgtttgcatcaacttgatgttgtgttaatcatctgtaactttttaaaacatagattgggttttgatgatgataatgacacacatggtatcattatcccaggaacttgataaacactacattagctgagattagtttattaggggtgggtgttttttccccactcctcccctgcccacccccatatgtacaagttcttctttctgccatggagaactcacaagctgccaaaacacactcgctcttccactgctccccgcacgcagcttgttttgtgcttgatgcccaagtggcttcattggccccattttgcaggccaactcatttcagtttccttcactggtgttttatttggccttataagaaaagttctgttttccctcctgtttgcttttgaattgtgtatcaacttcagccttttatctttctccttccctggctgtgctccttaagtggaaggcttgttttctccttgttcagcaccagcaaactgggcaagatggggaggcagggaaagtccatcacgtaaatgtctggataagactaagtgagcacaaacaaggctgagtgacacagaggccaggaaaagggtttgggctttgtagaggacaatctagaatacacaaattgaaggcaatttgtcacctggttgaggactgaccagcttctagagtctagtagaacctggtaaagtttgtcttccagggaatcctcccaacattttagttctaggaggggacatggaggacagggagaaaagggttattgtgtgcacatatgtgtgtgtgtgtgtctgtgtgtgcagatgtccatgttactcattccttttagggcaatgatcttcagtgttgtgaaataataatgacaataacttatattctttgcatagcaattttcacccagaagtaggccaaagagctttaccaactgcacacataggtgtcactcacccaccacggaaacacagccacctggagggtgggaaacagcagccattctgagccaacactacccaacagtagacgtcaatattagaaacaatcattttttgtgagagttcaagcatgcgtgcatgtgtgtggtgtgtggtggcaagtggggaagattattgatctgtagctttataaataccatgcaatacaaaccaacaagaaactgttcccattcctctagaatgcccctagcaattcagctttgcaaataaccactgactctgtgtagataacaatggaatacctgggtgaatattttattttcaaaagcactaatattcagattgttgattctatccataccttacccatactggaagagaaggctgttaaagtatatgtgagtctggttactaccaattatccactgtaatggaggggaaacagtagaacatatcaggcaaagcagaaaatcactgaaggtcacttctcttttatttttggaaggaattatacatttttaactttcctaattatgttttttctttggttagtaataaatgaatttgtatttcttgagcttacactgatgagagtagaaagccatgcaaagaaagggaaaggtagtccaggcaatgtggtccagagactttccagaaaacaatggcagagcattctgggatttcttcaatattaaggataatcacagatgtgaatattgacaatgtatacacacacatatgtgcatgtgcatgggttcacaatacacatatacatatatacacatatctatagcttgacattgacatacagatagacaagtgtgtctatttatttgcaaggctgaaagaaatagatatttctttatatatgaatatacaatccaaacttttattttggccaggattcaagaaatcactagagaaattggggaagagaacttagggtcttctcagaaatgaaacctgcatcatttatctggaacaagatatatgcatgtatctatggaccatgtaatgcttgttataatgacatgaggctctacttggtcatggccacattcatctaggagaaaattcctaactttagtaaaatgtactctttcaaataataaagttattttattcaatttttttttttgagacggaatttcactcttgtcacccaggctggagtgcaatggtgcaatctcagctcactgcaacctccacctcctgggttcaagagattctcctgcctcagcctcccaagaagctgggattacaggaatgtgccaccacgcctggctaatttttgtattttttttagtagagacggggtttcaccatgttggcgaagcttgtcttgaactcctgacctcaaatgatctgcctgccttggcgtcccaaagtgctgggattacaggcatgagccaccgcgctcagccctcatattttatttagtgatcataagttcattttgcaagcaaaaacaaaaaacaaacaacaacaacaacaacaaaaaaaaccaggagaaaaaaatgtgagcagaaaatatcttgtttcctgaatatggtataacgtaatggtccatcaaagccacacttggaggatagagctagatggggtaaatcctctgacttgctctagaaggtgagtcatgccaaagtggtgcccactcctttgtatttctccttaggaatggacacagtgcttaactctccacaaatgacttccacttgggtaagaggtaaatgcttttcaattaccttggaacgaaagaggtagagggaaatcatacaattcagagatgttggcatggcgagagttcttcttctacaggggtgatgtatatgaaggatgaaaccagggccgacctagtttaactcctagagcaagaatctaaacaaagttctatgttctcacagagagccaacttaattccctcataatgacatttagccaaacaaaaagctcagctcatcggggctacaaatcctttgagaaggacaagtggacaaatgtgagagagctgccagggatcgatgggccgcaccagctccctgttcactactgggtgctgattttaatgtacaaactaataactcttagaccactaagtacagcagattcagtgtcattttagctttgaagaacagacgctcacagcttttcaagccggcagtgttaaatgatgtatctcattccctccaccccttgagtcaactgctgcctagccagattaaggtgtcagattgatttgttttatacatcttttgaccatgctcattgaatatttaggaagtttcttcagcccatattgaggctgagatgtcccgtgggaagcattaatcaaagtcacagagactcgtacactgtggaaacacagcctctttattgtagcgattagtttttgcagtaacacattaacacactacagagctttcctttatagaacaattgatccttttcttgtaagccactacagaatgagggaaattaactctttaaagtttaatactttttctcccccagtgtgaatatctagaaaagcgggggcttgcttttgcttttagccggcgactaaaactgaacaaattttagttcacttctcctggagggaaaccctgttccttaggctgttgggctggtcatttcgcttgcctcatgtttggggagtctgttgtttttgtccattctttctctctggtatttccattctccaacaataagctttaaatctccctttatgtcccattcgtaaataatggcaagtgcacttacttttttgtcctccccattaggtcattcgtgaccattctagaaaaaaaatacccttctatttttttcctctacagtactcttgtccatatgagacaatgtcttgtaacaatgcagaagcctaatctccatgtcaaagcaattttcattccccagtgcacagcctgctatcattttgtaatgttttgtttcttattctaaaagaattaaaaaggaacagtaagccgtcacgggggcctgtagtccttatctcagtgtctggaaatttggacagtgtattttactgctgagataaaatggaaagaactccaagttcagcaaatcgtaatgggtttaagttctattgaaatcggcaaccagaagatcagataatgggggtccttcagttgtctttttaatcgggttccccgcgaggctgaatagagacagagcagacacacagagtgaaaatataattcttggataggttaagtacatgtttgaactcttgcaagcagaagcgatttgctgatgacttaatcattttctggtcaattatctgtaagggcccttgcaactccatggcaattatgatgcaagttggccttttgggagaaacaccagtctctctgcttctgtttccttgtgacttccattctctgccataaattttcattcatttattatctttgctagtatagaaacaactttctgtgtagtaattagagccccaatacacactttagctgtcatcttgttggagtctggatgttctcatggcctgtgtttgataagtgctctttgttgatttttgatgaatgtacatctttttctgggggcccagggaaggggatgcctgtgatgacaaaaggcagggggttgtctgtcagcccgcctgatatagagctatggatttattggttttgacttggcaagttgagactcatctgtcctttacgtgagcagaggactgtcaataaggatggtatcatttgcagtgcatccagaaagacatcttcatttcaaaggtcatcaggaaaccttggtaaacaaagttttaaggcctaaccatgttatagtaacttggcatttaaaaaaatgtaataaagctcctgtctatgccatctgtgtactgtgtcctaaccatgcctcccaaatggcagagataccaagggagggggacatgggtcttatccaatgctggcttcaggaagcaggtgaacaggcaccaggagctgaccagacctcaccagacatgaatgccgtgggcaaacattaagtggaatcacagttggatggacatgggaatcactcattgccaaaaaaataagcaaatgccaactcctcccattttgtgggaaggccatttgtctgcattgaagggggctgtaatgcggtgatacaaatcctcacttaaaaaaaaaaagtatatcaaactagtggtagagtcatgtggcacatcacctctggtacatgggagtaacaacacttccaggattctatggcttcaatgaatgtccataagaagtatataaatgcaagttgttctactgaaagatgaagaacaatggttaaaaataaagatgttcggcttaaggaaagtctgatttagaatgtgacttttccacttgaaaggtagagggttgtgatatgatttccattactgacaggtttttataatttcttgtaagtatattcttcctcttgcctctcttgccaccattttggtggagttaaatacgtatctttccaagtaaagaagggacgggaacattaaaaatgcttcagacacttaaaaaaataaatgaagaaaatggcaatgttcttatccttttcaacatttaaatttaacagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggtaggaactaatctttattttttggtcatctcccttttccttttttaaaaaatttattttctttagaaatgtacccaaatctgtttttgtgttggtttcgcatacaagcatcccccaatagagtaacaggtagagctgtgatgaggagcttccatagtccccattggaatcatgaggctctgacccactgccattttttccccattccctggcttttcagcttgtgtggaagactcatttggccacagaaaagggaactgtagaatccaaagaaaaatggcagcaagcagcaaagacagagtgattcattttccaaggaagaggtccctactccaatagacctttttcatatttaggttctgagaggtcaatgagctgatacatgctatgtgcaatggtagctaccaatgttattttcttaaaaagtctagaaacgttgatgggggagtgatcatggtttctgactttgacatttagtccctttgtggaggaaatggtatgataatttactaagtacatagcataagagatccattgacatctttttttgggattttgtttctgtttttgttctttttggaggagagactcgtgtgttttgcctaagtgtaccttcacaagcatgctgctctttgtacaaacactctcatacacacttatatatatctgtgacgtgtatattctagatccacacaaagcagcatagagaattcccagaaagcaatatccatgcaacaatgaaagatgtgtggctatgagtaaggcatttctttatgggctaatgtggtgcctcagcaaacagttttcatcacaacgtgatgactctctgtgagacaacactagcaaatctcccagtactcacaaaggcattttgctgagccctgctggctgaggcaacagtagttggaggtgggaacatggcaagaattctgcaggctgaactccctgatgatgagatcagacaggctgtggcttgacaaagttggtccatttcttgtattatcttggctagatgctgtgccatcttgagggtaggaattttttctccaacatctgtgtgcacttggaccttatgttaatattcttgctttcttcttgtagataggtatccaggaatacccaggaagttccaaatttcaaaggaaagaggacaccttggcctcgctctgtcaattaaggggtctgacccctagtactcttcctgcttgcccccctcctttttttcggctcttgtccctacagttcttggcaatgcagaccagttatagtggcttataaagaattgaatatggaagctcagcaatggggaagtcatagtttttctttgaaagtttgagtagttatagtgtaagctacctatttgtctttgctctctaagactaatatattttttgccaaatgtgtgataaatgaagtttgggtggtgtgtgtgtgtgtgtgtgtgtgtgtgtttgctaaatacattaaaagtgagaattcttcgtgtactgctccactattttaaaatctgtttttaaagtctcagttgtaatagagcactggctcactataatgacagagcactagcaggcttcttctaaagctgaagaatatgattatggctaaccattttaaagaaatctcattaagagcatcttttctcccctgcctttctgctaagcctgttgccctaaaccttaagctaagagacttctgtgtgctagtgaattatttacattacatgatgacataagtatctgtttggcagcatacatcaagcttcatgaaagaattgcccaagattcatgagatgacttctgcatttttgctatataaaatacccaagaggacaagtccttaaagtgcgcacgagggttttcggggttgcttaaaccttacctggttggaatttaatccgctacccacaggccaggggccaaaatgacacaaacaggggacggctggcatcaggaggtacccgacaagctgctccatttagcatcatctaaatcctctttaatatgattaacatctaatatttctctctttgtgaatcatatccacttccagccaggccacctctcctttatctgcagtgtctattttaagactgcttcactgcaaggagtatggggcccgggcaggaattttgtcacttctcatgtgacttcggacagttattggactattctggatctgattcctccttcagtgaaaagaaggcaagaaagcaggaccatgcagtgtgtcctgccccctctactcacacacttacacatccatatgcacacacgcgtaccgaccaccacacataatcctaatatcacgaaatcgtttttcttttagcctctcggtctggctcatttactgacaaaagtttcagataaggtgagcccttcttttccgtgcctttgtgcatggaggtcactgcttaagtgagatgcttaaaaagccaccgttcttatcgtggtagctttgctagtgtgggccgtggctgagagccaaaagtagatccggcaccttcagctgaatacctccactgatactgtgtgcacggctttacttttgtatttaagtttctcctcttaaggtcaagtaaaatgaacctatagtttaagtattagcaagtgaagaggatggcaaaatggagaactgtgctacaaacagagctaaaacatggtagagggactttgaagctacgtctacacggtgccccaagatccagtcgattccaaggaatcgtgtcacccagcttagtaggagctggtcaaacaataaaatgtcttattgattgtattcccagacttctcaatcaattgttgggaacaataataaaatagctaacatttattgactgtttactaatgtcctaggcactcttctaagtgttttaccaaaatagggcttatttaatgtgggtaataataatgacagtgataccaatataataacaagaaaaacttcagtttgcccaaagctttactattcttcaagttattctaactgggcagaggcagatcgagccagggagagagaaggaggtttgacgtctcttcactactactttattccttctttctctcctctaccccttgtcttctctcagccttctactcccatctctgcctctgtcataagcttgctagtggcacctttgtcactgcttagcaccacctccgtccagcccctgctgctgatggctctcaaggctggagaggctgctgacccctggcctacaggaaaataaagcagatggggaaagtttatcagcagcgaagagggagtggcttgcctgctctcctctcctagaccctgcatttcctggcctttatgagtacaggaccttctaagtggcagtagagcttgttctgccttttgtatcagtttacacaattgccagaattcttggcacggtgtgcagacttagggtggtgagcgtttgagaagacccaagggatgtggaagaagacacccaaggggaaaaatacgaaatacacttttagtttgtgctaaagggcagaagcttggccatatcacaccgggtggggtgtcttgcttctgtgcgtgagtgtgtgaggcacgcaggagaggggtgtgtaattatgtgctgtatccttcatttctgctcctcacatttaatgagattggcaacaataaatttgtctttccaggtgtgatggtatatatttctatgcttcattctcacttcactttgaagggcttccaaaaaaaattttatgggcagaaagagcaagtttgggattccttcccagtttttaaatcatactgatacttgtgactttaggggcgtatgagttggattttatcgcttttgttgttttcctcacaactgtggcaggaaaagaagatgacgatctctgtcagtttctgaggctggtttacctgttttgcaaagagctccaccgagacaactaacttgtgtaactcacaaaggttaattgcacaacgtaaggagccaaaagacatagcagctatatgtgcagctgcgaaaggcagaatcatccaaaggttggagggtttgttaccgcctgagtgtaggttgagaaaagaatgtgccagattccttcatccagtcacattgagctctctttctcattccagggtaccgggaggtagtgtttcccacgccatggtaagccacacatccctcctgggcccctcagtggctagtcattcacctgtaggcagggtctaagtttccagtaagaatgacagatctcccctatcctcgctaaaggcccaggtttggggatggaaggcttcaaaataaattgaatagggaacttgattcactcattagtggccttatgaatgccattttctaaggtactaatacctcactgggcagatgctccatcttagagactgtgggtttgacatttttctgggtgacacatgacagggaagaagggtacttccgcacacctttgaatgtgttttcttactttcctcttggaaatagaaaataaaaaacaacaccccaccccacccccaacacacacacacactaatacatacacacttgctgaatatgttctctaccccatacctacccttttcttaacctactcccactttcaatagaacccacatttcagaagatttaatatatttggaagacttttattcgcattgtcatctctttaaagaaaaatgaggacaggtggatttaggaagcgcttccctctgctccaaatagatccttaaatatgagtgatcgtttggaaaactggcacatgagtgagagcctttcactgctgttgcagtcttttggcctcaaagctgctgagccgtttaaataatcgcataacacactcttggtgggtggcgaggaggaaaagaaacccttaccatttcttcccttgccagtcccaccgttgacaagccaaattgatcttttaagagatcaaatgaatgttctctaaatatatgtacacacatggctgcctggaaacgtattccttccacagaatgattgcctgaaatttgaaggagagcgcagtaaagacaccaggttggaagtggggttgaagggctagggggtggagtggaggtagaattctatgcgtgcatgaggcttcacttttgtacactgtccttttgggattcaaggtgttcatcagtataatgaagcgggcccattgatttatcatctatttggtaatgtcattgcatttttagctccctgtgtcttttttgtcattgggttacattcaagcacagtaagatcaactttaaaacctccttactcaacagctttattagttatagcattccatgacctttctcaacattcttaaagaaaaagatacagtgtaatgtcgctttactttgcttattgtcctttgttggggtgaacaaagcattttctacagtggctatatcacataattatacagctttcaatagcagtgtcttggcacatatcaaagttcagaggagcctttagaaaaaaaaaaagatgttttgtggcagcctagggagggtctcatctttccttcagaaaatagttcaaggctcttctgtcaagcttccctacttagagctttttctcctcctgcttcataaagtttaaaggggattcagtggagttctatgatctatttcctttgaaagattgttcctcggcacagagaggccctttgacttcaagagttcacagattcatgtctttaggtatcatatgtctgaccttatcagttactccatttaatgtaggagaaaaagtctcaactctttgtgtttgtctgttttgcctctgtgaaatgatttggtgaaaagaccatcctttttaacacaccactgagaggccgtttctgactgtaacctaccctgtggcttttctctctttaaaaaaaaaaaaaatcgtccttgtgttttgtgtatggatgagttcacagtgagaatagaattatacaagggcaggcgcacacacaaaaaaatctttgctttcctccctcacctcccgcacccccccacaaatgatctattggctctctcggcggctgtaccccaacaggcgaagccatttagcaaacacagaggtagcggctgtggtgctgggacagtggtgggttttcccttgcttcgacctacccctaaggccttcataattaattgtccttcagcgatgaggaaagttcagaaacagtgtgtggagtgatgcctattgtctgatattcagttctccttgccttggttctttttcttcatcccacaaagggttatcaatgggagaaagagagcaagttctcttctgagagctgctggtggtggctgtagctttcagtgggatgttatcattgtgttcagcccatcctggattaaatgtctgaagaagttctaacaaccttttgaaagacagcctgtttatttcgcctagatgaaacaaattcatttagcaaaccaaagcttgttcgaagttggccaccccttttcacatggcagataacattatagatcaaatttcttcatttttccccccgcaggatgttatttaacttgaactgtttggttctttgtcagtcacagggcagaaattttaatgactattcactcactgctcttaaatacatcaatattaatttacaataatacagtttttgctaacatcctttttgatgaagcatagacgtttaatacttgaaagcagataattagtttaaaaatattgtttctccttcaatgactgccttcagccaatcttcaattctatcttgtaagatgatgtgaaacaaacgcattttgtcttcctgcaccccccaatttttggctgagatacaaaataaagatgcagtgtggagagagctatttgagaagggtaggaaaaagagaaccgtctattaatgatcattatactactgttcctgttaaatagggtgaagccaagaaaaacaaatataatcgttcttccgaggagagcagttgaactagtaaatcacagaggtttaaaataactacattgtagtgttcatgacaacttcaaggctgaagggaaccatatttaaaggcaatctctgtgtctcttatagcagtttcttttggaggaagagaccgacaggatggccagaatcgattctgccccctttgctctttgaaaacaatttcacaacagaccttttggtatttaaagagaacctgtatatggaagttgacacaactaatatagtcataccaaaaagggggtcataaaaaattaaagttcttcttatgaatctttcatgagaagcaatgaaaagggacactagtgtagccaagttctttgtgctacaagctcttcttccgggctctgagctattgttctttcagctcctcaaacagactttcactttcaaactgacaaaagtcacttaaaagccagacagctgtactaacacacccaccttactgagcaagagccactggcaggtgacaaggcctgctgagagaccttgttgaaaatgagcaggggtgactttctcgtgccttaacgttgcttttgcactcactttgagatggcccattgactgctctttttgcccccccaccccaaaacaggctccccaaaatatgttgtgcattttctttgcagtgtgcaacattgacatccgtgatcatatttctgccttacacctgtgtggctaggcacgggttctgggaaatttgtgcccttctagcagaagacagggagtttgactcacaaaactcctgctgcctcttttccttttgcccctccattcagttcaaatctcacttaaggttttcagatttctgttgcctcactagggttggatagaaaacacccaccaaagatgggtgcaaacctcaccttcggatttaagatctaggcagagatcgttaggtgggtagtcctgcctgcatcccgaccctcagggcagcagccgtcgtgggccatgggaggcctccctgtgtgcgcattacaggcctcccctcccctgtcaccttgtgtacagtctggtctgtgacactgatggtgattatgtcattattttgctctgggggccctggcacatctgcagagcccaagcacatcttctttgttgcgttggcaaatgtcccacgccgcaaatgcttcattagccctgctgccggcctccttgccagacgcctgtgcccaaatcccggcttctttttgctccgttcttttgtgtagctgatgatcatgtattcatcttcctggttcttccccattttcctcgacttctgaactccagatgtcccagttttcttgcccaaatcactccgaagtctacaatgcgaaatgaagtgactctttacccttgaatccttccccactcctgaccacctttcctactttttttcccccaaatgaatagtgactttgaatagctcgccaccatgaagactaacgttttcaaacttgcaatctgaaaagacaccaagtgattgcttccagtttatgatgagagacagggttagaatgagtttggcattattagatattgcttattatctgtgtgccttcctcctccgtccccactctgcccccctcactatttccttggatcctttatttgcacctgtgcattgccacattttaccaattttctgaaagcactttgaaatgtgagtacagaaaatactcttcatgcctcgctgtgcacgttacagtcttctgaaggttcctttctctaagtgaatcttcatctccactctaccctctcccaaaaccactgccccctccttctgccccagccctcaacaatgacctactattagatacttacagtgattaacacttggctgttttggaaacagctaaaacatttctctctctaaagttttattctatatatctaacagagccacagcttttgtgaaggtgtactggtttctacattagctgcagtaaattttagagcttaatatcttgggctgtgatggatactacataattggtatgtttaattttcccttaaatttgaattaattgatctgtgttagcatattatgagcagcttttccaatagagtttaactagtttttaaattctctaactactgcaacataaaatgatttaaatgtctccatctttgagcaaaccataagattttagttttcaggtgtagttaaaggagttaagtgtatattttatggaaatcatggttagatcactgccatgaattgtaatttgaaattcaagacaaagactctgttaagggttaaagaaaacttcctcagaggaatgagttgccacattgtaccgggttgctgagattttcaaatacctatcaaagaggggcacaagaatatgcatgttgcaaatattaggaccaatgtagccaacaaggtgagaagagaggtggtcagatcaggcgggtgggctccccaacccattgtcagccctgtgcagggagcatattgggagaggctggtacctgtcattgaatcatttttcaaaaggctcgagatatatccaaaatattcctaacctcccagttgcccaccattatggttttatcacccatgagttttacttaaaccttttttaaacttaatctcattgtcagaatataccactccttaagataataattctctaagtgtattacctgctgggaaaatactatcttctttttacggctctaaacgtgattcccctagaactccacagggatagcccttgttataatatcctgggattgtgaagagggttgtgtccatattctccatttcctttctgattttacagactttgatcattactccctcttaatcttcatctctccagattaaggagctctaatcctttttaaaagcctaatctcatacagtaagtgggctgccctggatcattttagctgccctgctgtaatgcgcttccagcctgactgtgtttttctgagggacagttacagttactaactcacacagcagaactccaggtgtgggcagtcatgccacggtttggtgatggtgccttgtgcacacccaatgggacttttttgattaccccaaaagtttatcctcagaagctggaattcttgagttggatctcagtagtgcttattggttaaaatgatcctatgagaccagctgatcagactcttggcaaatactctggcaaatatgattgtgtctataggacatacccagccaaatagaaaataggcagatccaccctgccctccagatgttttcagtgttcttgtagatcaagcactggggtatttgacatcatgaggagatagccttagtcttgaacttgagtctataataatgacagctctgggggaaagctccagtttctgctttatttgatgttattctcaggcaggcaatgaaatgttcacctgcaagtagtcaatattttatataaaacatccccttgaaatcttacaaagaaaatgctttggggagtctttccactgtcagtggtcctggatcaataccgttgtaggacttacagcatggactctccagccaggccctgggatcaaatcccagctctgctgctttctagcagtgaaaccctggcaagtgtcttaccctgcctgtacttcagtttccttatctgtaaaataggggatgtaatagtgactacttcacagagtgttgtgagaattaaatgaatctacacaattgtattagcacaaagtaagtgctgtataagcattcacatttattcatttgcagagccaagtaaatgttaccttgttgctgtgacatctgtggtccaattattgcaccatttcctgctgaccctaaataggaaagtaaacaaacgggcaatgagggagctctcatcagaattggaacatatattcaacgtaaaactggttttcacaagagcaagtgttcctgctctgaatgtggctgaaaaggcgacactagcctggaacagctccaggactctggggtcatccgttccagatgagaaggacacgatgagatgctgggggtggtggaaggagcactggcctggagggtctggctctggccatacctgcctcattgtggtctactgtgctcaccttttggaaagtgataagattaaattcaagagtttcattctagctctgaaattttgtgactctagagtagaggggcagtttcattctagctctgaaattttgtgactctagaatagaggggtattctgcattctctaaataaagtctcttttgagtcttggtcatgttgcaaagctttaagcagtgagtatagaggccctgggaatccagatggcttccatgtgaggccccttctaccctggtgactctgctgcagcttaattatctcagtcaaaatctccagggtgcccattttcgttttctcccaaggccctatttgcagatctgaatctcaacagtgcccttggagacatggcaattcccttactgggattatagagactaatttttcaaattcatacacaatttattgactgaattggcactatcattagacttgctgctcactttatttgttgccttggccagggtggccaaacaatgaggaaatttgtcagtgaagccctcatgccattgggttttctcacacattccatgcaggcctcaacacagactatcagcatttataatatgcattaacttctatataatgtacgtctcctctctttcagagcagaattggctatgtttttttttttattcttttatttttttatttttttgagacacagagtgttgcactgttgcctaagctggagtacagtggcatgatttcagctcaccacaacctccacctctcgggctccagcgattctcctgcctcagcctcccaagtagctgggattacaggtgtgcatcactatgcccagccagaattggcagttttagatgatataactaccttccctactaagcctacttggtagtgtttgcaaaagcaacaccacccttttctttaaatattccccaaatgatagtaatatagatcatgaaagtcttttcccttgagattgttttgtatgtgtgagagtttgtggttgggaggtattgagtcctcatacaagccatttggatatgtattcttcatatttcttatggctattgcacctaagttctgttttcttaaggctacattaacattttaaattagaatatggtgctaaaagtgactttcagtaaaaggtaatgtattccctgagaacaagtaaatacttgggcagggagggatggtttgagtagaggtgaaaacagagaaatgatgggaagctgaccatatgtagaagaagctgaaaggtcatggtttcaaggccactgtgtttcctttcatttagagcatccacttttaaagatttatcattttcagtgacctgaaggcgtacaagataatctgtgtagatacctgaaactgcctttcaacaaggccagtcctaggtattgacagcatcctaggttgtcccaccctaaacattacctcaagtcccattgggtaggagtctagtggacttccaaaagcccccgagttcattctgcaatctgcctgtctttgcaatctatttacctgtcttgaaaaagggattccaaagcccttcacaagctcttaagtagcatttgaaatacagcccatccttagttttgcaaagggtgattgcagagaaagacaaatagaattccctggaaatacagaatagaatttctctgacagaacaaagatcttgcagtcaaaaccaagggatgggattgaggccaataatccccatcctttcctaaagcaactcggatattatttggggtgtcataagctattgccagcagagtgccagcatcccccatgaacttgtgttctctgaagctctgtctgatttcctaccatctgtatcacaagcgctttctttggtgtttactatgagcaatccctttctcatcacaacctgcctgaaccccacttcctaacagcttctccctaggctccttactcacattgctccatcaatagcaatacagggcacacagactagttttaatattagcctaggcaaagcttaattatgaaggtaaagctgtggcagaaaacaatcacgtaatacattctcgaacgaaacaggagtaactgtggattatctgtgccccagcttcccttcatgcaatattggagtgtttgtgctatgttgtttttggataatgtcccatccaagaatggcaccaagcttggccctgcttcttttaccacctcacccagtaattgtagcaaaagttaaacttcaagggctgtcagcttgtcttgaactcagacaccaatggcaccaaatttacggggctgacttaaaggggaatttgttaacactacaaagtgactggtatatgattgcagggcttatttttccacctaagtattgagctgatttgtcagatgtgtcatgaagcagggatacattcctctgtttagcacatttaaatatgtactggcaggaaagctcccaattaaacgttcctaatcagagcagggtaagactgaagtcttcctggtccttgaccaccacgtgtgtggtttattaactctgttcccgtagacataggcagccttaactccatcgggggaatggtctggccttacaggtcgaattcaagtgaatcaatcgaactatcctccaagatagagcagaatgaaagacccaggatcagtgcagaatgaaagaccattaggcctctagaaaagctgttagccctcaagtttggctaaaagcaggggctggcaaagtatggcctatgggcagagctgcccctcaatctgtttttatggcttcaagctaagaatgacttaaatttttaaacagttgtaaaaaataaggagaatatccaacctagaccaaatatggcccacagagcctatgtatttattacctggccctttactggcaaattttgctgaccaccggctgaaggttttttctcttctgtgggacatgaactctctgagattccttctagttctgaagttccaaaattctgtgattcctttttttttttttttttgagatggagtctcactctgtcacccaggctggagtgcagtggcatgatctcagctcactgcaacctccgcctcttgggttcaagcaattctctgcctcagcctcctgaatagctgggattgcgggcgccagccaccacgcccggctaatttttttgtatttctagtagagacggggtttcaccatcttggccaggttggtattgaactcctgacctcatgattcacccgcctcagcctcccaaagtgctgggattacaggcgtgagccaccgcacccggccaattccatgagtctttgatggaatagtcttggtccagctcttacctgaacagcctaccagatgagcaatttctgcacagtgcttccagttgtttttaagatcttaacagtatctgtgtagtatctcagggggagagaatgaggtattaggttttagtttttgatgctttttccttgattttgcttgcatatttgtttgtttgtttaaacttggaatcactttttaagacctatgcagagtttgggagagaaggaaaatttgcttcatcgcgaccaataatgtgacaattatgtttcctaacacgtataataccaagacctccatgtgtgagcaaataaactagccacttaaagcacgttcactgaccaaatttcagccccacgaaataattttgacagtctctcatagacatttgtcattctgctcctagcaagctagtactatcttctactggggctatggaagagatggttttacttaccttgatctctacatgcagaattgccaatggaatacttacataatttaaaatgtatgcacaatttattaaacgtagaatagaagatgttaagacatccttttctattacctgaaagtcacaattattcgaaatgctcaaatctagaacattgttgataattatataatattttaacaacacatatgttatcaacatcataatgctgtagaaattttattgtgaattttgtattttctaaatactcttaaaagacaaagactcaaattcaggtagaaaaacaaagaagatactcagggtgtatctctgcccttcattcattgctgtggtcagagaagtctgtgtgaggggtttggccggtagcagccccccagatccgtacactgcagaccaaaattcagctcctgtgatgcttttccatggagtttccctgtcaattcaaggtagatcctcaacctccctccttggcagtttgcatgtgactgttcattctttttattacatttcctccagggggccattttcaccatgtcatatctgtttgctatcagcatttataagggctggtgtggcattggaggatgtcaagtggtctgacttggaagtgtactgccacaaactccatgtaggtgacaggaggagagacctgctttcccgttgccactttttggattatccctgcaactctttccgtctggctgacaaaaaccttggggctattgggtggctcatcacttctgctccttctctagcctttccctgggtttgcttcccccaacccccacaccccctcgcacattaacatgacattgcctggtgagcacagaagagagcagcttccaccagctgaaacctctgatctcaaactcactagagagtttggcttcgggattttggcaagaaggccgattgcccatcaggtcagcatgaataaagatttctttcttcccttcttttttaaagtcaagcatcaaccgaaactgctcccaaagctctgtctctcaagacaatttaacccctttcacctaagtacattttctattttgaatgcatggtactttgttttattcttttcctgtgagatgaccaagaaatctactatatgtaaaatttgaaagccaagtcaattctaaaccaggcttatcatttttaaagtatgtttatccagctttgtagtaggaacaagcagactgtttgaaggccacatacttttcaaaccctggttgcaacacgtctgccccgttttgaaactgtctttatctagccgagaaaacgaaaatctatttgacaaagtggcactctggccagtttatcttgcaatatggctttagctcactgagtctattgatttccttaaattaatgtttacagaatgctactgaattttgctcaacagaacattgttctttcgaagctttatatatatatatatataaaagagatacagactgttattgccatgtgttcctttgtttagaccaaggaaacatagtttttaggtttttttttttcttaagacagccttgaactatagccacttcctacaagcatttacttttcacatatttaaacagcaaaacatgtaactagaaagtgggcccaaactgcatgggtattagacgaatctaatcctcagtgttcctgaaagctgaatgccacctggagcatcagagggagaaagcctttagtcctaagcccagatgttgctggagaaccttcctctgcctcatttggggtaactcggcaggcacccgaaagcaacttcacagccagtgctcctggatcctgctagtttttccaaacacaagcatcctaataaaattcaaacaccatttagctgtttgggaactctaaatataacatcttgccctttgaccacggtgctcagtgttcaatacacaaaacctaatctctaaagatgattttaaaactgaccttcccagagaagtacacgtatccattcagctacgaacagtgcagaaaacaggattttgactcataattatgaaatggccaaaataaaacttagggaacacaaagcaacttttctcaaccggttgactcagccaacaaactcacccaagcgaacctcctcagagcacctctcaaaacgatgctttgcagacatttattaatcacagtgaatgcttcccaggaattagggctcctctttaaaatctcaaacttgtaaaccaccttatatttggatgatattttatgcttcccaaagtgcattcatgttttcttttccatttgatcctcccctggaatgagagggcactggaatagaatctcaggattcactgtgtatagcatcctgcaccattccttctcttctggagggcctgttagtccccggctgtacacacaggataaatgcatgcatgactgcaaagggagacccttagtaaccacatcttgtgaccatattttacagctccatgattcctcttttcagcctctggcaggagagtttagtgtgagtgagacagtgaagaggagcagcaataacgtatctgttcttggcttttcatctgataatctctatgaggagttactaaagcatctgagtttatccatttaagtccactctgtctgcagtgtaagtccccagcttgtgccactgctgtcaggagatgagtctctccttgatcgatatttacttaacaaacagcagggatgggagagtttgtttagaggaatcatgtgcactctagggtgaatgaatgctcgggaaagtacttcaactatttgtctccttccctaagatttttgtgtacgtgtgtgtgcacacacgtgtgcagatgcccattctctttttaacttctccaaagacacttcgaagtcatctagaaaaatacctcgctatgtatgattggtacatcattataccgttaaggagctaatgatgcagatgcagtttttctaacccagcaaagtttggttcttcttttgtgctcttatatagagcacaaaagagactcttaggataaactaaatgcacaagcatctacctttgacccctttcagatgagtggaagggaagaaaatacggatggaaacaataaaagcagtttgacaaggcagctcttcactatgtatttttgatggcattacctatatatttttaaaggcccacagggacaaaaagtaactttctccaatttttcagagctgcttcagcattagatatatttaactctactactgtatatgaattccacggtgtgaaaattgagagagcactgttctttcgagttccctgaaacaattgcttgaaggctcaagtcagcctcttgaatgcagttgacttggaggcatctggggctagatcgaggggttttgtttctgggtgtggggagaggctggggggtggctggggagttatttatttatttgattttgtgaatcggagttgtaaaagccatctgaaatattcatgcagaatagtctgagaagcccgtttctgttttatttaccgcacagtagaacagccacagcggattagttctacaatacccgtaacaaaagcccaacagctgatgcatgtgatgttaggaggtgacaaaacagttaaagtatgctgctggctacaggcaagcagtcagcagatgcagacaaaagggtttgtgacaagaataactctctctccaaggcgagcagtgaagagtatccaaaataccagtacccttttctccttgacattgtcttcttacagtcagcattttattgcccttttatagtataaaaaaaaatggaggaggaagaagaaggaaaacccacacacaaactaattcaccaaaatactaggcaggattgtactttcccattcgctagccatgcctgccagtacacgtgtccttttccatttctccatcgaagcaagtttgaaaaaaaaaattagcttaaaagatcagctataaagatgatttcccttgaaaagtttgtaatctattgataggcttgataggccattggagcctttggttacgggttggggggtgggtggccagggaaagaagtcgatgcctggtttgttttctgtccatttcagtgaagatcatttcagtgatgaaatgaggccagagggccaatttttaaaggggattgaggagggaggagtgtccatggagaactgagcaaggggcaaggtttaggtcccccgcaagaggctgatgaatgagcttacggacggttcagaggtgtgaaaaatgagcttctctgtctccagaaaataggagaggctgtcttctttttaacctttgtaattccccttctattctctgtgacattcattcagctgccaagagcgtttggcaaggtttgggccagcgagcacacttccagtgaccgctaaccttggtatgtcctgacacttatgatgagtatctgcaggacacagaaggcaggcagcctgctatgtcaggcttttattatgtactgcagaggctagggacagtcagtttaataaaacaaatcatccttgaaggtaaagcaactgggaagaggaggaagacaggagaaaaatgtgtctttgccactcattccgatggaaaaaaaaaagaacagcaaaacaaccacccacccaacacaccgtgtgtgtgtgtgtgtgtgtgtgtgtgtgtgtgcgcgcgcgcgcattcgcgcacgcacacacacgcgcaacccagctgtggactgggcagacttgaaaacctcctctcattttctgcatttcatggaagcccagaaggctcttgtttgctctgaggagactcaagtctgtgatgaaattggtagaagctgatagccaacccccttcaaatttatgcatatcttcaagtacctcattactttatattcttctccaaatatcaaggcaagaccatctggggtgacgttcctatattgggatgcctttttatcaaaacaaagtttccactctcctctcctgaggaacgctgggcaaagcagctcccacaatagcctcagagttccagccaaagactttggaagccttttgttttttccctgtggcatgtccaaaggcagggccttctcccctcctccgcccgccctccccagccgcctgcattgtcttgcattccagtgacttgattgactgttaccacctgatgctgaggagatactctagggttcattctgcagattgttgggttctattaaaagaaacctagataagggattacttgtcactaagggattttctgcagatgtttattggtgatgggaaagccattaggtgtgaagaggtgcagaaaaatatggacaacatcattctgataagactggtttctaagatgctcccacaaaacatcagaaagtaccccctattattctgttaaatggagctgggtgttttcaagcagaggtaaaggtctctttttccatgggtgatgtttctatgtgtggatgaaattcactggaaccctctcagaagatcagttgctacccaaaagtgtacctctgggagccaccaaacacatgagttgctccagtagttcagtatctcattacaactttcttttgtccagtccagtccattgcatgagtatcacctcaaagtaagcactatattaactaatcattttatttgttcacaaagaattcatttcttcccaaatataaaccaataaccaaagtctcctccagggcatcttttataccatttccatttattttgaagttactagattctctgtggtttttcaagattacagaggcacagcttttcaaggttttggtgcctcatataaatagtagaaattgctgaaaaagcattaaaagggagccagcatcgtttaatgcaaagacaccttacctcacagtaatctcttcatctcatcatttcttcatctcatacaatctcatgctttcttcatctataaagtgatgatttctgagatctattcgaactctttgaattctaccttactttaccattattttaaacttctttttttttttttatttttgagatggggtctcactgtcacccaggctgtagtgcaatggtgcaacctcagctcactgcaacctccgccacctgggctcaagccatcctctcacctccacctcccagtagctgggaccacaggcatgtgccaccacacccagctaatttttttgcatttttggtagagacggggtttcatcatgttgctcaggctgaagcttccctttattaagtattgttaaagtattaagtaactgccactctagagcaatatggagtaaagcagaaggcaagatctcactatgagctatttaccaaataactttgcaaaagatactctgctgaggctccttatctagagacaccttatgatgaggtaattgaaagtacataaaagtagataaaaagttaaacagcatcaagacacaaatgcaaaaggtgataaaggataacctatgattgccaccacaagaaaggaatatttaaaacagattaaaacccactaaaaaccattaacaagcatgacgaactataaaaatgatgaagaggagactgcatacaacccccaaagaagttgccttgttctcatgcaaatcctacaactacacttccctccctcccctgctgctgatgttctagatgtacctcttctctctcctctgacagtcttgaacaatgcctgcccttcccctgtccctggttccccagacctcctgtgcagttcttggtgtgggcagggcttccggccttctctggcttctctggggcagctgcccacaccttcacccctcaaagctctctgccatgtcatgctgcatccctgagtgctcaaggaacatagaatttcactgaggctgtattgccgttggctgatgaaaccacccttcttgaaacgtttattttaataaatgcctataattggccaggtgcagtggctcacacctgtaatctcagcactttgggaggccaagacgggcagatcacctgaggttgggagttggagaccagcctggccaacatggtgaaaccccatctctactgaaaatacaaaagttagccaggcgtgatggcacttgcctgtaatctcagctactcaggaggctaaggcaggagagtctcatgaacccaggaggcagaggttgcagtgagccaggatcatgccactgcactccagcctgggtgacagagcaaaactccatctcaaataaataaattaataaatgcctatgattatgtttctgtagcatttggctaacagctcccaatccaaggagtgagagtgggcagttgctccgcttcactgttctccagccacattccctccctcagtgatgctcatttgatagaatgtggaggattatctttgggggtggaggtgactgtgctagaaaagattgcttcacgaatttttatttgtataatgtgagtgggagggctaagctctcctccaacaaatactcatgtatacaagacatttgggaggaaatcacccaaaggcctgtagaaaatccacatgaattctcagcagagaatggcccttgaggtgtatgggtttgcacattcatggcggacaaggcggcactttgaaggattttccaggcaacactgggaattatgtcctaagaaatgggccagtgtgaaagtctttaggagggtctgataaaaatgtaagcttaagactgattggccccaaaaggagtccctttcatttttttctgcagagttattacatttctttataaacaacaattaacttgccatagggaacaatgaacttctttgtccaattttaaacgtgaaaaacagtgatgtcgggtgatgattctggttttctttaccagttactactattgttaaaaagtacattgcacccaaggtgggaagaaagagatgaaacatgttcaacattacactacttcctttttactttggtacgtggcatgtctgaacttagatgaaatgtctttcatctcttgtatatgcgtagataaatatggctacatgtacacctatgatacgtttatgtcctcatacgtctgcacttaatgtaaaaatgaaactttactggtgtataagtaccccactaaaagaaatctactaagtgtcaatgtgtacttggaaaatcatgagttcatggattattctgtgattccattatgttggtgtggggatagatagaccatgctgtactataagtaacttccaaagaacactaaataagtacatcagtagctactgctttccttagtcaagagatcagattaataagtaattaagagaacacacacacacacacaacacacatacatattaattgctgtggaagaaaagccttaagaaattggggttctaaaatgaatatttggggaatgtttattttggatgataaggaccttgaggaatttccttaccctctctgagcctcagttttctattgtgtaactgggataataacaccccttagagagattgggagaactgaatgacataattcacattcagtacataaaacatagcctggcaagtagtaaatactcgaaaaaagttagtttgtattattattattatcagctgaataaatcactctcttatggagcaattctaatctcaaggttaagtagtttctgatgtaatattttaggatcagttttgtgacttcatgttaatattattattttactcctttatgtatatagaatactttatattgcagattaatatacaacttagcatctgagtcaacaatcctctgagacaaacagataactgagattttagaagattttcttcatttaaagcttgggtttaatttataaagaagcccaactatttgttattctattttgagaacgtattttgttttcatcatggcaatcaaaaagaaataggattcaaattctgaaaaaataattggagactttcttctggatagcacttatttaataaagtgaggaatcccaaaagtcacatcccatattcctatcctaatatccacaatgaaatcccagtttttcaataggtctgcgttggatctttcatacactcttcttaaaacaaagctgtcaaccccacatcacaatgcttctatatataatgactttacattaaaagaatagaagccagctatttttagaaaatgcaggtgccatgtaagcccctttctgcaagaatgatcttagctcagtttccttggaataactgtagacttgaaactgaaaactttattaatgccattgtctccttgtatcagcaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaagaaaaataatcactctcaagccttgtctaagaaaagaggcaaactctgaaagtcgtaccagtttcttctggaggcaaagcaattttgcacaaaaccagctctctcaagatgagactagaaattcatacctggtcttgtagccacctctctaaacttgaaaataggttcttcttcataagtgagcttacatcattcttcataaagaaaaatcctataacttgttatcatttttgcttcagatactaaaaggcactaagtttccaatttacgctgctcaactttgtttatatgcttaaaaggattctgtttacttaacaattttttcccctaaaatactattttctgaatacttccttccagtaaggaataaaggaaagcccaacttggccataaaattcttgcctacactagaagtttgttgacagccattagctgacttgatcgtcatctcctaagaggaacacatatattttcacaagcaattccacactatcctgatgggtatgcaaagtggtgacagtctaactcagtgtttcttcattttaggtataacattttaaagcaattgataatgcctcttccaattcagaagctagtattgaccaaaatgtgagaagagtgtatagcataggaaaatttggggttaacccaaaagacacaattccagcacacataagaaagctagctgctattttatgctttcttccatggttctcctcttttttcccttttatttttccctgtttttcaatgatgtacagtgttccctacttgcattgaaaaaactcgtatggcattcacactttttttcttaggtgggtttttgtgtccagatgcagtaagaattcattgttcatcctaaaactgttttccagacccttccttccccttaggtaatttgatatacacctcctaaaatgacacagtaacaaatctggtatttagaacatatagaacataaatgccattttttaattcaactttaataagaattacatttgactttggagaatacaggtcttgacccatgtgactgactagctgacccgatcgctgtaatttaacgtcatttataaattctgctgatggacaggaatgtatgaactcaattattgtcagcacaaagccttaaaacctgctgactttaaattaaatggtgcagtcctatgatgccctgcaccatccaggggactaacagggcctcgcagtgtagacagagggtgcagccacacgggcgggggcaccagccacctcactctgcacccgcggcctcacacatctcccagctcacactctactaatgcacagagtcattagatccaatttgttatttttctcacttgctttaaaaaaaagcagtttggataatcatgacattggaataaagtgggaaggaaaaattccatc

SEQ ID NO: 16349 - DNA, 44881 bp, Human
tttatgacagatccagtgacactggaatggacacctttttgattttggggttccttcctaagacccccatgtgtgatatattcatggttggattctaggtactgaagcagttactacagctggatagtccaatgagtgtaagaaggcttctctacaaacacatgctgcccacatcgaagttcctctttaatctactgcagtttgaaattgtcccccactttctccaagagtccactccaagctagtttagggttaggtctaccatagcctttggaagagggagggaagataacttttctcatctctcctagtcccagctctaaagaccagaaccagggagaaagcaacacagcttttccaaacacattccccaaatgtggcaccttttcaacaattttagtaacaaatttaaggcatcatagatgcctttaaaattggcatgatagatgttagagtgatcataaaaagactttaaaagaggaaaagatgtaaagaaggtaatcaaatggggagcatgtttaacaatgtgctcacttcttccccttcaattccttgaattgagtctgcattatcattcctattgatctttgagcccagaacattactttgtggtctggcctaaggtttcttccaattttttaaattacaatatccctaagaggacagcgacgaggtctggggtgttatgaggattggaaacctagccacaagtgaccatgaaagtccaaaatgcctctaaagtctttgtctctaaggcccattttcaaggtcttgttatatagctaatttttccccgacttatgtcaaaaataaacgaagctgggttctaggtaaaatggtaggggcagattttaatcactactactactgcaatggggaaaagaacccagcgtgaactgaattcaatttcgatttgtagaggcaaccgggcgttttaaagagaatgaaggaattaggatgggactgatgacgccgagggggactgagcaactttttcaggtttgaaaagcctcaacatcaacgcgcgacggcgctctttcaacatcagcctccagaactggggctgcagccaggagggaactacaacgcccagcagccccggcgggtgtaaacactcccaacttccgaggcggtgctcaccatcggccatcagcgccagtgccactcgcgccctcaagaagccgcacggagttcgggccggcagcagcggctgcagtcgtatggcagtgagccgctgtctacccagcgagacggagagctcaggacgcaaccctacgagttggaagccgcaggaggcggaaccgggttgcgggatacgcgttgacgtcacatcctctgggcggggccgcaaggaacccgcgcaaattgaaaggtcagcctttcgcgcgctgtgtaggcaagttgcccgtgttctgcgttgccggccgtgggtgctctggccacagtgagttaggggcgtcggagcgggtttctccaaccgcaatcggctccgctcaaggggaaggaggagagtcccttctggcaaggtggaaggagcgggctgtgcggaggctaatgggtgggttcccttgggggtcgacctgcgcgtcacctccgaccctcctctcgggattcgggtcttccaggaagggaaggagagggtctggcgtgatcttcccaacccaacagcggagcccttagcctgagtggagtatgtgttttgttccgaggggacgtctggcaaccagaggtctgcagttcagtgaacggagggagataagagagcagacgattccgggctggagcaggcgccagggttgccagacttacctcatttttccgcagaagctggcagtccaggttttacatgcaatctctccacctttaaatgttgacaagtacattttcccataatattttgcaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtaagagactgtttttctgaaactgtggcttgaggaccacctgcatccagattaactgctttgtttaaaattcattcacagcagaactagtgaatcccagtcactgagtggagttgagagtctaagaacctctgaaatttgagaactgctggaccagagcctttagagctctgataaggtgtcaacagggtaaagctgcctcctgatcctgtactttctttcttcctttccttccaaacttaacgtttgataggagagatttgtattatgaaatgctaagcaactgctcagtgcccattactgactttttattgtagagtggggggaggtcgtttcatcagaaagggttgtgacagttccagaatctctgtatagaaagggcttagggggctgcaaccggaatggaagggggtggaaagttaaagcatttgtcttgaagctgtatttgcatagcagacgcagtttcacagttctttagggtagctttcagagaggctgatggagttgcccctgggcgccaccactgtttattaccagaatgttcgtgcttagaataatgcgttctaatagcagtgaatttcagtcctaaaaaagtacaggatcatttctgtaattctttttgaatttttcctttgttttttaattgaaatacttaccttcctacaaactgttttgagtttctactcctatttgaatttgcacgttgacccttatgattaatgccctttgtagaggcaatgcgatgccatcgcatgcatggttttgtttgtgcctggctccttgaagcatgtgtcaggagtgaaagtgcaaaagcactttggaaagactaaacaaacaataagcaacagtcaagtggcattagaggtagtattagtgattaatgtaaattctaccctatggaaattgtttgatagggaggagcccagctaaaatattaaagagcagtgattcttgaatatctgaacaatttctggccgggcgcggtggctcacgcctgtaatcccagcactttgggaggccgaggcgggcggatcacgagttcaggagatcgagaccatcctggctaacatggtgaaaccccgtctctactaaaaatacaaaaaattagccgggcgcggtggcgggcgcctgtagtcccagctactgggaaggctgaggcaggagaatggcgtgaacccgggaggcggagcttgcagtgagccgatataggccactgcagtccctcctgggcgaaagagcgagactccgtctcaaaaaaaaaaaaaaacaacaaaccaatttctgcattggactccaagctttctcttcatttgtctaagatgttttaataaatgtatttttctttaaatattactgttctccctgtctcttttcatatcaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtaagtctggaccttatgttaattctttgacaattaagaatgagacctacagtgcctttttttctcccccagaaacggattgttttcactcaatgccagaacttatcaggaagtaaaagttgtatgttttagaatattcccaaatcagggatgacttccttctgtgataataggcctagttttctttctttataataagccagagtatcaagacactgatggacaaagactattaatatctcctttattctttttttttttttttttttttttagatggaatctctagctcaggctggagtgcagtggcacaatcttggctcactgcaacctccgcctcccaggttcaagcaattctcctgtctcagcctcccaagtagctgggattacaggtgcacaccaccatacccggctaatttttgtatatttattagagacagggtttcaccatgttggccaggcaggtctcaaactcctcaagtgatccgcctgctttggcctcccaaagtgctgagattacaggcgtgagccaccatgcctggcccaattcttaacctaagataaattttttaacaaatgctttgaaaatccgtgatgatttctgactcccacattcttgggtacagaaaacatactgctaatcctggttagcaaaaaaacaaatgtgttgtaaaattcattataatttcatatttgctttctcctgaattttgctttatgatcagcaggtcccaatcattgttccataccaatgcaagttcactgtcactgatctacaacacatagaaaaaataaggataacaatgtagtgagtctttcatcaagatgacatatttaaaaggtcatcttttttttctttattttagctgctaagtttgcgttatgcaaaaagattaaagattgttttcccattcctgtttttgagctaaaatgtccttttctttataaaatgatagaagttgtaaatgcagttgtttttgtcacaatacctaatgtaatacctgacccttgattggatcctggatttggaaaaaatagtagcagtggtgtcctggagccaattcatatgagctctttatacaccatgtcttctcagctcagcattcatttgagttcaagtaggtagctcatctgccattgagaaatatttatctcagggaaatcaggcacctcttcccgcagaactggttgttaaacatttaccaggacaccactgaatataagaaacattgttgagacaagtgtaccaattataatataaactgagtattagataatattatgttactattaaattacttagctgtgatatggtgtcgttggaagaatccagtgtttattgtactattctttcaacttttcaatagatttgaaattttttaacataaaatgggggggaaagaccagatttgaaaccaaagatgtcagaattagaagggatatcaaagctctttaattcacagataaggaaaccaaggcttggagggtcaagtagttcaccagacatcacatggctcgtaagtatccaaggcaggatttgaatccaagtctagtaagttagagttccaattcctatgaaaacatctgcttaaaataacaaaataaaaaaccttctctttccatagttttctcatctggcctaaaatagagcagaagtattaccttaagaaaggtgaagcactgaatgtttttctttttttccataggtatgtaggattttgtatgaaatttgtaaatatgttactatctcatgggatcaagcctattctcgtatttgatggatgtactttaccttctaaaaaggaagtagagagatctagaagagagtaagttaattctctacttaatctctaacttcattgcactaaggtcagacactgtagtctatatgataccaatttttaaaattttaagccaggctcagtggcttgcgcctgttgtcctaggtactcgggaggttgaggcaagaggatcacttgagcccaggagttcagcaccttagtaccctatgatcatcgctgtgaagagccactgtactccagcctgggcaacatagtgagaccccgtcactaacaattttatctttattttttgacagtctcactctgtcgcccagtctagagtgcagtggtataatcttggctcgctggaaactccacctcccggattcaagcaattcttgtgcctcagcctcccgagtagctgggactacaggcacgtgccaccacacccggctaatttttgtgtttttagtagagatggggttttgccctgttggccaggctggtctcaaactcctggcctcaagtgatctgcccgcctcagcctcctaaagtgctggaattacaggcatgagccactgtgcctggcctaaaaaaaaattaataaataaaattttaatttgttgaggcttattttatagcctagtatgtgaacagatttccttaaatgttatgtatctgctacattatcacttttgtttaaaagtatcttcgttactacattttctttgacaaaaagaattgctgtggaaaagcctaatggtaatcttgtgtgtgtgtgtgtgcatataatcattctaagtcacttgttctttttgccttagaagcctaaagcatctgggttaatgttctcaagggcctggtgtgtactttctaatgagtcaaaaacttttttcagttctaggaaagcttcttgaattacagttctgttacagtttcttgagtcagcctcttaaatgttttatatttaaaaaatgttcttcccttgcagaagacgacaagccaatcttcttaagggaaagcaacttcttcgtgaggggaaagtctcggaagctcgagagtgtttcacccggtctatcaatatcacacatgccatggcccacaaagtaattaaagtaagacaaaggggcagatgggcaagttcaccaaagctagttacaacttgtttattgatgggagaggaagaaaatcaagggtggaaaattgttctaggcctaacctcaagtaaagggcagatgtcagaaggagaagggaacagcatcactagatagagaagacttcagcaatttccaaggagaaatcctaaggcataagtaaggctctctcttttaagtcatgttgttccatagcaatggaaggaacagggccaggcacggtggctcacaccagtaatcccagcagtttgggacgctgaggcaggagggtcatttgagctcaggaatttgagaccatcccgggtaacataatgagaccctgtctctattaaaacttaaaaaaatgaagagatggaaggaacaaattcctggaggcatcggtctcacccaactctcctacagtcttcaacacttactgtaaccggcactcttgaatgacagatctgtgatgtagcttcgttgccccaggcaccctacagacttctgttccctttcacctcctccttgcagcagcttctttccttattcctgtaaatcttagtgtcaaggtgcccacattcccagccctcactttcccctttttagagcctgcttggttaaggtgttgtggtttttttgttcgtttgtttgttttgaggcggagtttcactcttgttgcccaggctggagtgcaatggcacgatgtgggctcactgcaacctctgcctcccgggttaaagcgattctcctgcctcagcctcccaagtagctgggattacaggcatgtgccaccacgcccggctacttttgtatttttagtagagatggggtttctccatattggtcacgctgggctcgaactcccaatctcaggtgatctgcccaccttggcctcccaaagtgctcggattacaggtgtgagccaccgtgcctggcctgttaaaggtatgatggtaaaggtgaagtcagctttttctagcttacagttctgtcatccagttcctgagctaaaataggcgctacagttctgattttggctttgtcatttgagtctctggctcttttctgtatgggtcaagctagaaggaaacgatgcgatgcaggacagagcgtgaagtataaagaaatgtgtgctctgtgtagtcaggagaagagaggctgcattgtgtgcggaagtagagaagaaaccctgattggacacaaatagtggtgtaaaagtgtgtccagaattggtgggatcttggcctcactgacttcaagaatgaagccgcagaccctcgcggtgagtgttacagctcttaaggtggcgtgtctggagtttattccttctgatgttaggatgtgttcggagtttcttccttctggtgggttcatggtctcgctggctcagaagtgaagctgcagacctttgcggtgagtgttacagctcttaaggcagcgcgtctggagttgttcgttcctccctgggggctcgcggtcttgctggctttaggagtgaagctgcagacctttgcggtgagtgttacagctcataaaagcagcgtggacccaaagagtgagcagtagcaagatgtattgcaaagagcgaaagaacaaagcttccatggtgtggaaggggacctaagcgggttgccactgctggctggggcagccagcttttattctcttatctggccccacccacatcctgctgattggtagaaccgagtggtctgttttgacagggtgctgattggtgcgtttacaatccctgagctggacacaaagattctccactgtccgcatcagattagttagatacagtgtctacacaaaggttctccaaggccccaccagagcagctagatacagagtgtctattggtgcattcacaaaccctgagctagacacagggtgctgattggtgtgtttacaaaccttgagctagatacagagtgccgattggtgtatttacaatccctgagctagacgtaaagattctccaaggccccaccagactcaggagcccagctggcttcacccagtggatcccgcacggggctgcaggtgaagctgcctgtcagtcctgcgccgtctgcccgcactcctcagcccttgggtggtggatgagactgggcgccgtggagcagggggtggtgctcgttggggaggctcgggcggcacaggagcccacggagcgggtgggaggctcaggcatggcgggctgcagtcccgagtcctgccccgcaggaaggcagctaaggccccgcgagaaatagagcgcagcgccggtgggccggcactgctgggggacccagtacatcctccgcagccgctggcccgggtgctaagccctcattgcctggggccgacagggccggccggctgctctgagtgcggggccgccaagcccacgcccacccggaactccagctggcccgcaagcgccgggcgcagccccggttcccactggcgcctctccctccacacctccctgtaagctgagggagtgggctccggccttggccagcccagaaaggggctcccacagagcagcggtgggctgaagggctcaagtgccgccaaagtgggagcccaggcagaggaggcgccgagagcgagggagggctatgagtactgccagcacgctgtcacttctcaaaaggatgagagtaggactattgctggaccaaaaaaggaaaaaaaatgagaaaaatagcaaattgttaccaaaattgatagcagcaggatcttgatacctctttcctctttttttctttttttcttttttttttttagcttcccaaagcctgtcttcaggccttgggaaccattttcccatagtttagaacatggaagttccagttccagctgcctagattttgacacagcggctatgataggggctgtttttcttggcaagtttattttaaaagtattttctcataatgcattggtttaaatatagtgctatagcctataatatatatgtaagatacattattagaggagagttatgtatgtgtgtatatatacgtgtgtgtgtatacgtatacacacatatacctacgtatatattttccccccaagacattgctggatatggtctataattttatcaatactgtgtcagtacactgactttcgtagcttgacaggacaacctgttatttttatggggaagatatattcaaaactccaaacaaatgtatattttaggaacatagccattcttaagatggaagttttctataatttaaaataagtgggccaggcacaatggctgaacgcttacaatgccaacactttgggaagctgaagcgagtggatcacttgagtccaggagtttgagaccagcctagacaacatggcaaaaccttgtctctacaaaaaatacaaaaaaattagttgggcatggtggcatgcacctgtagtcccacctactcgggaggctgaggtgggaagatcacctgagcccagagcccaggaggtcgaagctgcagtgtgccctgccggctggcaccactgccactccagcctgggtgacagagccagaccctgtctccaaaaaataaaatgattacttttgtaacttgtaggattctttttatctctggctgtgtagcagtatttcttttctccaaattttataagttgattttttaaaaatgtcttaatggctatataattagttcaacatatactaaaacttatagtagaaaaactctacttcaaaggaaatgatttctcaaagtaatattagcatgtgcctgctgaggctagtaataaagtgggtttgaaacaggaagttgtttagtactttccagatgccgtgctagagattcactgtgattctctcttctaggctgcccggtctcagggggtagattgcctcgtggctccctatgaagctgatgcgcagttggcctatcttaacaaagcgggaattgtgcaagccataattacagaggactcggatctcctagcttttggctgtaaaaaggtactcacctctgactactatatattacttttctatgtagatagtagtgtaaatcaaggagctgaaatttttcctgtccaggaaattatgataatttataatatttataaaatttataatatttataaaatattacaaggtaaattattgtatttaatagatatttgcaactgacatctatttttataatgttaataattatttaaaatgaaaagaagggttttgctgcttgatgtttgtgtaatgtggatactttttcaaagtaagcccttaaggttggaggggtttgttattgttttatgcagattctttagtagaatgtggacgtaccagttttattttttaataatgacaacatatgctttatatttcttgattaggttaggtatactaacttatgtactaaagggttgccatgcagttatttagaattatgtataaaactatttcatggaaaactttatttaggggagaattaagatacaaaactacaggatgttctcatttttgttaatgcctatatttatgactagaagggtctctatcaaaaggttaatactaggttacagtgataaatgagggaatagggatgacttgttttcttcctgaatttctatattttccaaattttctacaataaacatgaattgcttcaataataaggaaaaagattacttaaaaggtacaagtgacagagaaagagaaaatgtttttcgtatgcattactgtttgattatcatgacaaccctgtaacacaagtaggaaataaagagatgcaaaaagagcttgctttataccagaattgtgacagttgagtcctagctgtatagccttgtctagtcatatcctatgcttcagcatactttatttgtaaacttagtaatcatcagcctgtctatctatgtctcctgtctttcagtgttatggtgaagaacaagaaagatttcttaaaattattgcagtggattagataatgacaaaagtggcccttctaggtattaacaatttcccttccttttgaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggtaagagtgatttgctaagtgtcatattcaatttctgaagcatttccttaataaaataataaatcataatatggatttaaatattctgttatgcgaataacctatattacattattaaaaggagcaaatgactgaggcactagaactttgccttagcaactaacatatattgggaaaatcatgttttctgcaattggcaaaaaagtagtgatttttaaaacaaagactagtataaagaggctcaaggagaaaatattctagggtaaaattaaactcggagtcttttgacttctgtgctataactctatagtagtggttctcaaactgtttggtcgcaggatccctttacactcctcaagctcctttatggtaatattttttgtttatgtaggcgatagctattgatatttactgaattaaaaattaaaacaaaaatttaaatgtttatcaattcacttaaactttataataaactcattacatgttagcataaatagcatgcttttatgaaaaataatcattttttaaaacaaaaattatgagagagaggaatcatacatttatgcaaatctctttaatgtggcctaatagaagacagctgtgttcgtatacaagttgaacatccctaatccaaaaatctgaaatgttcaaaaatccaaaactttttgagtcccggcaggcaagtgaaaaattccacacctgatctcatgtgaagagtacacaaaataattaaaaatactgtataaaattaccttcagtctatgtgtgtaaggcttatatgaaacataaattgagttttttttcttcttcaccctcttgctgtcagtgtgtggaaacgtaaatggattttatgtttagacttgggccccatccctaagttatctcataacgtgtatatgcaaatattccaaaatctgaaaaaattcaaaatctgaaacacttctggtgccaagcattttggataatgtgtacccaacctgtatctgctgccttattaagcctcatttgataccatgtatcatatatcatctggaaaattctgagactctggacattgctactttgtagtttgtcttaaaaaataaacatcaaagaagctcattttcccccttggatattctctaaacccttaacagtttgcagagcagaaatttcatttttctatttccaggagtataaggcctgagtcctcaggactaagagtgatgtcatgtaatggaaagatctctaggttggaagatagtgtcccaggtgggaataggaccacgtgccttaactagcctgtgactccaggatccgtttggttctctgggccttccctttttcatctatgaatttactgtgcaatgtttaggatcctttccagctttaagcatccatgactctcacagaaatcagaatgtcaacttggtttaaaaatatgatctagaaatatttgcatttttttaattctcagattttggatgttctttttttttcctttcttgataaaaaggactttgaagatgaatggataatgtatctcaaagttacacctagaagcacaaacttgatgtactatataactgtattttttttatccttcaaattagtaatagaaaaaccaaagaaaatactagttatgagacttagaattttaagtgatgtaacatggttgtgttagctggtagaattttttaatgtagatgaaagcagttaatgtttcaatccctctttatgaatgtaaatcaatcagccttgaggataatatgttccctgttctttagttgcagataaaatatttttgcatgcattgttaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcagtatcctttctgaaacagaatggtagaatttgtgcatttttcttcaatatttttatggtgatttttttgtgaggcatttagtaaaaagcttgcacattattttttgctctcttttttatagtgaaatctgtatattgttcatttaaattaccatgctagtgaaaattgagaacaactttttgtttataaacccgaggctcatccactatgcatcctgattacttagattgactgacagtagcatgcacagggtccgtcacttacggtacacattccaaaggtggctcttgagaggacctcctcgtggcaagcaagctcgacttatcaggaagagcattctgggcatttgagtgcatcaggagaggatgcccttcccatagccactggccatgtacatgcaggctgatgcagagccctgagtcacttaggtggtggctaggactttcccctctgtttcccttaaagggagggagtcagtgatggcctgggcccttgtcagaagacaccaactcctgcagagacagatagagactagcaaactgtgtctgctttcagtaatgctgatgtataaagtaaggagactccatttaagtcataaacctatggattttcgtgacaatagaaaacatttttccatcttagtataatatcatttggttggttgttaataaatacatttttccttaatcttgctaatctagatatgttgatgattccatagctcttcaaatagcacttggaaataaagatataaatacttttgaacagatcgatgactacaatccagacactgctatggtaacgttttgatgaccaccctatgaaaacacgttttagttatgtcccgagctgtgattaaaggcaaatcttcatacactaagcttcttttaagcgtttctatatccaggctctgtgcagaatgtacattaaaaacaacttgatcctagagaaattacatgtattagagcataggtatattggttaattttttaaaattaagaagtgactgttatttattatcaaacccttatccttgagcatttcatttgaatataccaagcatttgatgcctttttttctcatctcactccattcggcttctgtggcatttggcatcattgaagacccaagcctaggaatgctacgggagttaaagctgttttttcactcatgcacaatttaacaaatatttaatgcacgcccctgctgtttctttaaacaatttgctgttttcttttatttttcttttttgagacagagtttcattcttgttgcccaggctggagtgcaatggtgcgatctcagctcaccacaacctccgcctcccaggttcgagcaattctcctgcctcagcctcctgggtagctaggattacaggcatgcaccaccacgcccggctaattttgtatttttagtagagacaggatttctgcatgttggccaggctggtctggaactcccaacctcgggtgatccgcccacctcggcctcccaaagcgctgggattacaggcgtgagccaccgctcctagccgcgatttgctgttttcttctgcttcttcagtattgtatgtattccttaagatactgtctcccatcattgtctttctctttgtatttctgtttatcctctgttctcttttctgtttacatttcttccttaggtaagtccttagggctttaatcccatttacgtaaagaactcacatctccatctttactccagtctctcgcctgtgcaccaaccacagaattctcactgtctcttgcgtctctgatttcctgtagcctccaagtctatttataggcaaaactaaactcttcatgtttttaatcaacttttaatcacatttctcttttatttcctacttagcacttattactgtataacatgcttctattcttttctgattctttccaatagaatgtggtcttcataaaggcagaacttggtgatcctcactgctgtatgatatttactatgtttatatgttgagtgaatgagtgttagccacaggtctcttttgttctcacactggaaaacttggaaataaactttggcttccatttcgttgctacatcctcttgcctctttgagttgtccttctggttaacattttcttcttttcccaagcttccagtttaattcttgctcactaatttatttctttactaaacatttatcaagcactgaaacaatgtaattaggttagctagggttctggaatataaagaaaaataagaaatacaggaaaagtaagatccttgcctgtcaaatgcccattgcctaaataggaaggagaagggattctatagaaagaaatgcggtaagtgctacgctaaagaggtattccaggctctgtggaaataaaaagcatgtccctcactccacctaagagaatgcttcctaataataatggcaaacattttctgagcatttgctactttccaggtgctcttttaagcaccttagacatagtaagtcatttactcttcagaaagcctctgaagtcagcaccattctcattttacagatgaggaaacaattagaggacacttaagtaacttttccagctgaccattttcgtaaataggggagctgtgattccaagccaagttctctactgtctgctgaaagagaaactgatgtgtatcctcagtttgcaaggattagtagagtttttcaagatgggtgattccaggctaaaaaaaaaaaaaacaaaaaaagcgtatgtagaaaaaagtgatatattaagggaactcttagattgttcattatggatgggctaagaatatcttagtgtttaccatgtaaaggaaccagatcttgagaaaaaaagaagtgagcctggaaaagatgaccactaacaaactggtgatccattcagcatggaaaagtaaccattactgtaagctgaaataagccaagcctaccaagagagcacaaatctataacgaccctaaaaatgaactttatcagcttcagtgatgtaaaccttacactcaggttgctattcccctattttctaaccttgctccatgtaatacggtagccactagccatgtgtggctatttaaatttgttaaaattaaatacaattgctattttacttccttagttatagtagccagctttcaagtgcttagtggttagtggctaacatagtggacagcacagagcttttctatcagtgcaggaaattctgctgaattctttacttctactatcatatttttatatctagggactctttaattgtacttttttttgaagatttagatgtcatctcttatctttctcagaatatgataattttttgaacgttttcttccgctctctgtaactgctgtgtacctttttcctgtgttgatattttctccctcatggtggtaacttctggccagtcatatttgaaggggccccgaaaagctcatggggaacattgtgtgaatgagtggggcttatgatgttggacttcattcttggatgatgtggttggtaacacattggatttgatttgtgaattctccaatgttggaatgttctctgcacagttacatttttccaaaaagagatgtctgcttagggtatctaaactttggctgtctgtattttgaaagcaggatagggaaagtgagttggggcaggccaggaaagggtagcatggttccttgccattcaatatttagccttttgtttcatctctgttttcagacaaatgaatctatcttcagaaatgcctgctatgtctgttactctttgtgggtttcaaaagttcaattgttctggttctgaaggcaggtagatgtttgttgactgtatagtcaggttggagatggggacacagggtcaaataattctctctttcgttagtcattcccccaccaggggcttctgtaattccaagactttaattcttgagcctttctccaggtttctgtaggtggaattggcttctctttgatattctcttctgcagacaaagtcttttaatttcttccatctatgttctatcttcactgtggtttagaagtcacagattatctcctaatttttttgcaggttaattttgtgtttcttattgttttgaggaatgattatggaaagaaggagactgaaaagtgctatctttacacagctgaactattgacagtatttatcatttctttctttctttttttttttttttaaatttgagacagggtctctttctctgtcctccaggctggagtgcagtggcaccatcagagctcctgggctcaagcgatcttcagtaactggcatcaagcctcttgagtagctggaactacaggcacatgccaccatgcctggctaattttgtgtgtgtgtgtggggggtctcactatgttgcccaggctagtcttgaactcctggcctgaagcagtcattctgccttggcctccaaaacttctgaggttacacatgtggagccaccacacctggccacagcattatatatatatatatattttttgacttgaatatctctttttttttttttttgaacagaatctctctctcttgcccaggctggcacgcggtggcatgattttagctcactgcaacgtctgcctccgagtttcaagtggttctcctgcctcaggctcccaactagctggaattacatgcatgtgccaccacgcccggctgatttttgtattttagtagagatggggtttcatcatattggtcaggctggtctcaaactcctgacctcaggtgatccacctgcctcagcctcccaaagtgctgggattacaggtgtgagccaccatgcctggcctataatttcattaagaatgattcttaagcttttcctttgtctcagaaactcaaaaatagttgacagtgttgagtatgtcccattaccaattgtaatgttatggaatgctaagatggccatccttcatcagctcaaattcctgtcagaattttgtccttctcatagagaaatttctataggaaccataattgtacaccaaatgagttatttttatgtatctaaaatttatttagtctggttttctacttgtctatttctctttcttatttagtaaaaccatcagtgggacctaatgccatgagccatactgataaagctatctttttatattcgttccctcaattaaattaccttccttattaattctcaaagggtattctgaataatgtcacctgttttatttatttttatttttgtcctttctttaagtgaaagggtttgattagattctgagttcatgtgggatttttgtcaggtgggattgtaatgattttttttgtgtctttgctaattttttccctttggctgtccttctctgttagaatatcattgacatcctcttagcagatcattgtcttccaaaatttgtagtaattgtgaataacttatattagcattaaaagtgattgctttccttttttgtttgtttgtttttgagacggagtctccctcggctcactgcaacctctgcctcctgggttcaagtgattctcctgcctcaacctcccaagtagctgggattacaggcacacgccaccacacctggctaatttttgtacttttagtagtggcagggtttcaccatgttggcaaggctggtctcgagctcctgacctcaagtgatccgcctgcctcagcctcccaaattgctgggattataggcgtgagccaccgtgcctggctgctttccatttaaaagacaccgttttcctgaccacatttcttcagttgtggtcttatttcttgcaccatttgtattacgaagatttttatttatttatttatttatttacttttaatcttttttttctacagctgctagcaactcttgattttttttttttttttttttagaaatgagctaacaaagttgcttgactctcatcagaagaaaaacaggcctaggaatataagacacatttaatggaaaagtataggaccagcaaagtaggaaatgttattcaaggacagctgtttcatcaacagctattgtttttaagggtaacttaagatgtttatttataatttatgttgatacagaaggaaataaattgattattttctttctgcaaataatctttttccttttccttttctagcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtggtacgtatttcagttttgcaaaatgctggtgaatattggtcatatttaaagaaatcattgcccaacgcaaagtcgcgaagattttctcctgttttctcctagaagttttatagttgtattagtccattttcaccctgctgataaacacatacctgagactgggcaatttacaaaagaaagaggtttaatggacgcacagttccatgtagctggggaggcctcacaattatggtggaaggtgaaaggcacttctcacatggtagcaaacgagaagaatgagagccaagtgaaagggttttcccttataaaaccatcagatctcatgagacttattcactactataagaacagtatgggggaaacggccaccatgattcagttatctcccaccaggtccctcccacaacacataggaattatgggagatacaattcaagatgagatttgggtggggacacagccaaacattatcattagttttagctcttacattttacagttttagcctgtgagccattttgagttagtttttttaatacgatgtgatgtaaggattatggcttttttttttaatcttgtatatatggctgtccaattgttccagcaccctttgttaaaaagttttcctttccccatttaattgccttggcacagctgtttaaaatcagctgaccacatatatgtggatctttttctgaactctgttattctataccattgctctccttacttatctttacatcagacacattcttgattactgtggctttatagaaaatcttgaagcggggcagtgtaagtctcaagttagttttcttttgaaaagttgttttggctattctgtgtttttcacgtttccatgtacattttagaatttagctttttaatttctaaaaaaaaaaaggtcaggcatggtggtttgcacctacaactgcaacgttttgggaggccaaggcaggtggattgcttgagcctaggagttcaagaccaggcttggcaacacactgagaccctgtctccacaaaaaaaatttttaaggccgggtgcggtggctcacacctataatcccagcactttgggaggccgaggcaggcagatcacttgaggtcaggtgctccagaccagcctggccaacatggcaaaaccccatctctattaaaaatacaaaaaattagccaggcatggtggcacacatttgtaatcccagctacttgtgaggctgagacaggggaatcacttgaacctggaaggcagaggttgcagtgagcggagatcacgcagtgcactccagcctgggcgccagagaaagaatccatctcaaaaaaaaaaaaaaattaagaaagctgtcagctggttattctccaaagctgcagcttctctgctcaaagggtcttactagttcagaatacattatcgtaaaacaaaaaataaatacaaaagaaattttttaaacattagtcaaatgtggtgacttgtgtctgtagtcccatctattcaggaggctgaggtgggaggatcgctcgagcctcagagttggaggctgcagtgagccatggccacatcactgcgccccagcctgagtgacagaacaataccctgtctcaaataaaaagtaaaaagtctattgagagttagttaaatccatacatcaatttggagaaagtggacattttaacaatactgagttttctgattcattcatttaagtctttaatgctttgtagctttcattgtacagatcttaacatatctgttgtcaaattatctttatatttcgatttttgatgctgctgtaaatagtattttcagttttgttttctagttgttcattgatggtatatagaaataccattgatttttgtacattaatcatatatttgcaaccttgctcacgtcacgtattagttctagtatctcttttgtggactatgtaggattttctatataaatgactgtgtcacctatgaataaagacaatcttgcttctccttttccagtttaaataccttttatttctttttcttagtataagaatctaagcttgttttcttttgaactgcctgatttcaagattatactgcctgacttcaagatttcctatgagccacagtgtgtgatgtaacagtgtatctgatgtaaagataggtaaggagagcaatggtgcagaataatagagttcagaaaaagatccacatatatgtggtcagctgattttgaacagatgtgccaagacaattaaatggggaaggaaactagaatctgtagtacaatattgaacagaagtgctgagaggaatatactaggtattggggaaacgtgggaattttttcaccatagaggatgtttaaaatgaaaagaatgattataattgcttccttctctcttaacttccttccctcagacatctacatcggtgaatgaaatagcaacaataaaaataaaacaaagacttgcaaattttagttcatgcttttatttttcaaatttaagcatagattatacatattcggccgaaatatcctgattccttatgaacctaaatgattttcatgataattatctctgaacctttgtttcttcatatgaaataaaaggtttttgtgtatgttatataagataatatatacttgttatataagaagtacagtgtacattcatcttccttccttccctccctccctccctccttccttccttccttccctccctccctccttccttccttccttttttgagactgtgtcactgtgtcacccaggctggagggcagtggcgtgttcttggctcactgcagcctccatctcctgggtttgaggaattctctgcctcagcctcccgagtagctgggatacaggcgtccactaccacacctggctaatttttgtatttttagtagagacggggtttcaccatgttggccaggctggtcttgaactcctgacctcgtgatccacccgtctgggcctcccaaagtgctgggaatacaggtgtgagccactgcgcctggcctgtacatgttctttcattttcttctgctacaatcaagacacgctgtccattttatgtagctagctcactgtcagcaagtttgcgagttctttatgtcagactaagtctacttttctataactacaacttatcaataggttttgtcccctttctatacacacaaacacaaaaacaaaacaaaagaactagagtaagtttaattcctatttcatgtaccagcccttcagatgatttaaagatagccattgtgacactcctaaatttctcttccaggctattatgttccttggccattcaggttgtgctctggatgtaatataggtttttaagaattgtctagttgttacagtgagtatgattattgaaatgtgatctgcttaccacagaagaaatatttagaattgtggcactgtttcagtcctgtgcttttattattgcaaactaagattgcattcacattcttgcaatctggcattttgctggaatttgctgagttgataattgatatttgccagttgctgttaagccaggtatagttacattttaaacttaaatgtgggttaactcattcctcttacaataatcttaattcattttagttcattgttctgcctgttaatttttttgttcgaatctttgtattttctaataaatgcatattatgtatgtcatctggaaattgatgagtcttaaagttttggttacagtacgtttgcttatataatgtttaactgaatcagagcaagtacagaaatctggagtatatgagacagacttccttttgactaacagttgccagtagtagtcttttaggcctgcgcaattgctgcaaatccccataactaatatacagtagatatggctttgcattgttggctaggatgatatgagagacactcaaatgtcttgccaaattctagatatgcttaatttatggagtccccaaataactatgctaataaccttattgagaaaaaaaaaatgaggttaatctggtgtggcttctgaaagccttgttggggaccctggaacacttgtttttcttcttctgcaaggactcacaattccctgcataataaacagatttaacttttgctggggatcaacatctaatttgctgatacagctttttaaaaatctgtgccttttaaaaatttgagacatctcgtttctggtattttggtaaccccaacctatcttaccaacttcacaaagattatagtagtgtgcacttacacctctgtggagaaggagctgttcagactcagaattagtcaaagtaattcaaagaaccttagtgctgtctctatgtacttacctgtctcagattttaaacttttgttattatttagtcttatgatttattttaataccacagaatacatttgacacacagcaatcttcttgggcctcatagtgaagtaataacgatcagagctacagcacaaattacttatgactatatgacattcacaatatacatcaaaacccagaacacataaaccatgtgtatcaatagctgctggttttattggaacattttaacgattgatcattaaccatatatttacatataaattttcctggagatttttttatattcaaaattagacccttagtataatgaatacatcgccacacaggattgattgtgctctgaaattttgatttgggtaattttaacatgaaattgtataaacaactgatattaaatcttaaactaatgtgtgaaattataaaatagacctaagggagtttttttgaatcatccttatccttatgttttcttttctgaggcatagtttttttttttttttttttaaagtccttatttttaggacaatgggatataaactgaagttaaggccaaatctctaagtacaggtgaaacaaagatttacagataattttgtttttatttagcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtatagttatgtctccagaatgttgattgtctgttgtattatgtactctgttggtatttattttgtctttttttagaattaatttatttattatactttaagttctggggtacatgtgcagaacgtgcagttttgttacatgggtatacatgtgccatggtgatttgctgcacccatcaacccgtcacctccattaggtatttctcctaatgttatccctcccctagccccctaccctgccacaggccggggtgtgtgatgttcccctccttgtgtccatgtactctcattgttcaactcccatttatgagcgagaacatgtggtgtttggttttctgttcgtgtattagtttgctgagaatgatggtttccagcctcatccatgtccctgcaaaggacatgaactcatcgttttttatgactgcatagtattacatggtgtatatgtgccacattttctatacccagcctatcattgatgggcatttgggttggttccaagtctttgctattgtgaatagtgctgcaataaacatacgtatgcatgtgtctttatagtagaatgatttataatcctttgggtatatacccagtaatgggattgctgggtcaaatggtatttctggttctagatccttgaggagttgccacactgtcttccacaatggttgaattaattcacactcccaccaacagtgtaaaagcattcctatttctccacatcctctccagcatctgttgtttcctgactttttaatgattgccattctaactgacgtgagatggtaactcattgtgggtttttttttttatactttaagttctagggtacatgtgtacaacgtgcaggtttgtcacatatgtatacatgtgccatgttggtgtgctgcacccattaactcatcatttaacattaggtatatctcctaatgctatccctcctccctccccccaattgtggttttgatttgcatttctctaatggccagtgatgatgagccttgaataaacattgagtctagagggaagcaggtgtagaacctgccttaatctgattactgtcttatcatgtattgtcttagttctgacataaacccctttaacttctagtactttcgtaatctctccgtacagaatcagaataaaagaggattgtagcccctattattaattttgctttacagaaattgtttttttggggagttcccttccccctcttttttttctacttttttgttttctttgagggcttcatacaattttgcaaagtattttcagaaatatattctaatgtagatgactgtggagctgtaatattaattgagaacctgatgccatgctaggtgctatagttcaaaaatgagaaagacagtttttgtttttcagaagcttgtagtccagttggaaaaataaatacataaaaatctttccatacagtatggtgagtacagagataaaggcatgaatacggtgttttgagggcgttcaaggggcatctaatgctggggcaatggttggaaagggtaagagggaagggatgagtgttgggtgtccctgcctaggtttaaatgacaggtgaagcaggcaaagaccggcaccaagtaccttcccagtacagtcagacagcttgaggaaaggtgtaaagatggggggcagcatggggctcaggacaactccttgctgtctgtcagtgctgtgatgacctctgtcagaattcaagctggggaaagatgggtggtgaggggagcagaaataggcaggagaccattcactgaaggcttgtatgccaacgtgggaacttttagtcttctttagaggcgatagaaacattgagagggtcgccgggcacgatggctcatgcctataatcccagcactttgggaggccaagtgggtggatcacctgaggtcaggagtttgagactagcctggatgaaatggggaaaccccgtccttcctaaaagtacaaaacctagctggacatggtggtgtgcacctgtagtcccagctacttgggaggctgagacacgagaattgcttgaacccgggaggaggttgcagtgaaccatcatgccactgcagtccagccagggtgagacagtgcaagactccgcctccaggaaaaatagaaaagaaaagaaactttgagagggttttaatcaggggaggtggtgtatgatttgatctctgttttagatcaaccattctgagcgccctgtgaagagtgggctgaagagggccacagatggggcacaaggaccagttgggctgttgccatagtccctgggagcaatcatgagattgtgaagagtcagtttaatttgtggattaggaatttagaacctggagtcaggcttcctggaatcttgttgtgttcattgtgagatgtgtgacttgacaagttaacttctggatacttcagttttctccttttaaaaattgggactaacaattataacagccttagggccgatgaaaggattaaatgagttactatcagtaatgcacctaaagcagtgccttatagatagatgataaacatacagtaagtaactcgtattatgttgactttagatggtggtgccacaacatgaaaaaggaaatgtaagtgtcagaagtgatctaggcatgatagagtaacactaagagagaaaagttaccagctcctgtattccactagaagacttcgaatgaatagtctttgtttttcaagttttttatttttttatttttatttttacttgagacagaattccactcttgttgcccaggctggagtacagtggcgccatctcggctcactgccacctccgcctcccgggttcaagtgattctcctgcctcagcctcccgagtagctgggactacaggcacccgccaccatgcccagctaatttttatgtttttagaagaaatggggtttcaccattttggccaggctggtgtcgaactcctgacctcaagtggtccatacaccttgtcctcccaaagtgctgggattacaggcgtgagtcaccacactctgccctgtttttcaagtttaataaatcaggcagcagtcagctttgtctaaccatgatgatgggagaagagcatgaaagaatgaaccactggtagtttcttagtctcacctcaggtgatgtttcaaacccttctcccatggagtcttctcaaggaaacagttgcaatacaatatgattaaatgatagttttgattcgtcttttgctagtcacccttgttaaaggtgcttgttaacagtggaatgatgaaaaattggccacaaaactggaacagtgttctagataatatacactgattgggccggccgtggtggttcatgcctttaatcccagcactttgggaggccaaggcggtcggatcatgaggtcaggagatcgagaccatcctggctaacatggtgaaaccccatctctactaaaagtacaaaaaattagctgggcgtggtggcgggcgctagtagtcccagctgtttgggaggctgaggcaggagaatcgcttgaacccgggaggcggaggttgcagtgagccaagatcgcgccactgcactccagcctgggtgacaaagcgagacttcgtctcaaaaaaagaaaaaaatacactgattaaaaagttctagaaagttgacttctctcacttggaacagtttttctagcttggttttgtttttccgctggggtgagagtagagtgtccctgtgctgctgcttcatgttgagctcttctttggagacaacaaatgagaatgtttgtgtgtctctacagggctcgcctatttagtcattgtagaagcttaaggaagtcttcaagtttgagactgtacatcgctgctttatgtagtttagatgtttcactagtaacttgttcagagggtgcattaagagatacctagagaaataatttgttttctctgtcagctttctgtgagaaataattatcaggagtaagtcagtctttgatgtgtcattttatggcttacattatacagcaacatctgataatgactagacagggtataggctcacacctataatctcagcactctgggaggccgaggagggtggatcacctgaggtcaggagtttgagaccagcctggccaacatagtgaaaccccgtctctactaagtattcaaaaattagctgggcgtagtggcagatgcctgtaatcccagcttctcggggggccgagggaggagaatagcttgaacccaggaggaggaggttgcagagagttgagatcgcacccctgcactccagcctgggtgacagagcgagactccatctcaaaaaaaatttctttttaaattaactggatattattaaattagttttcaaagttaattttcaaggtaattttacatgtttttctatttctcacaacaatattatgagatacataggattgctgctatcttctctatttgaggttaagagattgaggctctgagaggttaagcattctcaaagttgtacagttagtactggtgataggaagattcctagtcacagttgatataatggattggaagcagcatacaatccaataggcctggatttgaattctcactctgtcatctttttagttgagtcgtctttcacacactgttcacctccctgagcctatttgtttataaaaaatggatgattatatacataaggctgttgtgaaggtaaatagaaactgcgtgtcaagcacctgccataatgcctagtcattaatatatgtgcaagcattcattaccactcctctccttttaattgaatgcaactaaaggagatactaaacatgtaaaacgttgtcaccaatttgcctgcattttggaagcctgttttaagtcttaattatttttattatgtaggtagttatcacagaaacgtgccagttttatctttcgagatctggaaatacaagtcaattaagtaacagtatgggccagttgggaggaagtagccatgaactgggaagggttctgagttatacttctgtttgttgctagccaagtaattttataaccctgggcattgtcactatctcttctcttgcctgtgaaatgatatgtaggagaatacttgggcatcataggaattgccgttgatttaaaaatgaatttgccgtcctatctaggagctcatgttttctgcttactgaaaagcctagtaagagcttttcttccatgtactgcttcctgccccctccccatacaactaatctagggatttggtgaaaggatagaaaggatttttactctctagcatttagtaaatattctgttcattatcttggatttgaactaatgcctattaaggaggtaaattctctttaagttttttatttatctgatcatgtataataggatatttgttaaacctaaaaactctctttgcctcctcaataatgatactgatctttcattttcattggaatttttttttaaagctgctatactgaataagtaatacctctttagtaatatggaatttatgattgatttgaaagaaagtcttaacctgtatatttaaaagagtatagaagtttatagggtatataacaagctggtagattagtatactactgcaagttcctagatgatataatgctaggaacaaagctaagatgaagggtaaatagctaatttctttaattttgcttcctacaaaatatgagagaatagttgtcaattgtccttttggttgcatatttctatatcttttcatgcgtttgaccatgttttagccccatcctaggtactgtggaagatacaaagacatgggaagtacctgccctcacagagtttatcttctatttgagagtttaaaagtttagggaaagaacacctatatgatgattaggtataaataaagtacagaagttccaaatacatgtgtatatagaagactgcttttagaaagtcctctctaggccgggcgctgtggctcacgcctgtaatcccaacactttgtgaggccaaggcgggcggatcacctgagatcaggagtttgagaccagcctgaccaacatggagaaaccccgtctctactaaaaatacaaaattagccagcatggtggcgcatgcctgtaatcccacctactcaggaggctgaggcaggagaattgcttgaacccggggggcggaggttgcagtgagccaagatcccgccactgcactccagcctggtgacagagagagactctgtctcaaaaaaaaaaaaaagaaggaaaatcctgtctaaaaattcatcgtataaatagaattctaaatgtgtgaatgttggcataatcaaaatttgaattttgactaaaatttaagattttttatgcctttatgaaattatgtatttatgagacttttttcaaaaagaaactgattattccattttgaatcttgacaccccttgagaaaactctaaaatactcatacttacttattgtttctattgctttttttattaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaagaggcatgttcttcacagtcccaggaaagtggagaattctcactgcagagttcaaatgcatcaaagctttctcagtgctctagtaaggactctgattcagaggtaagtcaaatcctgaaggctttgttttcaaatttatatgtaaggaaaaatagattgttgctcaaactgaggaaatttttcctacatgtgaatgacgagctatattattttttcattctaaactctactgtgcagaaagttcacattttattcatttgaaggacttctctgtatctttcacattttaaactgcaatacatttaaattaactctgtatatttcctgaatcactgtatgttcaattggtgagtatctcaaggggtgccacagttaaaaccgaggcagagtgataatctgtgaaatgaaaaattattatcaatttactgtttaaatccttaatatgctcttgaattcagataacatttaagaccttgtaaggggccaggtgcgatggctcatgcctgtaatcccagcactttgggaggccgaggcgagcggatcacttgaggtcaggagtttgagaccagcctggccagcatggtgaaaccctgtctctcctaaaaatacaaaaatcttaggcaggcatggtggtgggcacctgtgatcccagctattcgggaggctgaggcagggtaattatttgaacctgggaggcagaggttgcagtgagccgagattgagccactgtactccagcctgggggacagagcaagactgtctcaaaaaaaaaaaaagaaaaaaaaagagaccttataaggaaataaccctgttaatgcaatggtattcatcttaagttttagtacttcagaaatatattttcatttactcttcttattccttctaaatttctccttatgacaaaacaaaacagtaatacaggtgtgcatactggtctagaagactgtctgtttctcttcctatgaacgtctttatctcgtctttttcatttctgcttcatactgcatcttctcttactgccacttgggtaccacggcagtggctatcttgaacatctttcataaaaacatcactgtcaatttgtgaggatattaagtctgctgagctcctttggggttatcttttttatatttccagcatgcatcttactatttcatttactttggaagcgtttagccatgttttcctgagaagccttatcagttcacactgtaggctggtagaactccacattttgtcttctgggctaacctttttttatgtactaatggttatagaaatgtgaatcctcctcccctagccatgccccactgaaaataaacgaactgaacaaaactaggaataattcattaagtcctctctcttgctgccagatgtagtaaactcctactagaatagttaattctcaaagaatctgatgctgacagttgacatgaaaatcatataatctttctttgatggagaaaatgtttcagaaagctgtgaaacattggggcatcattttgaatatcagtttttatcctatagttcagaagaaaatgcttcaatatttgagccttctgtcggtagttcactgtgaaaaacaacaaccatagattctgtgttgagttcattgaccatatttgaggttgaagtcttcttaggaccttccttgtgatcttcaggaagtgatttagcccagagtcaccaatactgttagctatgagcaaagaatgttagagtttctgtaaggtataatacaagttaatggagtgcttttcactattgggttttttattgctctttttttttgttttgtttttttgttttttaagtctgctctgttgcctaggctggattgcagtggtacaatctcggctcactgcaacctccacctcccgggttcaagcgattctcccacctcagcctcccaagtagctgggacaacaggcatgtgccaccatgcccggctaatttttgtatttttagtagagacaggatttcaccatgttggccaggctggtcttgaactcctgacctcaagtgatctacccacccaccttggcctcccaaagtgctgggattacaggcatgagccaccgcccctggccttactgtcctcttttatttgactttcatgggaatgcagattataagggaactctccatctatagagaagtcttatctgatagaattgggggcagaaaggtctgaaagtcattgctaaaggtgaagtgcatttaatacaatgctactccacttgaaagtggatgcgtttttttctttttaaagttgaacgtgttacatgattaaaagaagggatggagctgcaccagttcaacttattttagctagtaagatgaaaacttaaccacacgtgcgtaacgcagcgtttttacagtaggagactcttgttttatctgactcagcattttgacatcctcttctaacagttcagaaaagactttaattttaaatagatattttatataatttacctctccagctgaaacatcttgttagcttcttcaatgaaattggcaaatatcatcctttccatattattcattttcttttattaattctatcccatgttcttatttatcttccattttgttgaatattagtttgttgtcataaaaattctacagtaaaaatctaattttattttattttttgatctggggactctaggaatctgattgcaatattaagttacttgacagtcaaagtgaccagacctccaagctatgtttatctcatttctcaaaaaaagacacacctctaaggaacaaggtaaaacatttatttaattttttttttaatttcagaagcggtgtatgcttacaactagaaaatgagaaatacaagcagaattaaaaatcaaaatacctgtagtctcatttatataaaaatgtctactttaaaactttatgcttgactgtaggtgtttaagttgtgaaacttattttctcttgcagtgtatatgaaagatcactttccaagtacttttagtcattaatgtaatgactttataatatgcagttgtataggtttggtcaatccccttatttttgtcatttatcctaaatttttttgctctagcaaataatactgcaaccaagatcttgtggataaatatttgaggacatgttcttgattagtttgtaaggatgaattgcatggagtggtattactggtcccaaggcatgtatgatttaacattgatacatactgccaaaaggccttctagaaactgtgtacccatgataaactaggtttgttaaatcaaaatatataaatatttgtgttactacatagtaaagcatgttttatatattaagcacgaattaaagcatattttatgtattaaatgttcttgttcatcagtataaaaacaccatttcctaacttaaaagatggataaaggtcataaacaggtcacaaaaggagaagtaccaatggttgattaatatatgtttaacctcatttgtttaaccatatgtttaacctcattagtaatcaagtagtgcaaattaaaataataaaatagtttcttgcctcttcatatttcaaaaaaatgtttttaattatactcattttttatgagagtatagtgagataatcacatgttttaaaaagtaagtattggtctgccatttctagaaaaaaatttgaaagagttcaaataatttaaaccagtaagtgcattctagaactttagcctaaggaaacattgagaatttaaatacaagaatacttaatactgcattggttataatagtgaaaaaatggaaataacctaaataacaataagggagtgagttattaaataatcattggttttagctcttactggtagaaatataggtgaacttttttctgttctttttcttgtgtttttctaccatgagcatatattatgtttctagtagcataaaaacttcttactttttaaaattttaataaatggccctgcctatccatttgaaagaagatgtagtctcacacaatataaatgtaaattctactgtagtcaatatgggttgctataacagaataccagaaactggatttgcttaaatgataaatatttatttctcacagttctagaggctgggaagtccaaggtctgagtgagagcccacttcctggtttgcagacagatgccttctcgctgtgtccttacatggtagagggagagaatatctcttttgtacctcttcttaagggcactaatctcattcatgagggctctactctcatgatctaatcacctctcaaaaatcccaccatcacattaggagttaaggggttaggacttcaatatgaatgtgagggagacacaacattcagtccacagcaaattccagtacattaaagatacaaatatgaaatatgtaaatatgagattattttttaaatttttgagcaagaagttttttgcaatcatatctactaacttgaaaagacattcattattagtgaaaaggaaaaatatgttattaacaatatgtatagtggtgtttttgtttaaatactttaaaatattcatgtacacatttgcatgtttgtggcatcatattaagaagtctggaaagatacatgcagaattatttacaatgatggatagaactggagatgtagaaagtacttttcctgaaggagttatgtctagatagtaaaccatcatattattattataattctcagacatttgcattgtcagggatttaactaccacttctgttttggtgacccttcaggtgagctctccctgatacccatctttaatacctaaaatcaaactcgtgtcttttacctctgtttcttctcggaacgttttttgttttatctattaaataaaattatattatctgccacttagtttcaaaatcctaaggttgtcctttttcttgataactgtcagtttgatccttctacagcagttagagaaaaacaaccaaacatcgatacctctccaaattctaacgtttatttctttgccttcttttttctccctcactttttccccatcacaacacatatttaaggatttcatctttactgtgtgaacctttattttgttttaactttttcattcttcctacacacactgccagattcatattgtaaaccttttttaatatacctcattcttactatcttaagaaacaataacaaaacttcattgtctccattctgtccacagggtaaaaatcaacccttagtagaaacagcctaaatgtcaatagaggtttgtttaagtaagttatggcatatatatacaatgcaagaacaggcaacctattcaaaataaaattctatttcctgtgaactgaaaaaaatctctaagttacatcattaagaggaatcaagatatattaagtgagaaaaatgaagtgcacaacaatgtgtactatgctgcctgtgtgtgtgtgtgtgtgtgtgtgtgcacgtgcacgtgcacgtaagtcagtggatgcacaggaagctgggagcagcaattgcctctggaaagggaggcagcgagagagattcattttgctctctgttcctttacaaaagagagaacttttaaattttatgccaggtttacatattacctgttaaaataatttatgatgacttctgtaatagacttttataaatagcacatttttaccattgctcatgggttattttgttcttatgtataaagaatagtttggccgtgtgtggtggctcatgcctgtaatcccagcgctttgggaggctgaggcgagcagatcacaaggtcaggagatcgagaccatcctggctaaaacggtgaaacgccgtctctactaaaaatataaaaaattagcgaggcgtggtggcgggtgcctgtagtcccagctactcgggaggctgaggcaggagaatggcgtcaacccgggaggtggagcttgcagtgagccgagatcgcaccactgcactccagactgggcgacagagtgagagtccatctcaaaaagtaaataaataaataaataaataagtaaagaataaagaatagcttgaaattaaagttagttgctttaacagaatggtcttaaaatgggtgtttaatcttcaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaagtgagttgccttgtttcttattctgaaacaagataaactgttattttctgtaatttccatccctttctcccaactcttcctagtttcgtatgagtttttgtttctctcactataaaataattatttttctctcttccctttagctaactctttatacttaatatcaatttctataccttcttttcataaaaagatggcaaactaaaaaccagttttcagtctggttttggagtctctctgatgtgaagcaaattgctttcctaggccttaagtctcctgccttccttttcttatctctcaggattgtaaagagaataaaattttatttggttttttgttttttgttttttgttttttgtttttttttgagagagttttgctcttgttacccaggctggaatgcaaggggcgatctccactcaccgcaacctccgccacctgggctcaagcaattcttctgcctccccctcccgagtagctgggattacaggcatgcaccaccacgcctggctaattttgtatctttaatagacacgaggtttctccatgttggtcaggctagtctcgaactcccaacctcaggtgatccacccgccacggcctcccaagtgctgggattacaggcgtaagccaccacgcccagacaagaataaaattttaaagaaggggtagaaacacagtgcaatatcgtacttctctaatttatcacatctaaaatggggagactcattgagtttatatgatgaatttgccagatttgcagtgtatgtggccagcactgttttaaaagaattcatcttctatatagttaaatttttgttaaccataatacttccttctgttagaccacaaaattagccacagagtagcattaccttatagctattttcttgttctcaataaaagaaatgtgctgtttaataaaagttttttttaattatatggaatgataggattaaaccttacctagtagaaatattgtcatagatgaggcggtatgagtgggaaacactttgtaaataagtaagtgctggacaatcatttcttattttacattgtgtaaagtctaggattaaaccatatgacagcagttttcaaactttttcttttcaggaatgctttatactcttagaaattattaaaggccccaaaatactttggtttatgtaggttatatttgtcaacacttaaccatcatagaaattgaaatagacattttaaaatatctattttaaaataatgataagcctattacatgaatgtagatagtacatttaaaaaataaatagctatattttccaaatccccccaaaagctaagaaaagtggcatggctttacatttcattttgcaaatctttactatctagtttgcaaatctttactgtctggcttaatagaactcagccggattcttgtatctgcttctacatttgatctgttatgatttggtgttttggttgagtatatgaaggaaatagacatatttgtagttagaaaatatatactttgatagcctttttagatagtggtaaattttcttctttgctgttatgtctaaatccaacaacttgtagtttccttaggtcagtgatagtgtagaatatgaaaccatatcaactgactttttgtactctgtgttttattgcagtccactggtgtcccttttttctgttgcctaggctggaatggcacaatcatggctcactgtaccctcgagctcctgagctcaggcagtcctcctgcctcagcctcttgagtagctgggactacaggcttgtgccaccagccccagttaattatttaagttgttatgtgaggtgtgagccaccttgcctggcctacactggtgcacttttaatgcatcttttacatgtaacatcatgagttggtcttttggaaaatattggttaattgagatgtacttccaaatattgatatattttattatacaatataagaaaaaagtcacaatcaacaaagcctttaatattggaaaactgttgtgtggcagatacgttttccaaaattttaattttcatttgaaagcttgaattttatcattagcaacaaatactcttagttgtttttctttaaagtaacaggctctctttgttcattttatttgtttgtttatttatttatttattttgagacagagtctctctttgtcacccaggctggagtgcagtggcacaatctcagctcactgcagcctccgcctcctgggttcaagtgattcacctgtctcagcctcctaagtaggtgggattacaggcgcctgccaccatgccttactaatttttatattttttgtagagatcgggtttcgctgtgttggccaggctggttttgaactcctgacctcaagtgatccacctgcttcaacctcccaaagtgctgggattacagacatgagccaccacgcctggcccctttttgttccaaattttagagaagtcctgaatgaccttagtgtcacacatgcttttacttgaggtaaactatcatacttccatacacaatagaagtgttttgtttgtgctttccattttgtcacagaatattaaaaagtataccaaagaattagctgagcgtggtggcatgtggccgtagtcccagcttctcaggaggctgaagtggcagaattgcttgagcccgggaggtggcggttgcagtgaactgagattgcggcactgcactccagccagagtgcaacagaacgagaccttgtctcaaaaaaatttaaaaaaaaatgtaaagtataccaaagggttgagatttaataaaattaatgatttgtactgcttccatcaagaacatttttgagacttttttttaactgcaagtgcgcagaggtggagaatacaaatagtcctggtatgactcgtacggtgtgatgccactgtcttgattcacactgagttgtcagcagtttcactctgttctgctttagcaacatccatgcaagggtcagcacagtggaaaggatgaacaaagtctgaatattgtaagaatagttttggtcttggaaaccgttgaaaggatcttgggactctccaggggttgtggaacatgctttgaaaactgttgctagacagaaattaagggtgcaacagtattcttaaatacctttgagaaaaagagatgtactggtatttaatttttgttgacaggagatagaattacctgtaatatcttcataacaggattaatttttatagatagcttccttccagaaaagaaaaaagagaaaacaactgagaggggaataaaagacagggcttaggccaggcacagtggctcacgcctgtaatcccagcactttgggaggctgaggcaggcagatcacttgaggtcaggagtttgagaccagcctggccagcatggtgaaaccccatctgtagtaaaaatacaaaaattagccaggtgtggtggtgcacgcctgtagttccagctactcgggctgaggcaagataatcgcttgaacccaggaggtggaggttgcagtgagccaagatcgtgccactgcactccagcctgggtgacagagcgagaccatctcaaaaaagaaaaaaaaaaataataagatttaaccagggcttaaccatttgttcctgcttcacttatattagttcttaaccagacttgagaagggcactaaggagaaaagaattaaagtattggaatcattctgccttagctaatatatctagtggtggcccagcacctacactgaatagtgattttgaaagcaagaagaggcactaagaagtgagactcagaatgtattgggagtgctcacaggagaacctgattgtgttatataatgaattgaaagagatcgtacagtaaagggtcttatcctcttcatgtccctctattttgtccaggtagaatatttcttctctaataatcagtaccttaaaaataccaaatgtattttattgtattttgcagagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattgactttataattgggttgtggtttttttgctcagctttttatatttttataagaagctaaatagaagaataattgtatctctgacaggtttttggaggttttagtgttaattgggaaaatcctctggagtttataaaagtctactctaaatatttctgtaatgttgtcaagtagaaagatagtaaatggagaaactacaatcctagaggaaatcactgtgtttctccaggctttaaagttttccacttgcctttcccatctgtccttcagggttgaattgaaaataaagttgttgagatgggaggggtaattggaagggttaaagatcattacacaaatgagacagtgctctcttatccctgaagggtttggttggattataggttgacactgaaggaaaattttcagcctcatatgaaaggaaatacttcttatatcattaatatttttaaacttcaaaatagcctcagttttaatatatatattttgaagtataggctaaagctttcttaacatgtatttaaaactagtcccctaaacactacataagatactaaagctgcaaggtctgtgacacgtacactctgcaaataaatgggcagatacctggaaagagaaccagctgcacaagtgaggatctgaagtgacaggaattaaaggaattataaaagtatttgtgatatagaggataaaggaaagagagccaaagtatttatatttttgagtgagacttggtagaggactctaggaaaatgagatcagaatggaataaaagctaactaaagctattacaaaattaaaacccaaaaaggcccaatctggaaaagacctaatccaaagaacaaaagcagatttgaattctccatgcatgtttcctgttataaaataaattaggaatgtgagtcaaacgttgtctacaaatatttatcccctcactcactaaaaatgctacttaaatgacagaaaaggaataagacaaatccacaaggttaatagaatggaagaagagacatcaggcaaggaaactgatggatgagtggtaagtgatttcacaaagaaatgataattgtcagtggcagaagactagaagaggtaaaaatctaataagcttgacaaatggagatatccagattcctctaaagccagaggtgcagaataaggctggaaataggattggttttggaaatctttaaaactagtgtgggagaaagggcagatggcagcagtgccatagttttcaatctccaaatcaccatataatagcaactggatagcaaaataaaaatccatgagcaacgtaagtgggtgaagatagccacaagaccacaagctggcattggcatcaattcaggtgaagcagagtgaggaaacggcatctaatggcctgagaacagaacctcagggtcatcacagaaacagcaggccaggttgaaaacagcactcaagtgggagaggctttgcccatttcaaaggtgggtgagtccaagaggcttgtattaaggtctgaaggactgaagcaagctagcccctagaaagtgttagaactgattcgctgagttcaccaaggttctcttccaggacagcgttccccacagaagagaaactgctggggtgaagccaaattgaagaagagaaagatgaagagaaggtccaaatacaagtagaataggggatagtcaaccaaaatctctcagcagaatactggttttgaacacttagaaagaaacagggaagttcccgtgaatcatgcttccttctcaaagtttaggaaatggaatttacttaagaaactaaggaaagtttttagatgaatctcatacaaagttattttaatgaaaagaaagagcaaagataagatttctgggcaatgaagatctatcagaaaggtctacagagcagagcaaaactagttcgtttaaaatgtgctaaaagatattagaaaaatgatataaaatatgacaaatttaggattacaagaatcagaaataagataaactcaggaaaacactg

SEQ ID NO: 16350 - DNA, 7008 bp, Human
catgggtaatccggacagcaaataatgcatccacgggaagtgaagaaccgactcatctctttggctctctcatccgtatcttctttttttcttttgagatggggtctcactctgtcacccagactggagtgcagtggcgtgatcttggctcactgcaaccttcgcctgcgaggttcaagtggttctcttgcctcagcctcccgagtacctgggactacaggcatgcaccaccacgcccatctaattttttgtattttgaatcgagatggggtttcatcatgttagcaagcatggtctcaatctcctgacttcatgatctgcctaccttggcctcccaaagtgctgggattacaggcatgagccatcacgcccggcctcttttataaaaaacccaagccagctttgtatttcttgttcccatgaccttcaccatgcccctaattaaacgagggtgggttttctgtcacatgaggctgtcctgtcctcctgatcccatgtggccatgttccttgccttccttacctggccaagtgccatctgccctctggtctctgatcttgtcattccctctgcatggaactgcatcttccctggatctgtcactagacagtgtcgtccactcatccaaatgtcagctgaaatggcatggcctcctcctctcagtagtcagtccatgacatcattttgctgttgtggatattttgagttctttgcagtgattactactttctcatatctctcttatgtggcaggatgcttgttacctcccttattggaaagtcagctccatgagagcaagggcttggtctaaattgtgcctataactgaatttatggtgtgcagctcactgccagctcataggggatgctcagtagttatttaaagatggatggctgcatgcatggatgaaatcttgtctttatacatgactactttgtactgggctgtgtgaaacaattttttttttgagacagagtttcactcttgttgcccaggctggagtgcaatggtgtgatctcggcccactgcaacctccacctcctgggttcaagcaattctcctgcctcagcctcctgagtagcttggactacaggcacgtaccaccatgcccagctaattttgtatttttagtagagaaggggtttctccatgttggtcaagctggtctcaaactcctgacctcaggtgattcacccacctcagcctcccaaagtgctgggattacaggcatgagccattgcgaccggccatgaaacaatctttacatgaagcatccttatacaaattctgcatgctatcccattccgccttttattttcttcaagtgatgaaaaggaaggatgctcagagagaccagcaaggacatggcaggactgcaagttgcatccagggtccaaaccctcatccctgattccaaattccatcaccacccaccacccagcactgcctgtccagcccatcagttacgctactaattcacagcatcctttgaatcagtggaaagaaaaccctaaaaagttaccaaagaactaaacaaagttatcaattaatttataattaaccgagataatccttgtaaaaataactttcagcggagggtggatggccttaaatttccccacaaaaggtaaaactttcccagacatccctttctgaaaatgagatgtcagtggatgagaaaagcctgctcccaagagtaggtgtgaggtattgcacctaggcccactgctgggataagctggcacagatacacgggacatgatgctttcattctcaccttaaagaaagagacagagaagaaaaggaaggggagcaagtggagaaggaatacaagaaagaggaagagaagcaggaagattctacatacaggctggctgtgtttcccctggggcatgctcctgtttactggtcccatgccaggttgactcattgcctcgttcatgggtggaattaagatgcctacctggggaataaatagagcaaggctgggtgctcacctccacagcggcttccttgatccttgccacccgcgactgaacaccgacagcagcagcctcaccatgaagttgctgatggtcctcatgctggcggccctctcccagcactgctacgcaggtgagttctgtgcagggagggctgcctcggggttaggggttgtcacttgggcctctatggaagaactcctgctccccaattctcagcagagatcagccccagtacaaaggctgtaggtataacagatctcaccatgttgcccaggctggtcttgaactcctgagctcaggcagtctgtccacctcggcctcccaaagtgctgggattataggtgtgagccaccacacttggcctaagatacttggaaatcttctgtgatgctctgaatggtaatagtgaagcatcgtatgattttgaaccaaagaagaccaaataatcttcacgatatacttccaagtccgagtgtttcatttctcaagtcttctcattaaatgaagtttcatgaggtttagcttttctgggctggggagtggagagaaagaagttgcagggcttacaggaaatcccagagcctgaggttttctcccagatttgagaactctagattctgcatcattatctttgagtctatattctcttgggctgtaagaagatgaggaatgtaataggtctgccccaagcctttcatgccttctgtaccaagcttgtttccttgtgcatccttcccaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgaggtgtttatggtaatttcattttcttcctataagctttttaaatcccctgaccagggacaagtgggctcttcatttctcactgacaatgccaaagccactagtgaacaagccttttcttacattggttaatttagttgaatggttagtctaatgactttgccatcaagaaaaacatccagtgtccctgtgttgtcactctacccagagaatcctcagtggatgataaatgaatagggcaagagaggaaaaggaaaggtcggtagaagtcttacctatccccagagctctctaattcatgctcacaaacacagacacaatcacacaaacacagaaacacacatacacacatccagacacatgcaaacacacagacacagtcacaatcacacaaacacacacacattcagacatacacaaacatagacagacaggcaaagacacagacacagacacagacacaatcacaccagcacacaatcatccagacacaaacacaaacacacagacagaaccacacaaccacagaaacacagagacacacacaaacacactcagacacacacatacaaacatatgttcactctctacagaaaaaacaattttccagaagacccgcacctatagaccaatctgcagagaaaacttctcttcttcaaaaaaaagtaaaagtgttctttcttaaaaaatgccctatttttcaacagtttggaaaataccatttgagcaagattctatacatctcaaataaaaagaatttaaaatgcacttccaggcaatcataatttgctagcataaatgatgagaaaccttggactatccaataggcaactgtagatcatgggtatgaaaccaccatggaggaagaattgtctcaaacaaaaaccaatagttttgtatttctttctaactatacatgtatattgttgagggttttctttagcatttattccctatgttaaattcttctttaatccttccctggtaaaaaaaaaaaaaaaaaaaaaaaaaaaaagttagaaatataccaaacccctccattaggatgaaagtgaacatcacctcaggaaaccctgacgctttctacaacatggatgaaccttgaggatattatagcgagtgaagagtgaagcaaagagtcacaaaaacacaaatgctgcatgacccatgcatatgggaatctggggagccagactcagagacagtgaaaaaaaaaaaacagtggttgtcagggcttgggtgcagagaagaagggggagtcatatttaatgggtctggagtttcagttgtgcaaaacagtaatattctggagttaggttgcacaaccacacgaatatacagaacactccgaactgtccccttaaaatggcaaattttatgagatgtacattttaccactattaataatttgttaaaaactaattatcaactgcagggaagggtgatggatttgtttctttaaaagcttcctcagacagatcatagtctgcagctccaataattagtagagcacaatggtggtggcagagggcgtcggactgctgggatgctgggaatatttccacaatggagggttagacgagagctcaaagtttcacttttttttttttttttttttttgcatttgagctaagattttaacaatcctgtgaaaataggtaatatagtcacgtatttgttgaatacattatttcaaagaaccacaaacacacagaaaaaatatttaaaaagtccatggtgggggaaatgatccagaaacaacagctcttctacttccagccctaaccgtctgggatgctagatggttgtgggcaaaccgtggaaaaagataagcttctgtttttcaagattttattttgttagagagtgcagaaaatctaagtgatgtctctgtttttgctttctagcaattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggcaaaaactgaagtttctctttgttctaccgtagaaaagaggcgttagagggcctcacatattttacatacacacacacacacacacttacttattaaagaactcatggtcatgggttgaggactctgtgaagcatttgtttcctcagtctgacctctaagccttggtactctctctgaagagtgtttccctgtccccatcccaccacctcccccgtcgactctctctggagtcctcaggctctgggatgtgaggcagggtttcactcagaggacctgctttcactccagtcctcccatccacgctgagccctgctggccatgtcaggcttctctgcgctgtctctgggcctccccgagatgtgcagggcctgggccagagccagccagggagaggagtcctgcaaagcagggtggcacctgactgggtttaaattttgtaatttttactcatcatggatgttggcttcagtttaatttataaactactacaggaaaatattatttttaaccatattatgttattatttgaatcctatgcaatatgactactgagtttaacagtacccctattaagattttcaatgtcctctagtcctgtgcctgtggtgggactggggtccatcctccgctgtcccgcagtgagctgcaaaggcaatgagggttgaggggagtgagtgtgctgtgcagggacccagcacagcaggggatgtttacatggaacctggagtctctttcatgtcctgtccccagcattcctgtcaccaggggcagttattgccacctgttctgcttctacctcagcctgtccctcttctttctgaggctatccccttgtaaggtttttgtatcggctcgaaccccaagaacataccaacagacaacacgaggcagtgtggagcaacatgctgttttaatgagcgcctggaagcaggagggctgaggcctaaagtggcatcagccttaagtgaggatggtgcaaaggttttatagtctcctgtaaacaggaagtgtcctagtctgatgtaactgctatgttatatctggatggcctctttctccgtcttcaggggtatgtgtcttccggccggctctcttcctgcttctgctatcttgctggtgcaccccactagcacaagtagccttgtgccttgggactgagcctgagaagtggggagctcatctccttaagctttcaggccctggggagaattttacattgctgtctatttggttatggaaaaaggacgactttctcaataaccacttcaggtgtgacatggggtggcatgggcaccttggaaaaagaaaaacttaattttggggctattcttgagagacaggttggtatccaccatgtcattgtagcaggagcatcatctggattgtctggaaaggtgtctgtgcctgcaaaacagttatgttgagaggacaaggaggtgtcaacagggagaggcatggcctcatttgctgcttcacgaatgaaagaccatgtctggattaagaaggggaataattcctgagtggctcagagtctggtaagggtggaggccccaagacaaaagtttggccatacatgatttcaaagggactatagaaagagggtgcttttggtgttgcgtggagtctcatgagggtaaaagggagattttttgtccacgactggggggtttctagaagcagcttggtgagttgggctttaaggacagagttcattttttcaactttgcgtgaagattgaggcctgtagggtgtgtggagaacttactttatttttaaagatgtagagacaccttgggtgatttggctgatgaaagtgggcctgttatcagactggatggatgttgggagtccaaaatgggcaattatatgcatgatgagcatttgcgtgatgatatttgtaccttctgaagttattgggaatgctcctacctacctggagaaagtacagacaaaaaccagaagatagtggagcaatttatcaggtggcttgtgggtgaagtct

SEQ ID NO: 16351 - DNA, 5225 bp, Human
ggccgggttgggcgattaacaggcggtggctagggaggacggagagggggcgtttgctcctctgggacttttcatgcctcgttttttttttcagatgtggcttggtctggacgcaaggtcccagcagccagcttaagcttactcttctgtgaaaggggaaagtatcccctgtggaaagcagttaaacttgtggagggggtgcgagacgtgagttctcccccatgccaggcgaatggtgtggacttgagctggtccagcagccggctcgacttgtctgagggagccctggagggggcggggaggggccccacagaacgtgggttctataaagagacattgggaagattcgattccgagaagaggaagagccggattgaaagagagccaggcccttgagggggagggggctgccaagatggcgtcggcctcctccgggccgttgtcttcggtcggtttttctccgttgatcccgcggtcccttcctgtacctcgtcctcagcatctggaatcaagagtcccatggcatctgaggtgccttatgcctctggcatgcccatcaagaaaataggccatagaagtgttgattcctcaggagggacaacctcatcagccttgaaaggtgccatccagttaggcattacccacactgtggggagcctgagtaccaaaccagagagtgatgtcctcatgcaagatttccacatggtggagagtatcttctttcccagtgaagggagcaacctgacccctgctcatcactacaatgcctttcgtttcaagacctatgcacctgttgccttccgctacttctgggagctatttggtatccggcccgatgattacttgtattccctctgcagtgagccgctgattgaactctgtagctctggagctagtggttccctgttctatgtgtccagcgacgatgagttcattgttaagacagtccgacataaagaagcggagtttctgcagaagctgcttccaggatactacataaacctcaaccagaaccctcggactttgctgcctaaattctatggactgtactgtgtgcagacaggtggcaagaacattcggattgtggtgatgaacaatcttttaccaagatcggtaaaaatgcatatcaaatatgacctcaaaggctcaacctacaggcggcgggcttcccagaaagagcgagagaagcctcttcccacatttaaagacctagacttcttacaagacatccctgatggtctttttttggatgctgacgtgcacaacgctctctgtaagaccctgcagcgtgactgtttggtgctgcagagcttcaagataatggattatagcctcttgatgtcaatccataatatagatcatgcacaacgagagcccttaagcagcgaaacacaatactcagttgatactcgaagaccagccccccaaaaggctctgtattccacagccatggaatccatccagggagaggctcgacggggtggcaccatggagaccgatgaccatatgggtggcatccctgcccggaatagtaaaggggaaaggcttctgctttatattggcatcattgacattctacagtcttacaggtttgttaagaagttggagcactcttggaaagccctgatacatgacggagacactgtctcagtgcatcgcccaggcttctatgctgaatggttccagcgcttcatgtgcaacacggtatttaagaagattcccttgaagccttctccttccaaaaaacttcggtctggctcatctttctctcagcgagcaggctccagtggcaactcctgcattacttaccagccattggtctctggggaacacaaggcacaagtgacaacaaaggcggaagtggagccaggtgttcaccttggttgtcctgatgttttacctcagactccacctttggaggaaatcagtgagggctcacctactcctgaccccagtttctcacctctagttgaagagactttgcaaatgctaactacaagtgtggacaacagtgagtatatggggaatggagacttcttacccacccggctgcaggcccagcaggatgctgtcaacacagtttgtcattcaaagacccgcagcaaccctgagaacaacgtgggccttatcacactggataatgactgtgaagtgctgaccacactcaccccagacactggccgtatcctgtccaagctacatactgtccaacccaagggcaagatcaccttctgcatgggcatccacgtggcccatctggctctgaagcaccgacaaggcaacaatcacaagatccgcatcattgcctttgtgggaaacccggtggaggacaatgagaagaatctggtgaaactggctaaatgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttttccgattttggctggtgaaggtggtgccatgatgggtcttggtgccagtgactttgaatttggagtagatcccagtgctgatcctgagctggccttggtccttcgtgtatttatggaagagcagcggcagcggcaggaggaggaggcccggcaggcagctgcagcttctgctgctgaggccgggattgctacgactgggactgaagactcagacgatgccctgctgaagatgaccatcagccagcaagagtttggccacactgggcttcctgacctaagcagtatgactgaggaagagaagattgtttgtgccatgcagatgtccctgcagggagcagagtttggcctggcagaatcagcagacattgatgccagctcagccatggacacatctgagccagccaaggaggaggatgattacgacgtgatgcaagaccctgagttccttcagagtgtcctagagaacctcccaggtgtggatcccaacaatgaagccattcgaaatgctgtgggctccctggcctcccaggccaccaaggacagcaagaaggacaagaaggaggaagacaagaagtgagactggagggaaagggtagctgagcctgctcaggggactgcatgggaagcacggaatatagggttagatgtgtgttatctgtaatcattacagcctaaataaagcttggcaagattttttccttctttgcttcaaaaaaaaaagaaagaaagaaagaaagaaagaaagaaagaaagaaagaaagaaagaaagaaagaaagaaaagaaaagaaaagaaaagaaatcctgatgcctaaatctgaccccttgaaatgctgatgagcttcatctgagctgtgtgatctctcatgtgcagctaaggttgagaaccactaacataaaataattcacattaaaatcaccaggaagctttaataacatttcaaatacttggacccaacccctaaagattctaattaattggcctgggactcaggtactgatatttttcaaaagctcacaaggtaattctgaaattcagcaaaagttgagaaccactattcagactaagtgacttgtccaatgtctctgggtgcatcagactttatggccttccttacacaggggttgtgaatgaaatatggctatggaaagcaattgttgagtaatatgttataaagtatggtggtgatgatgatgatgacaatgatgacaatatttcttgagtgcgtcctatgcaccaggcactatgctaagcattttatgagcttaatcttattgaatcttcaacattagcctgctggtattattttcccttttccttgattataatatgtcatcagttgaggatgacaatttaataacagttattagaggctgttgcttgttaataggaaaatatttattcagtcctccagagacaaagatttgctttgatcagaataaatgtaaattttgatttatttaacatgaaatgcaaataaacatgtgtgctgctatcaatgcaaatcactcatcccatgtgatatcaaataagcagataccttctatgtagccctccaagttcacctacattcacaaatgttacttatatctcatactggggtatccatactgggcctggaagctggcaagtttatttagacacattccatttcaggaataataaaatgcagggaaaatgtgtatctttgagtcacagaatcatggtattattcttattttcaggtgagactttaaaagattaagtgacttgcctatagtcccagggttcattctacagccaagccagaaataacaacccagtgcccctgatgctggaattctccagaagctcctctactgacatagtttccactgacaaactttccttgacaagaataaagtagtctgtcagaacaaaattttgccagctctgtctactgccagcacttggaaataggagtcccatggggtttgcaaacaaatgaaagcagtggtgggcttgcaagacctcaccagtccttagagttcagttgatatgtctctcaatacaatgcaggaactaattttaaagcattttgaaacaagcacaataactgaaaattctgagttcaacaagaaacaaatgcatttaatctttgaagaaaaatcaagtcaattaagaaatgaaaataggttgagactagacgaataagaatggaaatgatcgattggagaagttttcagccttgaacaggccattaccaagtggtcagtatgaccacatttatctgatattatttggtccttttctttcttttaaaagtactatttagttataagaatcttaaatgctggctggtgcagtggctcatgcctgtaatctcagcacttagggagactgaggctggaggatcgcttgagctcaggagtttgaaaccaacctgggcaacatggtgagaccttatctctaccaaaagtaaaaaaaaatagttggacatcgtggcatgagcctgtagtcccagctacttgggaggctgaggtgggaggatcacttgagcctggcagatggaggctgtggtgaactgtgatcttgccaagaccgtgtctcaaaaaaaagaaagaaagaaagaaagaaagaaagaaagaaagaaagaaagaaagaaagaaagaaagaaagaaaagaaaaaagaaaattaaacaccactttttaaaaaaaagcaacaaagaaaatttgg

SEQ ID NO: 16352 - DNA, 56147 bp, Human
tctaccaatgttgtataccttaaatatatacaatggaaataaacaaataactgtactagtcatttagaataccacaatgacatctttacagaatatgcctttgtacaagcattgccattagtgatctagaaatgtatgtatcattttagtgatatatagagcctcatgagcgctaaatgtcatctccagttcaggtctgcacaactgtgtttgttctgtgccatgggtctgtttaatgatttccctacctcccattcaccactgaagcacatgcctgttgttctgcctataattccccttccttgctgtgcaatatttcattccattatttctgacacagaccaaaaaagcaatagaaacagcagtgtctggaggcaagtgggagctggagaagccatagtttctgagatcttacccacttaattctctgagattggctctttcctcagttatactgagtaggtttcagctcttcagtgacagagaggggagaaaccctagcttttatttcttctcttgagaatgtacaaccctgttattttgtgaacagtgtggtgtagattcagagtgagaaatgtttttaggatttattttattttgctaaaactgttctcaaggcagctctggtgtaagtgagaatataccacagcgggcgtcagaagatctcagttcaaatcccagcctgccatttatgagctgtgggacactggacaggtcatctgttctcctagagtctccctttccccatttggaaaatatgaaataatattctcagccgtccagtgtttttcacggggtttaatggaaaaaggtgtgtatgtttacttagttaattgataaccggtttagccatttaagatgaatgagtttgttagctgctttatgtttaggcagctgtaatgttagtactacattaaaatatttcaaaaggatctcattttcaaggaaaatgatctagtgtttgagaaagcattatagtgttgcagtcttgcagatccttagctcagctaggtccgagttgtcttatgcaggaagaattaggcacacagacactggagagtgagtggagtagaatttattaagtgaaaggaaaactctcagcaaagagagaggccctgaaagcaggttgcagattgccacttcacagttgaataccaggacttttatagaaaagctgatgaggctgggatacttatttgcataaggcgtgaattcctggtgtttccaccccttccttccattgcgcgtgtgggctcttagtctaagccactccatattgatttatttcccttcctgcgcatgtgttaaaggtaggaatttttcactgtgggcatatttaggcaagctccctgtgcaagttcccttatctgcacaaaacatctagtgtaagtacttggggtttttgtggattgggcaatgacctggaagggttggaggttctctggggacccttcccttactgcctgcctaatgcaagctggctaactcctctcaataggataaacattattttatgtacaaggaatataatacacagattgccctcaaagtcatatttccaactgctcatcaatctaaaaatccaaaattttgaataattttttgatgaaataatttatttcattgtttctcaattttggctgcacagtggaaccacctgggctgtttgaaaaaacctaggcctagccaggcacggtggctcatgcctgtaatcccagcacttagggagaccagcctggccaacatggtgaaaccctgtctctgctaaaaatacaaaatcacctgggcgtagttgtgcattcctgtaatcccagccacgccagaagctgaggcagaatcgttcgaatccaggaagtggaggctgcagtgagttgagatcttgccattgcactccagcctgggcaacaagagcgaaactccatctcaaggaaaaacaacaacaacaacaacaaaatcctgggctctgcttcagactagttaaaccagaatctccagggtggggcaccggaaagaacaagaaaaaagaacaccttatttttatcttcttcagtgagccaatgttcattcaaaagagagattaaagtgctttttgctgactagtcacagtcagagtcagaatcacaggtggattagtagggagtgttataaaagccttgaagtgaaagcccgcagttgtcttactaagaagagaagccttcaatggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatgtaagtatgctttatgttcctccagtaatgtacaaggtgtatttaacctcacaattcttaaagttttatttcattttaaagtgataaatgataattgtatatattaatggggtacaatattacattttgatacatgtatagattgtgaattgatcatatcagggtaattagcatatccatcatctcaaatatttgtcatttctttgtagtgagaacatttaaaatcctcttttttagctgttttgaaatatacagtacattaatattaattatagtcaccttgctgtccaatagaacacccgagcttattcctcctatctaagtgtaactctgtacctgttgaccaacgtatccccttatttggcccatctccacctgccagcctctggtagccaccattctaatctctacttctctgagtttaactttttaagattccacatagaagtgagatcatatatgatatttgcctctctctgcctggcttatttaattaatatgatgttctgtagattcatccatgccgtcataaataagaatattttttcctctttaaaaggctgaatagcatttcattgtacatatatgtcacatacaaaatccattaatttattgatgaacacttaggttgtttccatatcttggctattgtcaatagcactgcaataaacatggaagtacagacatgtcttccacatactgacttcaattcctttgggtatatactggtagtgggattgctggatcatctgatagttctatttttgttttttttaggaacatccatactgttttctcaaatcacaatgctaatttacatacccaaggttcactttattccacatctttgtcaacacttgttatctttttatctttttgataataataatatcttatctatgagttgtgatgagttatctcattgtggttttaatttgcatttctctgatgattaaatttgttgagtatttaaaaaatatatcttggccatttgtatgtctttttttgaaaaatgtctactcaaatcctttgcccatttaattaattaattaattaattaatagagacagggttttgctctgttgtaggatggagtgtagtgatgggatcatggtccctgcagccttgagctcctgggctcaagccatccttctaccttagacccccaagtagctggggctacaggtgtatgccaccatgcctggataattttttaatgctttgtagagatgtggtctcattatgttgtccaggctggtcttgaactcttgggctcaagcaatccacccacctttgtctctcaaagtgctggaattacagacatgagccattgcacttgacccctttgctcgttttaaatagaattatttatttgttattgagtaatttgagtttctaagtattttgggtggtcagaatctcatttgtctagttttgctttcatggcctgtacttttaggatcatatccaagaaatcattgcctagaccaatgtcatggagtttttctatatggtttctttcagtagtttttagtttcaggtcttatgcttaaggctttaattcattttgagttaattcttgtataagggtgagattaggattctcttttattctttgcatatgaatatccagttttcccaacaccttttgctgaagagtgctttccccattgtatgttcttggcacctttgtcaaaaatcaattgattatagatgtgtgggcttatttcagggttctctatgcttttcctttaatcagtgtgtctatttttatgctaatgctatgcagttttgcttactatagctttgtaacatattttgcagttcagtggtgtgatgcctccagctttattctttttgattaatttgctttagttatttggggtcttttgtggttccatacaaattttaagattttttttctatttctgtgaagaatgagattaaaattttgatagggattgcactgaatctgtatattgctttgggtaatatggacatttttccactattagtttttccaatccatgaacatgggatatctttgcctttatttgtgtcatcttcaatttctttcatcaatgatttgtagttttcagtatatagatctttctcttccttgattaaatttattcataagtattttattttttgatgctactataaattaattgttctcttaatttcttttttagatattttgttgctagtgtataaaaatgccactgatttttgcatgttgattttttatccttcaagtttactgaatttgtttatcagttctagcacttttgtactgaagtctttagattttctacatataagattatttcatcaggaaacagacaatttcacttcatcctttcctacatgaatacatcctttcctatacgaatattcctatatgaatattttctgtctttagtctaattgctctgactaggacttccagtactctgttgaacagaaatggtcagagggggcattcttctcttatttctgatcttagaggaaaagcttttagcttttcaccattaaatatgatgttagctgtgggcttgccacatataaccgttaatgtcacatagaaacttctgtattactggaggccagttattaaaggttatatgttataggaacattcctcagcattcctcctgtaccagcagaggctgattattaaagtatgctattgtaaagcaaatacttcctgtggagtatgtttttcttttttgtcattgtcagaaatagtggaataaaataatgcattttgccagaagagaaacatttcaagtggtaaggtagaatcaaaatgataaaggcctgctgctttctttgcttcacagtcatttgctatatttttttgcctgaaggaaaatggtagtggaagtgttttgtgattaaagattttgagaagtcagtcactgtatatgctatgtattttgcttagattagccatgatcattaaacgtcttaaaaaagcaaatcatgcctgatgtcaaagaaatatctatgagttcatcataaacataaacgaatgaaagaaagaattaattagtcagggccatctgggtggtaacagaatatttatggcctctgtacaaagctgctgtctgtgacctatgagtgtatagcatggaaaacatttttcctctgtgagatgccacacatcctgatactatctctgttggatccactctccttctgtggtgattataccagtggatctcaaagtgggctgggcagtagaatcatttgggtgatttaaaaaggtgtagattttttagtattgatgacaggactcctgcatcaggatccctatgggatgagctttgcaggagatcctgaagcagtgtcccagcagctgattattggtcaaaatatggacattaggaactgataaactgctcaggctcacagcttgactaagcaggcttcaaatttggaccttctgtttatcagctgtgggacactggcagtgaatttgaaattctttaaaatacaatctgtcttatctgtaaaatagagtaaacaaggtgttgatgtgatgattaagtttaatagcctgcatactacttgcttggcacattgaaggcactgtatatgtgcagctaaaacaataatcatcatctttgtctaaaatatacaaatatttgaagctgtatttgacagaataatcataacaacattatgatgataatatcagtctgaatcacggacaatatatagaccaaatactgagttttgctactatttgaacctccttttctatgtttagttctcaaaagtctatggccctgtgttcactgtgtattttggcctgaagcccattgtggtgttgcatggatatgaagcagtgaaggaggccctgattgatcatggagaggagttttctggaagaggaagttttccagtggctgaaaaagttaacaaaggacttggtaaatgtgcatgtatcgtgtgtatgtgtacatgtgtatgtactgggcagtggctatagggatggggaggatggaaaacaggcttgaagagctcctgggacagaacttgacctgtccacgtggctgccgagtgtcagctctcttgtccttgtttggattctccctcgtagcttctgttttctgttctgctaggaatccttttcagcaatggaaagagatggaaggagatccggcgtttctgcctcatgactctgcggaattttgggatggggaagaggagcatcgaggaccgtgttcaagaggaagcccgctgccttgtggaggagttgagaaaaaccaatggtgggtgacttttttttttcctgaaaaatgttttctaaaatttattttaatttatttttagattgatacataacttttatgcatatttatggggtacgtgtaatattttgttacatgcacagaatgtgtaatgatcaagttaggtgtttaggatatgcatcactttgagcatttatcatttctatattttgagaacagacctgtgttctagctatcttgaaatacgcaatactttgacattaacacactgctatgttctctaatgacatccctggaaacctcctaggggcagccagatctttcatgatagtggttgtcagtcctcatatggagggtggaggtttgaagcagagagccaagggaggttttgtgcacctatgcttgttgtgtttgtacacaatgactatgcatacgctgtgagtataaaaggctcatttaatcctattgtgtcccaggcttggtttgttttcaaatcattacagcatgaatttagaaggttttgtctcatttttttcaaattattaaagagcaatgtttttcccaaagtgtaattgtgggttatctattctagaacatttcaccaggaatacttgtggcacagacatagtgggaatgacttctttacatcttttgggcatggaacaactgacatgtactttcatttgtttggtctatatttgtacagtcagtctcactaacatgtctgggggtttattctaaggtctgtgtctacaatttctaccataatgatgcttatctatggttttaagagactaggcatctttagtgtagcttttatcaattttaatttccctgttaattaagaagtaattaaaattatcagctggtgttatttaatgttactatttactgtaatgttttatatattttaagaaaatatatgctatagcatagtctttcaatttaaacaaatgccaagttataaaatgtttatttaaataaattttaagtattattaataactctttatcctaccttccctagttgtccattagctctgtattcagctttctttatattttccttcatctttacttgtgtattaatcatgttttttattttctatatttttatgaaatcttcaacatcttggggattttgtggtcctagaagggactgctgctcccaaagtcagacagttcctagagatagcaaatgtcttgtccacagcatgtctctgatttacaaagcacactctccagagccagagtcccatccaccttctttaccaaactctcacacatgaatccaatacagttgtccctccttatcagtaaggcattggttctaggactcctcttggataccaaaatccacatatgctcaagtcccttagatatggcataatatttgccatatattggagaatattgacaatattatttataatatttcccaatattagagaatattgacaagaaaaaaggtccgtacatgttctgtacagatgcttgtttttgctctgaatattttttatttggggttggttgaatccatgatacaccatggatacagagtgctgactatattctccttgtcttaaattattatagggccagttatgggacaactatggccacccctatatcccagagcccacagaaattgttcaaactatctattcccaggcttactcagtctaccctccctatctcactcatttcttcctgtgaaaaccccaatgaaggctcagccccatggtttctttttgctcttgctgcctcctgaccaaccctggtacttccccatgtggctccccgcactccatggtgtggagtgcccctcctttaggaaccgtgagtaatgaactatcttttcaagggaagtctgttttggggcaacctgatcggttgacctcaccatatctaaatggatacaaaatcctcggtgaattttaaaacaactggatttgggagtaaaagtttatttatcctctccccatccaagttggactcacctataaagttcttgtcataatgagtctggttttcagcttggattacaaattaccctgatttttattatctccctgatatagtttggatgtgtgttcccattcaaatctaatattgaaatgtaacaaactaccaacagagaatactataaacacctctatgcaaataaactaggaaatctagaagaaatggataaatttctcgacacatacactctcccaagactaaaccaggaagaagttgaatctctgaatagaccaataacagtctctgaaattgaggcaataattaatagcttaccaaccaaaaaaagtccaggaccagatggattcacagccgaattctatcagagctacaaggtaccattccttctgaaactattccaatcaatagaaaaagagggaatcctctctaactcattttatgagggcagcatcatcctgataccaaagcctggcagagacacaacaaaaaaagagaattttagaccaatatccttggtgaacattgatgcaaaaatcctcaataaaatactggcaaactgaatccagcaacacacaaaaagcttatccaccataatcaagtaggcttcatccctgggatgcaaggctggtccaacatatgaaaatcaattaaaagtaatccagtatataaacagaaccaaagacaaaaaccacatgattatctcaacagatgcagaaaaggcctttgacaaaattcaacaacccttcatgctaaaaactcaataaattaggtattgataggacgtatctcaaaataataagagctatctatgacaagcccacagccaatatcatactgaatggacaaaaactggaagcattccctttgaaaactggcacaagacaaggatgccctctctcaccactcccgttcaacatagtgtcggaagttctggacagggcaatcaggcaggagaaggaaataaagggcattcaattaggaaaagaggaagtcaaattttcgctgtttgcagataacatgattgtatatctagaaaaccccatcatctcagcccaaaatctccttaagctgataagcaacttcagtaaagtctcaggatacaaaataaatgtgcaaaattcacaagcattcttatacaccaatagcagacaaacagagagccaaatcatgagtgaactcccattcacaattgcttcaaagagaataaaatacctaggaatccaacttacaagggatgtgaaggacctcttcaaggagaactacaaaccactgctcactgaaataaaagaggacacaaacaaatggaagaacattccatgctcatgggtaggaagaatgaatatcatgaaaatggccataccacccaaggtaatttatagattcaatgtcatccccatcaagctaacaatgactttcttcacagaattggaaaaaactactttaaagttcatatggaaccaaaaaagagcccgcattgccaagtcaatcctaagccaaaagaacaaagctggaggcatcacaccacctgacttcaaactatactacaaggctacagtaaccaaaacagcatggtactggtaccaaaacagagatatagaccaatggaacagaacagagccctcagaagtaatgctgcatatctacaactatctgatctttgtcaaacctgacaaaaacaagcaatggggaaaggattccctatttaataaatggtgctgggaaaactggctagccatatgtagaaagctgaaactggatcccttccttacacttgatacaaaaattaattcaagatggattaaagacttaaatgttagacgtaaaaccataaaaatcctagaagaaaacctaggcaataccatttaggacataggcatgggcaaggacttcatgtctaaaacaccaaaaacaatggcaacaaaagccaaaattgacaaatgggatctaattaaactaaagagcttctgcacagcaaaagaaaccaccatgagaatgaacaagcaacctactgaatgggagaaaaattttgcaacctactcatctgacaaagggctaatatccagaatcacaatgaactcaaacaaatttacaagaaaaaaaaaagatccccatcaaaaagtgggcaaaggatatgagcagacaattctcaaaagaagacatttatgcagccaaaaacacatgaaaaatgctcatcatcactggccatcagagaaatgcaaatcaaaaccacaatgagatatcatctcacaccagttagaatggcgatcattaaaaagtcaggaagcaacaggtgctggagaggatgtggagaaataggaacacttttacactgttggtgggactgtaaactagtttaaccattgtggaagtcagtgtggcgattcctcagggatctagaactagaaatgccatatgacccagccatcccattactgggtatatacccaaaggattataaattatgctgctataaagacacatgcacaggtatgtttattgcggcactattcacaataacaaagacttggaaccaacccaagtgtccaacaacgatagactggattaagaaaatgtggcacatatacaccatggaatactatgcagccataaaaaatgatgagttcatgtcctttgtaaggacatgaatgaagctggaaaccatcattctgagcaaactatcgcaagaccaaacatcacatgttctcactcataggtgggaattgaacaatgagaacacatggacacaggaaggggaacatcacacaccatggcctgttgtggggtgggggaaggggggagggatagcattaggagatatatctaatgctaaatgacgagttaatgggtgcagcacaccaacatggcacacgtatacatatgtaacaaacctgcacgttgtgcacatgtaccctaaaatttaaagtatataaaaaaaagtgtaatcccccatattggaggtggggccttgtgagaggtgattggatcatgggggtggatttttcatgaatagtttagtaccatcccttttggtactgtcctcatgatagcaagtgagttttcatgaaatctaaagtgtgtagcacctcccacctcccttttttgctttgacttttgccatgtgagtgaaagctcctgttttgccttctgccgtgattgcatcacgcttcctgtacagcctgcagaactaggagccaattaaacctcttttcttataaattacctagtctcaggtatttctttatagcaatgcaagaacagcctaatatacttccccacatgaagtgaaaggaaagaccagaaaccagattttcactacatcatgttcatatgcatgcacaaacacacttgcatgcatgcatgcacacacacacagaaatctctaactaataatccaaaattatcccctgccttccaggctaaaataaaagattttctgaaaacttcatcccttggcatgtttcagctgaaaagaagcctggcataggagcagttaactaaacagggtcccattatttaattccccatcattaccgcacaacatttttgttcaagtcactcttaattacattcatgatactctcacatgtaaagttcattgatgatttgattataacaattttatttaaaaattgccctttcctcttattgcccttacatttcagtatgagatttgaagggaacacacatccaaactgtatcagggagataataaaaatcagggtaatttgtaatccaagctgaaaatcagctttcctctatagtaatttattgatttgtaatatgatggaattacctaaatgatgatcaaattaaaaagtttataataacataaggtatttttttgatggctagatagaacaataaccgaggattctataagaggtcaggctttgttcaaataaattgaagatagtgcctggtgataatagacaccatttcttagagcaggaaattccttttttttctttgaatattgaaataaggaaataaaaggactccatctgtcaatttaactttttctgtctgctctatttgtagtttaggtttgaaatgaaagtttcttattacttttattttaggcaaaccaatctatcttcttatttgtgttaatttgtgttagattttttcttgtataacatagatgacttttgcctgtttacatttgttccatcaacctgaattttcccataccctttctgtctttagtctccccctctgctggtactacacacagttactttaactactcattatatagaagatgttttctggttcctattttctcccttcctctatcaatcaattgtctacaagcttttcagacagatgttattttgcactgatgacctgaattattaggtggttttaaatgtggcctctttaattttttttgttttctcttcaaaataacaggcatcttgggtcagaattgtgtaaagaaaggcagtgcggtaaatgcagtatttggaaaaccattattaaacaagctagggtggaatgattaattcagttttaaggaaaaagtgaggtattaaatttcaatatgctgtagtttgtgttgataagagaatttctaggtaggtattggtttagagtttctaaaaatactttttcctgtatcaaagacaaagtattttatatgtatattttaatggtaatttaaaatatttccaatcctttagcctcaccctgtgatcccactttcatcctgggctgtgctccctgcaatgtgatctgctctgttattttccatgatcgatttgattataaagatcagaggtttcttaacttgatggaaaaattcaatgaaaacctcaggattctgagctctccatggatccaggtgagatcaagagcttctcttcctgagatattatttttgttattttatcagacagtccaatttttttaattttttaaaattatactttaagttctgggatatgtgtgcagaatgggcaggtttgtcacatgggtatacatgtgccatggtggtttgctgcacccattaacccgtcatctatattaggtatttctcctaatgctatccctccctttacccccaatcacccaacaggccctggtgtgtgatgttcccctccctgtgcccatgtgttctcattgttcacctcccacttaagagtgaaaacatgcagtgtttggttttctgttcctgtgttagtttgctgagaatgatggtttccagcttcatccatgtcccggccaaggacatgaactctctcagcatttgcttgtctgtaaaggattttatttccccttcacttatgaagcttagtttggctggatgtgaaatgctgggttgaggcagaagacagatgatttctgcatttccaactgaggtactgggttcatctcactaggcagtgtcaaacagtgggtacaggacagtgggtgcagcacaatgagcatgagccaaagcagggtgaggcattgcctcacccgggaagcacaaggggtcagggaattccctttcctagtcaaagaaaggggtgacagatggcacctggaaaatcgggtcactcccaccctaatatggtgcttttccaatgatcttagcaaatggcacaccaggagattatatcctttgcatagctcagagggtcctacacccatgaaacctcactcattgatagcacagcagtctgagatcaaactgcaagatggcaatgaggctgggggaggggggcctgccattactgaggcttgagtaggtaaacaaagtggccgggaagctggaactgggtggagcccaccgcagctcaaggaggcctgcctgcctctgtagactccacctctgggggcagggcatagccaaacaaaaggcagcagaaaactctgcagacttaaatgtccctgtctgacagctttgaagagagtagtggttctcccagcacacagctggagatctgagaacggacagactgcgtcttaagtgggtccctgaccccccagtagcctaactgggaggcacaccccagtaggggcagactgacacctcacatggctgggtactcctctgagacaaaacttccagaggaacgatcaggtagcaacatttgctgttcaccaatatctgctattctgcaacctctgctgctgatacctgggcaaacaggtctggagtggatctccagcaaactccaacagacctgcagctgagggtcttgactgttagaaggaaaactaacaaatagaaaggacatccacaccaaaaccccatctgtacgtcaccatcatcaaagaccaaaggtagataaaaccacaaagatggggaaaaaacagagccgaaaaactggaaactctaaaaatcagagtgcctctcctcccccaaaggaatgcagctcctcaccagcaacagaacaaagctggacagagaatgactttgacgagttgagagaagaagacttcagacgatcaaactactccaagctaaagcaggaagttcaaacccatggcaaagaagttaaaaaccttgaaaaaaaattagatgaatggctaactagaataaccaatgcagaaaagtccttaaaggacctgatggagctgaaaaccacggcccgagaattatgtgatgaatgcacaagcctcagtagccgatttgatcaactggaagaaagggtatcagtggtggaagatcaaattaatgaaatgaagtgagaagagaagtttagcaaaaaaagaataagaagaaatgaacaaagcctccaagaaatataggactatgtgaaaagaccaaatctatgtctgattggtgtacctgaaagtgacggggagaatggaaccaagttggaaaacactctgcacgatattatccaggagaacttccccaatctagcaaggcaggccaatattcaaattcaggaaatacagagaatgccacaaagatactcctcgggaagagcaactccaagacacataattgtcagattcaccgaagttgaaatgaaggaaaaaatgttaagggcagccagagagaaagcttgggttacccacaaagggaagcccatcagactaacagctgatctttcagcagaaactctacaagctagaagagaatgggggccaatattcaacattcttaaagaaaagaattttcaacccagaatttcatatccagccaaactaagcttcataagtgaaggagaaataaaatcatttatagacaagcaaatgctgagagattttgtcaccaccacgcctgccctacaagagctcctgaaggaagcactaaacatggaaaggaacaaacagtaccagccactgcaaaaacataccaaattgtaaagaccatcgaggctgggaagaaactgcatcaactaacgagcaaaataaccaactaacatcataatgacaggatcaaattcacacataacaatattaaccttaaatgtaaatgggttaaatgctccaattaaaagacacagactggcaaattggataaagagtcaagatccatcagtgtgctgtattcaggagaacaatctcatgtacagagacatacataggctcaaaataaagggatggaggaagatctaccaagcaaatggaaaacaaggaaaggcaggggttgcaatcctagtctctgataaaacagactttaaaccaacaaagatcaaaagagacaaacaaggccattacataatggtaaagggatcaattcaacaagaagagctaacgatcctaaatatatatgcacccaatacaggagcatccagattcataaagcaagtccttagagacctacgaagagacttagactcccacacaataataatgggagactttaacaccccactgtcaacattagacagatcaaggagacagaaggttaacaaggatatccaggaactgaactcagctctgcaccaagcagacctaatagacatctgcagaactctccaccccaaatcaacagaatatacattcttttcagcaccacaccacacttattccaaaattgaccacatagttggaagtaaagcactcctcagcaaatgtaagagaacagaaattataacaaactgtctctcagaccatggtgcaatcaaactagaactcaggattaagaaactcactcaaaacccctcaactacatggaaactgaacaaactgctcctgaatgactactggtacataatgaaatgaaggcagaaataaaaatgttctttgaaaccaatgagaacaaagacacaacataccagaatctctgggacatattcaaagcagtgtgtagagggaaatgtatagcactaaatgcccacaagagaaagcaggaaagatctaaaaatgacatgctaacatcacaatttaaaaaactagagaagcaagagcaaacacattcaaaagctagcagaaggcaagaaataactaagatcagagcagaactgaaggagatagagatgcaaaaaacccttcaaaaaatcaatgaatccaggagctggtttttttaaaagatcaacaaaattgatagaccactagcaagactaataaagaagaaaagagaagaatcagttagatgcaataaaaaatgataaaggggatatcaccaccaatcccacagaaacacaaactaccatcagagaatactacaaacacctctatgcaaaacactagaaaatctagaagaaaagaataaattcctcgacacatacaccctcccaaaaataaaccaggaagaagttgaatccctgaatagaccaataacaggctctgaaattgaggcaatagttaataacttaccaaccaaaaaaagttcaggaccagatggactcacagctgaattctatcataggtacaaggaggagctggtaccattccttctgaaactattccaatcaatagaaaaagagggaatcctccctaatgcatttggtgaggccagcatcatactgataccaaagcctggcagagacacaacaaaaaaagagaactttagaccaatatccctgatgaacatcgatgcaaaaatcctcaacaaaatactggcaaaccgaatccagcagcacatcaaaaagcttatccactatgatgaagtgggcttcatccctgggatgcaaggctggttcaacatacacaaatcaataaacgtaatccagcatataaatagaaccaaagacaaaaaccacatgattacctcaatagatgcagaaaaggcctttgacaaaattcaacaacccttcatgctaaaaactttcaataaattaggtattgatgggatgtatctgaaaataataagagctatctatgacaaacccaaagctgatcataccgaatgggcacaaactggaagcattccctttgaaaacaggcacaagacagggatgccctctctcatcactcctattcaactagtgttggaggttctggccagggcaatcaggcaggagaaggaaataaaaaatattcaattagtaaaggaggaagtaaaattttccctgtttgcagatgacatgattgtatatttagaaaaccccattgtctcagcccaaaatctccttaagctgacaagcaacttcagcaaggtctcaggatacaaaataaatgtgcaaaattcacaagcattcttatacaccaataacagagaaacagagagccaaatcatgagtgaactcccattcaaaattgcttcaaagagaataaaacacctaggaatccaacttccaagggatgtgaaggacctcttcaaggagaaccagaaaccactcctcaatgaaataaaagaggacacaaacaaatggaggaacatttcttgctcatgggtaggaagaatcaatatcatgaagacggccatactgcccaaggtaatttatagattcaatgtcatttccatcaatctaccaatgactttctgcacagaattggaaaaaactactttaaagttcatatggaaccaaaaaagagcccgcattgccaagtcaatcctaagccgaaagaacaaagctggaggcatcacactacctgacttcaaactatactacaaggctacagtaagcaaaacagcatggtactgctaccaaaacagagatatagaccaatggaacagaacagagccctcagaaataatgccacatatctacaaccatctgatctttgacaaacctgacaaaaacaagcaatggggagaggattccctatttaataaatggtgctggtaaaactggctagccatatgtagaaagctgaaactggatgccttccttacaccttatagaacaattcaagatggattcaatacttaaatgttagacctaaaaccataaaaaccgtagaagaaaacctaggcaataccattcaggacagaggcatgggcaaggacttcatgtctggaataccaaaagcaatggcaacaaaagccaaatttgacaaatggatctaattaaactaaagagcttctgcacagcaaaacaaaccaccatcagagtgaacaggcaacctacagaatgggagaaaatttttgcaatctactcatctgacaaaaggctaatatccagaatctacaatgaactcaaactaatttacaagaaaaaaagaaccccatcaaaaagtgggcaaaggttatgaacagacacttctcaaaagaagacagttatgcagccaaaggacacatgaaaaaatgctcatcatcactggccatcagagaaatgcaaatcaaaccacaatgagataccatctcacaccaattagaatggtgatcattaaaaagtcaggaaacaacaggtgctggagaggatatggagaaataggtacagttttacactgttggtgggactgtaaactagttcaaccattgtggaagtcagtgtgatgattcctcagtgatctagaaatagaagtaccatttgacccagccttcccattactgggtatatacccaaaggattataaaacatgctactataaagacacatgcacacatatgtttattgtggcattattcacaatagcaaagacttggaaccacaccaaatatccaacaatgatagattggattaagaaaatatggcacatatacaccatggaatactatgcagccataaaaaatgatgagttcatgtcctttgtaaggacatggatgaagctggaaaccataattctcagcaaactatcgcaaggacaaaaaaccaaacactgcatgttctcacttataggtgggaattgaacagtgagaacacacggacacgggaaggggaacatcacacactggggcctgttgtggggcggggaaagggggagggatagcattaggagatacacctaatgttaaatgaagagttaatgggtgcagcacaccaacatggcacatgtatacatatgtaacaaacctgcacgttgtgcacatgtaccctaaaacttaaagtataataaaaaataattaaaaaaagaaattcctctccacctctaccacacagtctcagagtgtacacagttgttcccagtttcccatgattgggaaggactcaaacactatgatggcaggtcaactttctgtcatcttgtccaagggaaaagcacactaagctgggagtgaatgagcctgacctaaacagcagcagagagaatgaggtggagaggagaaggaagaggatagttaggagaagtctgaagcctatagcttagagagtgtcttcctcatgaaaaattgcactcactgggcagtggcattacagaaacaggcttaatttggattaatctttctgtaaatctgtattgagaattgtttcataaaacaatgtcactggtaaaaaaaaaataaaaaagaaattcttggttgaaaattcttttctttaaaaatgttgaatagtggcccccactctcttctggcttgtctggtgtctgcacagagatctgctgttagtctaatgggcttccctttgtgggcaacctaacctttctctctggctgccctcaatattttttccgtcatttcaaccttggtgcatatgatgattgtgtgtcttggggttgctattctcgaggagtatctttgtgatgttcctgtatttcctgaatttgaatgttggcctgtcttgctaggttggggaagttctcctggatagtatcctgaagcgtgtttttcaacttggttccattctccccgtcactttcagatacaccaattaaacatatgtttggtcttttcacttagtcccatatttcctggaggctttgttcgctccttttcattcttttttctctaatcttgtattctcactttatttcattaagttgatcttcaatgactgttatcctttcttctgcttgatcaatttggctattgatagttgtgtatgcttcatgaagttcttgtgctttgtttttcaactccatcaggtcatttatgttcttcttgaaactggttattctagttagcaattcctctttttatcaaggttcttagttcccttgcattgagttagaacatactccttgagcttggaggagtttgttattacacatcttctgaagcctacttctgtcagtttgtcaaactcattctccatccagttttgttcccttgctgttgaggagttgtgatcctttggaggagaagaggcattctggtttttggaatttttagtctttttgtgctggtttttcctcatcttcatggatttatctacctttggtctttgctgttggtgaccttcggatggagtttttgcatggtcgtccattttgttgattttgatgttattgctttctgtttgttagttttcctcctaacagtcaggcccctcttctgcaggtctgctggagtttgctgggggtccactccagaccctgtttgcctgggtatcaccagcagcggctgcagaacagcaaagattgctgcctgctccttcctctggaagcttcatcctggtggggcaccagccagatgccacccagagttctcctgtatgacatatctgtcaaaccgtgctgggaggtgtctccctctcaggaggctcaggggtcagggacccacttgaggaggcagtctgtcccttagcagagcttgagggctaggctgggagatctgctgctctcttcagggccatcaggcagaaacgtttaagtctgctgaagctgggcccacagccaccccttcctccaggtgctctgtcctaggaagaggtggttttatctatagtcccctactggggctgctgcctttatttcacagatgccatgcccagagaggaggagtctagagagacagtctggctacaggggctttgtggtgctgcggtgggcactgcccagactcatcttcccagaggttttgtttacactgtgaggggaaaaccgcctactcacacctcagtaatggtggactcccctccctcccatcaagcttgagcatccgaggtcgacttcagactgctgtgctggcagtgagaatttcaagctagtggatcttagcttgctgggccccatgagggtgggatcctgtgagctagaccacttggctccctggcttcagccccctttccaggggagtgaatggttctgtctcactggaattcaggtgccactggggtatgaaaaaaagacttttgtagctagcttggtgtctggccaagtggccacccagttttgtgcttgaaacccagggcccttgtggtgtaggcatctgaaggaatctcctagtttgtgggttgcgacaggttgcgaagaccgtgggaaaattgtagtatctgggctggatagcactgtccctcatggcttcccttggctaggggagggagttccccaacccgttgtgcttcctgggtgagccaattccctaccctgcttctgtttgccatccgtgggctgcacccactgtctaactagtcccagtgagatgaaccgggcacctcagttggaaatgcagaaatcacgggccttctgcattggtctcgttgggaaccacagactggagctgttcttatttggccatcttgccccaatcccagtccagaactttgtatgtaccaagctgtgaagtgaatgtttgaaaactggaaattttggatactcttatatagtagctctggaaatcagagtctttcctctctttagggtgttttgttgcctgctatagttttttttttttttcttctgaaggctatagcttcctttagtgacttttcaaaactatttttgcaagtcatgtgtggtttctgaagtcttttctttagcgtatgttcagctaattttgacagaaattttcttgaatgtggagaggcaaaaaagagacatagaaaaaatatatgtatttatatatataaatagcagaagaaagatggaaggaagtaaggaaaggaaggaaggaggaaaggaatgaaggaagaaaggaaggaaggaaggtctttcagattggctggagcactccttgtcatagccttcacttactgcttaagttgagcctggatatcagccagaggtgaaagttcaggatcttctcacatttttctaactagcctgtcccgctctgggcatgttgataactttctaaatttcttagtatacataggcacttttgaacatcccattttccaaagaaactgtctcccagcttttattctcaggattttagtgctctactgtgtgccttaactataatcgtttgccctaggtagctttgggttgttcatttgtcttaggagatttttgagaaatgtccattgcttttccatcctgagtgagttttgaatcaggtgaaacaaagatgactgcctcgtgttagcccgtgttagtcctcagacaggtgagaaagagaaacataattttttgcaagtaaggtcttctgtggtccctctgtaaataggaaccagggccttccactgcgagcagggctgcccttgacaagatcactgccaagctgatgagggaggtggtacaagtgcaaataaacataccacaaagcttacatatgcatcatggaatactatgtagccataaaaaggaatgagattatgtcctttgcagggacacagatggagctggaagccattatcatcagcaaactaatgcaggagcagaaaaccaagcaccacatgttctcattcataagtgggagctgaacaaggagaacacatggacccagggaggggaacaacacacactagggcctgtccggggtgttggtggagggagagcattaggaaaaatagctaatgtgtgcggggcttaatacctaggtgaagagtttataggtgcagtaaaccaccatggcacacatttacctatgtaacaaacctgcacatcctgcacgtgcaccttggagcttaaaataaaaataaaaacccacaaagcttttctactgtttttaagttgccattttttttattcagttctcccttgtttgctataaacctttgactgatttccagagttctgttagagttgattctgacttttttgtttgaatttttgggtgtttttatggagagatgggcccatggaactgtctattgtgccaattttgcgggcattattctgtgaagtgagtggttgaacactacagcttgcccatatcttagcattgtggcattaacatctgggaaagatagatgatttctttattttacagatgagaaaagaaatgcctgaatatagagctggaattcaagcccattagctggtggtttttcccaccaaacccccaaatccagtttctggcagtactttggtgactgcccaaaagcacacactcaatggaaatccaagtcccttgttgaaaagctggcattactcacaggcttttcctctaattcacacctagagacctcttcatcacattatttggcaaaaggggaggaggttttggagaacagatgctaccaggaagttctgaataggataggggtgtttgctgcttcagcaaggtaattaaggttaagatgacaaaatgattggattttggggtgtatgaaccattaaaaaattacagttttgcctgtgctgagctagcatgtcctgaactctgtctaaaggataattgtgtgattatctcaactactcacggaagtatcttaactactctggtgtatgggtacttatccataaaatgctgagttacattttatggtatctttgtacccctcccagttataaaagagtgattctatttctgaggcttcctgctaggagtagaaatagcagggaatggctttgtgatctatttcatgttgttcaaatttccttaccctctgttcttatctgtaaaatgggaattaaagcaattcatggcattctatatttcaaggctatggagaagaattaatgtacaaaaatgagataattgacatgaagctattttaatattctgaaaataatatatgagtatagaaaattatcatctttgatcccttgttcagaattttctaacttaaatctttctatcagtatagaggactactttgtacgtataatcaaatgctcctcttacagagggagataatttttaaaaattcactccagttttaaaccagcagttgacttatggcatatgtcttcaatacatgtgtttaatttaattaatttttaaaaatctttaaggtctgcaataatttccctgctctcatcgattatctcccaggaagtcataataaaatagctgaaaattttgcttacattaaaagttatgtattggagagaataaaagaacatcaagaatccctggacatgaacagtgctcgggactttattgattgtttcctgatcaaaatggaacaggtaaaatgttatttgtttgcctgcatcttgtggttcattgattagttctataacgattgcttaaatagtgaggcaagaaacacttcatgagcactttatgtacttatcatgtgtatagatctggatgaagcaccatggagaatttataattgaattgttaaacaattataatatgtgagcaccattgttaggtactaagaatttatctgagaaaagacagaatgcatgccttagatgaaagggaaatacaaataagatagaaaatgcaaaatatagcatcataaattgaaggtggacatggtcatatcacacagcatatgggagagtgaggtgaaagggtttaacctaagtgggcctcctgcatgtcctgatgtttggtgtaaatgttaaaatatttacaatgaataacggggcagtcaattttttggtgtgcagaacagtgtgatgacaggttcagaggtgtgtggtggcaaagagatggaaaagggaggccttaactgaatggaaccaaaagtaaatccggacaaatatggaattggaggtgtctgtaagctgcagacctgaatgctggcatggagagttttgatgtgatcaggtatatgtgtgagccctaacaagagtgggatgcgtataattattagagaaaataatcctaggaattgtgtagaaggatatgtacaatgagaatggaggtcaaaaacttgctacaagacatttcatatatttgaagttcagcttgctgaaagtgtgggctacagaaacagattctgaaataaaatcaagttgtccattttgtcatattgccaaaaatctatggatattagtttcagttagaggatcagataggagccaaatgataggacctgtgtgggaaatttcagtaatgagagcagacattctctttgataactttaactgaggagggaaagattcagatggtgaatttgaatagtggtagggtcaatatggaaactgtgaggaaggtaatatagatgcttcaggacactaaggtgcaaagtactctttgaactgagaagaggcccaatccagaacaaactgaaaagagttaactctagagaataaaatctttcctctgaagccaccattattttattcaaccgctttacagcactaggtggaaatgcagaatcagtcagtaggtgaaaatgggacagagtcaaagatgctgatgaaggtgacttccatgaaattgcccatggaatgttagcaggactgctcgaataatgtgttctagatggagtgaagtgaagaagatgagatactttgaggaaactggagaagggaagaaacaaattatttgtactctccaccttctctactgctaggtcaattgttctgaggtctaattaatttaagaatctcattaaaatatggacactgccagaaaaatgacactatatgagttctccatttttgtacacatttaggggggtttccttaatgctatgaattgtctccattaattccaggttaaggagaattgtaaggtctatggtgtttcagtgaccagtggctatgtcctcattactatatttaaaaagtgcattgttcctttgacctcactataatatttagaatctagcttattttatttttcacagcatttttattgagtttaattcacatattgtaccctcatacattttaaatacaattcaacagttttagtatttttcacagagctgtgcagccaccaccacaaccaatttcagaacatttccatcatcctgaaaagacaaccatatgcttaacagtcaccctgtattggggtggctctagtcaacactaatatactgtctgtctctataggtttgctattgtagacatttcatgtaaatgaaattacacagtatgtggtctttgtttgtctgacttctgtcacttagcacaatgttttcaaggttcattgacatagcatgtatcagtacctcattcctttatgtggtcaaataatatttgggtgtggctatatcatattttatatttccattcattagttgttggttttgattgtttctgttttggctgttatgaataatgctggtatggacatttgtgtacaagtttttgtgtatagataagtttttatttctcttgggtatatacttggctgcagaattgctggattatacagcaactgtatgcttaatctttggagaaaccgtggctggatcaaagacctaaatgtaagagctaaaaatataaaactctcagaagaaaacctaggcatgaaatttgctgcaccatttcgtattctcactacaatgttttgaggattccactttctccacaaccttgctaatgtttcttatctttttgattccagccatcccagtggggttgaggtggttccatgtggtttggtttgcattttcctgacatcaaataattttctcttgtgcttactggtcatttgtgtatctctttggataaaagtatattcagaccttttgtccgtttttaaattaggttattatatttttaaaattattgagatggaaaagtttttatatattctagataaaagtcccatatcagatgttattaaagatattttctcccattttgtcaagtgtctttcactttcttaacagtgtcttttgaaatacaagtttttagtttttgtgaaatccaatttatttatttatttgcatggtttcttgcaatttttttgtcacgtttaagaaatgatttcttagtccaatatcacaaagattcaccccaagttttcttcaaatggttttataattttaactattacatttaggtctaagatccactctgagtcaatttttgattatagtgtgaggtatgggtacaacttcattctttgcatgtgcattcagttgtcctagtaccatttgttgaaaagactattcattccccattgagtgatcgtggtacatttgttgaaattcagttgactacaaacacgaggatttatttttagactctaaattctatttcattgatctatatagctttctttatgccagtatgacagtactttttttttttgagacagggtctcgctctggttgcctaggctatagtgcaatggtgtgatcttggcctctacctcccgggctcaggtgattctcccacctcagcctcctgaatagctgggattacaggcatgtgccactatggccagataatttattgtatttttagcagagacagcctttcgctattttgcacaggctggcctccaactgctggcctcaagcagtccacccaccctggcctcccagattgctgggatcacaggagtgaaccacgcacctgggtgatggtagcttttatgtaagttttgaaattggaaagtgtcagttctccagttttgttctttcccaagattgttttggttcttagctattttggttgtgtagagttccccatgaattttatggtaatcttgtccatttctattaaaaaggtaacagatattttgatatggatcactttgaatctgtagatcaatttgggaagtaatgccattttaacgatattaagtcttccaatagatgaacatgggatgtctttccatttatttagatcttctttaatttctttcaacaatgttttgtgtcagctagcttaattttgataggctatttgtacataaccactgatttttcaaattcacttaaacagaaggaaatattagtattggtttataagtgctctactctccttcctggctttggtgtaattttgagttgataagcttagaaaactgtgttaagttgatgttaccaatgggcatgatgacctttgtctagcaagtacatctgttgagaggactaggtttgtcttactgtggttgattacataatattaggcatgccacaggtcacatggagattataacagccttattaaattaatgctgttctagaggattgaataggaagaaatctttttttgtatgttaattactccctatagtcaataatttagactgtcccattgttatggtcaattttgtgttacatatttccctcatcttaaaccagccttagttgccttgtgaagtgctttgttcttccactctccattttattattaatggcataaactgcaattactttttcaccaactgaatataagaactcagttcattcagtcccttgtcctaagcatctccattgcccttactctctccttcatcctgtataggtggttaatgtccaaactctctgtcttcatgtctgtagtgtctcttcaatttctatattcttattcattcctgtgcttgtttactagatcaagttgactattacctcacatctggaatataataatggctggccccatcttgtcttgtcaatctgttctctttctccataatcttggatatgttaccatgttatcttttgcacatttccgagttcataatgagtctgcaggcaatattgagtgtgactaaattcttttttttttctcagacagagtcttactctgtcacccaggctggaatgcattggcatgattgtggctcactttagctcgaccttctggactcaagtgatcctcccacctcagcctccccagtagttgggactgcaggtgcacatcaccatgcccagataattaaaaatttgtttttatagagatagggtctcactgtgtttgcccaggctggagtggacctcctgaactcaagtattcctcctgcctcagcttccgacagtgctgggatttaaggcatgagccactgtgcccagtctaaattacctataattccttatacaatgtaaatgccatgtaagtggttgttatactgtattttttagggaataatgacaagaaaaagaagtctgtacatgtccaatatgaacacttttttttttctgaattttattcttttttgttttagaggcagaatcttgccccattgcccaggctgttgtgaagtggtatgaccatagctcactgcagccttgaactcctgggctcaagcaattcttccacctcagcctcctaagtatatgggacaacaggtgcatgccaccatgcccaactaattttttttttttttttttttgtagagatagggtctttccaggttgcctaggctagtcttgaacttctgggctcaagcgatcctcccatcttggcctcccaaagtgctgggattacaggcatgagccacctcacctggcctctttttccaatttttttttttttttatttaaggttggttgaatcaatggatgtggaatccatggataggaaggtggattgtactctattattagctatattcaactggctgtgcaatttattattttttaaaaaagagatcagatttactcctccattctaacaggctttataccctttgactatcatctccccctttccccccgcccccaagccctctggcaatcagcattctactctcttctatgagttcggttgttttagattccacatataagtgagaatatatagtatttgttttcctgttcctgacctgactttacttagcataatgttctccagttccatccctgttatcacaaataacagaatttcttcatttttaaggctgaatagtattctattgtgtatatataccacattttctttatccatttatctgttgatgggcacttaggctgattctatatattagctattgggaatagtgctgcaatttacatgggagtgcagacattgctttgacatactgatttcaaatcttttgagtaaatgcccataagccgaatcactggatcatgttgtaattctatttttagttttttgaggaaccttttactgttttccataatggttgcactaacttacattcccatcaacagtacacaagtgttcccctttttccacatcttcaccaacacttgttttttctctctttgataatagccattctaacagatgtgaggtgatagctcattgtgtttttaatttgtaactttttaatgattagtgttgttaagcatctttttatgtatctcttaatcatttgtatgtcttctttttagaaatattcattcaggctatttgcccatttcttaattggattatttgttttctttctatagagttgtttaagttccacatatatgtgcatgcatgtctgtgtgtatatagtttttaattttaattttaattttaaaagaagtatagaaatttaatatgtttttcttccaatgttatgttttctcatatttttttctttttttaattatactttaagttctagggtacatgtgcacaatgtgcaggtttgttacatatgtatacatgtgccatgtaggtgtgctgcacccattaactcatcatttacattaggtatatctcttaatgctatccctccccgctccccccaccccacaatagtcccccgtgtgtgatgttccccttcctgtgtccatgtgttctcattgttcaaatcccacctatgagtgagaacatgcggtgtttggttttttgtctttgtgatagtttgctgagaatgatggcttccagcttcatccatgtccctacaagggatacgaactcatccttttttatggctgcatatattccatggtgtatatgtgccacattttcttaatccagtctatcactgatggacatttgggttggttccaagtctttgttattgtgaataatgccacaataaacatacgtgtgcatgtgtctttatggcagcatgatttataatcctttgggtatatacccagtaatgggatggctgggtccaatgatatttctagttctagatccttgaggaattgccacactgtcttccacagtggttgaactagtttaaagtcccaccaacagtgtgtaaaagtgttcctatttctccacatcctctccagcacctgtttcctgactttttaatgatcgccattctaactggtgtgagatggtatctcattgtggttttgatttgcatttctctgatgaccagtgatgatgaacattttttcatgtgtctgttggctgcataaatgtcttcttttgagaagtgtctgttcatatacttcacccactttgtgatggggttgttttttttcttgtaaatttgtttgagttctttgtagattctggatattagccctttgtcagatgagtagattgcaaaaattttctctcattctttaggttgcctattcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttagatctgacatttatgtctttaatccatgttgaattaatttttgtataagatgtaaggaagggatccagtttcagctttctacatatggctagccagttttcccagtaccatttattaaatagggaatcctttcctcatttcttgtttttgtcaggtttgtcaaagatcagatggttgtagatgtgcggtattatttctgatggctctgttctgttccattggtctatatctctgtgtcagtaccagtaccatgctgttttggttactgtagccttgtagtatagtttgaagtcaggtagcatgatgcctccagctttgttcttttgactcaggattgacttggcaatgtgggctcttttttggttccatatgaactttaaagtagttttttccaattctgtgaagaaagtcattggtagcttgatggggatggcattgaatctataaattaccttgggaagtatggccattttcacaaaattgtttcttcctatccgtaagcatggaatgttcttccatttgtttgtgtcctcttttatttcattgagcagtggtttgtagttcttcttgaagaggtccttcatatcccttggaagttggattcctgggtattttattctctttgaagcaattgtgaatgggagttcactcatgatttggcactctgtttgtctgttattggtgtataagaatacttgtgatttttgcacacttattttgtatcctgagactttgctgaagtttcttatcagctttttggagattttgggctgaggcaatggggttttctaaatatacaatcatgtcatctacaaacaggaacaatttgacttcctcttttcctaattgaataccctttatttctttctcctgcctgattactctggccagaacttccaacagtatgttgaatagaagtggtgagagagggcatccctgtcttgtgccagttttcaaagggaatgcttccagtttgtgcccattcagtatgatattggctttgggtttgtcataaatagctcttattattttgagatgtgtcccatcaataccgaatttattgagagtttttagcatgaaggtttttgaattttgtcaaaggccttttctgcatgtagtattgagataatcatgtggtttttgtctttggttctgtttatatgctggattacatttattgatttgcatatattgaaccagccttgcatcccagggatgaagccaacttgatcatggtagataagctttttaatgtgctgctggaatcagtttgtcagtattttattgaggatttttgtatcgatgtgcatcaggaattttggtctaaaattctctttttctgttgtgtctctgtcaggctttggtataacgatgatgctggcctcatcaaatgcattagggaggattccctctttttctattgattggaatagtttcagaaggaatggtaccacctcctccttgtacctctggtagaatttggctgtgaatccatctggtcctggactttttttttgttggtaggctcttaattattgcctgaatttcagagcctgtgattggtctattcagggattcagcttcttcctggtttagtcttgggagagtgtatgtgtcgagaaatttatccatttcttctagattttctaatttatttgcgtagaggtgtttatagtatgctctgatggtagtttgcatttctgtgggatcagtggtgatatcccctttaacattttttattgcatctatttgatttttctctcttttcttctttattagtcttgctagtggtctatcaattttgttgatcttttcaaaaaaccagctcctggattcattgattttttgaagggtttttgtgtctctatctccttcagttctgctctgatcttagttatttcttgccttctgctagcttttgaatgggtttgctcttgcttctctagttcttttaattgtgatgttagggtgtcaattttagatctttcctcctttctcttgtgggcatttagtgctatacatttccctctacacactgctttaaatgtgtcccagagattctggtatgttgtgtctttgttctcattggtttcaagaacatctttatttctgccttcatttcattatgtacccagtagtcattcaggagcaggttgttcagtttgcatgtaattgagtggttttgggtgagtttcttaattgtagttctagtttgattgtactgtggtctgagagacagtttgttataatttctgtttttttacatttgctgaggagtgctttaattccaactatgtggtcagttttggaatacgtgcgatatggtgctgagaagaatgtaaattctgttgatttggggtggagagttctgtagatgtctattagatctgcttggtgcagagctgagttcaattcctggatatccttgttaactttctgtctccttgatctgtctaatgttgacagtggggtgttaaagtctcccattattgttgtgtaggagtctaattatcttcgtaggtctctaaggacttgctttatgaatctgggtgctcctgtattgggtgcatatatatttaggatagttagctcttcttgttgaattgatccctttaccattatgtaatggccttgtttgtgtctttcgatctttgttggtttaaagtctgttttatcagagactaggattgcaacccctgcctttttttgttttccatttgcttggtagatcttcctccttccctttattttgagtctgtgtgtgtctctgtatgtgagacaggtctcctgaatacagcacactgaggagtcttgactctttatccagtttgctagtctgtgtcttttaatcagtgcatttagtccatttatatttaaggttaatattgttatgtgtgaatttcatcctgtcattatgatgttagctggttattttgctcattagtttatgcagtttcttcctagcatcaatggtctttacaatttagcatgtttttgcagtggctggtagcagtttttgctttccatgtttagtgcttccttctggtgctcttgtagggcaggcatggtggtgacaaaatctctcagggtttgcttgtctgtaaaggattttatttctccttcacttatgaagtttagtttggctggatatgaaattctgggttgaaaattcttttctttaagaatgttgaatatcggcccccactctcttctggcttgtattgcccagatcaatgtcctgtagtttttcctcaatcttgtcttctagtagtttacagtatctggtgttatgtttaagtctttaatccatgttgagttgcttgagtatatggtgtgagatcagtgttcaattttattctttagcatttggatatccagttttctcaccatttatttaagagactgtcccctttccattgcatattcttggtacctttgtctaaaatcaattgtagttgcatgggttcttttccagctctctgttatattctgttggttgatgtgtccatttttatgccagtaccatgctgttttaattactattaatttgtagtatagcttgaaatcaggtaatgtgatgcctccagctttcttctttctgctaattattgccttggctatttgggtatttttgtggttctatatgaattttttggggatgacttttcctatttctaagagagataacattggaattttgatagggatttcaatgaaaccataaatttctttagatagtatggacattttaacaatatcaactcttccaatccatgcatatggtatctcttttttatttgtgtcttcttcatttttttaattaatattttatattttttggtgactttcacttttttggttaaatgtactcctaaatactttatttctttgatgctattgtaaatgggtttatttttaaaatttctttttcatatcatttgttgttaatgtgttgaaacactattaatttttgtgtgttgattttgtatcctgcaactttactgaatttaattatcagttctaagagttttttggtgatgtgtttaaggttttctgtatgtaagatcatgccatcagcaaacagagacaattttacttcttttcttctttggatgtctttcatttatttttcttgtctcattgctctggctagtacttctcatactatgttgaattgaagtactgagagtgggcatccatatctttttcctgatcttatgggaaaatccttcaactttccactattgaatatgaggttagccatgcacttgtcatatatggacttgtgttgaggctagttattagctccactatcaggagcagcaatttgcaggacatgctaacaagtctcatccaggcagaaacttggacttttgagtttcatccctttctctgccatgatcccagaggattaaacctctggaagtgcttgtgcactaatataatactggtactttttccagtggtctagagagagactcctgtatacttagtcctctctgctcccagaattggtaagttaagtagatagctgtggggaaccttagagttagggtgttaatgtgtggtctaaatcctcctttccacagggagaagctggatgttggggattcattctcaattgtatggtgtagtgcctgggtgaggttggtgctgtagctttttcttcccagtctatgtggatattttctttgttgctcagtacatagaagtctctcaacttgtttctgactttctctcacagggaattgatctgtgaatagatatttatttggtgtatccttgggtggaagaagagactggagcctcctattctgcaatgtccctattgtgacactgagaattgcaaacccttgattcttgcttataatgtatttatgtctctaatttacttatttctatttctatcaattaagattgtatatatacaaataagaaaaaaaattaacatggcttaaacaaataatgtgtttatttatttcacatacagggtgtcatgttgggcagtgcagaactagtactgtagctctgaagcatcctagaactaggtgcctgccatttttgatccccacgcttacaacatgaaccttcatcttgattatttttttttttgagacaggatctctctttgtcatccaagctggagtgcagtggcatgaacatgcttcactgcagccttgacctcctgggctcatgtgtttctctgtgtcagcctcccatgtagctgggaccacagatatgtgcaattcacctggttaattttttgatttttatttttttttttgagaggagtttcactctgtcacccaggatagagtgcagtggtgtgatctcggctcactgcaacctccgtctcctgggttcaagtgattcttatgcctcagccttccgagtagctgagattacaggcgcatgccatcacgcccggctaatttttgtgtttttagtagagatgagatttcaccatgttgcccaggctggtctcgaactcctgacctcaggtgactgcctgtcttggcctcccaaagtgctgggattacaggcatgtgccaccatgcctggccaagtttttgattttttttttagagacagggggtctcacttgttgcccaggctggtgtcaaactccagaactcaagtgatcctcctgccttggcatcccaaagtgttgggattacaggcatgagccaccacagatggacttgttatattcttaaatattcatgttccaaggtgatatctatatcacctctaccttcatatatgtgttttgagtaaaaaggagagaaagtgccatcaacaggtacctgcttatatgtcatagacaagaaatatgtttcatggccaacacagctccaaaagatattcagaaatagaatttttaggcaagcaatggataagtaggaatgggaaatgaactattttacattctctgccacaccgtgcaattgttgtagttttaatactgcactctgtacagtttccaaacttccttatctttagaacaacctgatatattttggattttttgtaatttaatatgctggcaaactaccaaataattaaattatgaaataattttttaggaaaagcacaatcaacagtctgaatttactgttgaaagcttgatagccactgtaactgatatgtttggggctggaacagagacaacgagcaccactctgagatatggactcctgctcctgctgaagtacccagaggtcacaggtatgatgataccataggtgagcagggtgattttcagaaaagatgttgggaagacactgctattgtcctcaatcttgtttctcttagagaagcttcattattgaaatttctgtgccattggctctaagttgtctaaatatgatgaagggataagaatgagacaaatttgcacaatagggaagagggactgagagaggtgaagacagtgtgatcagtagcaaaagtaataaagccctggattttagtgactaaatacttttaataaagtgtctagatttcatgggagacgatttgtagcaggcacaggcatgatgaattggcctaggattgtatgttggttttctaaagaacagaccactttgttgcagtttcttttttgaaatgagtagaaattttatttcactaaaagccatgtctacaaaattccattttccagcagaacagaccactttgagtaatagatatgctctttctttctttctttctttttttttgagacagagtctcactgtgtcacccaggctggagtgcagtggtgcaatcttggctcactgcaacctccgcctcccgggttcaagtgattctcctgcctcagcctcctgagtagctgggattacaggtgtacccaccacacctggctaattattttgtatttttagtagagacggggtttcaccatgttggtcaggctaggctcaaactcctgatctcaaatgatctgcccaccttggcctcccaaagttcttggattacaggcatatgccactgtgcccagccaggtatgcttctatagatcttcccttattctgaaaatgtagtgttttaatgctgggacagtaaagacagaaactctttttatttttaatttttattattggcaattcttttgtggttggtttgatgccattttttaatgttttggtaaatttctatttttatagacttaggggtacaagtgcaattgtgttcatgaatatattccctagtggtgaagtctgggctttcagtgtacccttcacctgaatagtgtacattgttcccaataggtagcatttcatccctcacctccctcccacctttccaccttttggactctccagtgtctattattccactctgtatgtctctgtgtacccattgtttagctcccatttataagtgagaacatgtggtttttgactttctattttgagcatttgcacttaggataatggcttctagttccatccatgttgccacaaaagacacgatttcgttcttttacatggctgagtagtagtgcatggtgtgtgtgtgtgtgtgacacaccatagaatactagatgcagatttttaaatcccacacataacaattttaatccattcatctgttgatggatgcttgggttgattttatgaatttgccttggtgaatagtgctgcagtaaacatatgaatgcagatgtcttttcgataaaatgatttcttttattttggatagatacccagtagtgggattgctggatcaaagggtagttctatttttgattctttgggaaatactatttattgaagtgtatagtggatattctagaaatgtcatgagatagcctgagaaaatctgtatagtctgggaagtattttaaacacttaggtgtataataaaggtgtatgatatttaagcagaaaatgtgcctgaggaattttatgattatcaaaatctgcatctagaaaaatggtacttgtcaatattttttcttagggtcaatagttttatcttttacaagcaacttttttttttcttcaacttttatatttatctatgagcagattctggctctgcataacatattagccacacacttgtttttctggggtcagaatcacactgaagtgatgataaacatattacaaatgagaattactcctgttaaagttggagtataaccatcaagtctttaacaaacttctcagacacagagagcagatagaaggatgataaccaatttggcagagagattgaagttgcaacctaagggtcataagaatttctgttgctatagtccccataaggctgagtattcaaaagaaccaagacccaaagaacatagagggagaatgaggcagaaaacagaaaattctccctgcctagtttccctccacaactccatttgtcaactaattgtttttctccacagaaaagggaggttcactctctagagaaactgaacctaagaggctcactcatggacaacagacagagactgggaaagagtgaggggttaagtaagagtccacttgaattctaaggcctttagcgcctttttctatcttgttcctaaaatacagcagccaggtgtaaactccagaggacaagtagcaccagtggaaagacctccatttttcaccatttagatagaaaattcttaccaaatgtccagcaaagtgaatgaaatggaaaatattcatccaagacaccagaccatggggaattttagaacatcagagttaaagggaaagtcataaaaacattcagagataaattaggtcacctgtgaaggatcaggaatcagaatggcattagaattctcaagagcagctgtcatcttgtgtatttgtagataaagaatattttcagatctgcatttggcaaaaaatttttgccctttgtgtttattttcttagaaagatactagagaatattttccatccaaatgtctgaaaccaattcaggggaaatcatgggctgcagggatcaggagatctcatgtaggaggatggaagtgtcagggaggctgctggataccaggtctagaaaacaaatgctttagaatggaccaggtggatcatggaggtgtgagggaagacattaagggcaaagaaaagttgattgattatttgattatttttagtgtttagaaaattattagtaagagtttgaaacatttctgagcatttgcagtaattctaaattggcatatgaaaattagaattgaaatggacacacaagtccaagaatatacaaaaaagagacataattacagctgtcccacttgtggtcaatgtttatgaaataataatggtgtgaacatgagtattaatataataaaaatgtgatataaatacattggggaaactagagtgggggaagtgtgaatgtgtgtgcatgtttctgtttgtgggtgtgtgtctatttgttatggggtgatgatggagatataagtcctcatctttcttaccatgaggttttagaaattttcaaagataaattaaaaaataaaaagagagtcagtatttagaaatatgaatataaacttcagaagaaacttctagaatgtttcaacatagtcacctttgtggagtgtgaggatgagagagaatatcatttcaagtttcaaataaacatatgcacacaatacacaaatccatccatacatatagatctgttagtagaattaaagttttaaaacattatatgttattctgatacaacattaatttgatttttttctttcttcaagaacagtaatttcttgagtttataatgtactaaatatttatattttgaagtattttatcatttatatttgtactgattatcttgtatgctaatatgtaggtggttacagatttatcttaatacttagcttgtaggagagttggatgtatctataatgtagtaatttcttccctaagtctaggtgtactttcagtcctataagtttataatgatgttgggaccccttccttatgcttcttgtaacctgaattgctacaacaaatgtgccattttcctccttttccatcatttcttacttgtgtcttatcagctaaagtccaggaagagattgaatgtgtagttggcagaaaccggagcccctgtatgcaggacaggagtcacatgccctacacagatgctgtggtgcacgagatccagagatacattgacctcctccccaccaacctgccccatgcagtgacctgtgatgttaaattcaaaaactacctcatccccaaggtaagcttgtttctcctacactacatctccatgctcttcaagtccccaaattcatagtatagtcccaatcctctaacaacacatgatgagagaagtgtaaaattcatacgtggggcagctttctggactctgctgtttccattccagtttgggcctatgaaggtttataacaggtctcagtatctagcagtgtatgtcttccaaatttgttctgcttctttagtattttttttttgtggctattctcaggtgtttacatttccaagtaagtgttgaaagtatcattttgtcaatttcccaaaacactgtgctgggatttttatcatgatgacattaaatctttagatcaatttagaaataattgatgtcctgacaggttgaatctttcaattcatggatatgattatgctctttatttatttgggctttcttctattgtgtcagtaatgttttgtcttcagttcagtggctttctcatgtattacgttttttttctgaaatgatatttctatgtaattgtaagttgtgtatttaatatataatataaaatatatataatatgaaataaatatatataatattaaaaatatattttcaaaacagagtcttgctatgttgcacagattgatcttctgggctcaagcaatcctccacctcttcctcctgagtagctgggattagagatgtgtgccactgcacctggcttttaaataatatactttaaaaaaaatgccttttccatttctttgtttctggtacatggaaatataattgactttattattttgatgaccttacatcaagcaaatttacttggcattgctaattttttgtttgtaaatttatttgtaatttctatgtattctgtgttctcttttaatatttattttatttcttatttttcaattcttataactcagttttctctttattgttttatttcactggttaggatttccaggacagcgttgaataaatcatgatggtgggcatccttgtttcatatatgatgttcaggatgggtggagatttaacatctcaccagtgagaatgatgttttatgtatattttcataagtaaaaaatcagattagagaaggttgccttctacttttgatgactttttttggtcttgaatgtgtatacaatttgatcaaatggagtctctgcatcaatcgatatggccatatattttgtcctgtctatagatataatatatatattagttaaaatacacacaaatgtgcacacagagacatacacagctgggttttatttgctatgattttcagggtgtttgaacttatatttacaagagacattggtttgcaatttttcttcctcaaaattttcttgtcagatttctgatattgaggaaatgttggcttcgtaaaataaggaagataatgttctgtattgtggttgtttttataatcttttctcccttctctattctttttgtgctcacttagttctgtctttggagtgactcataaattttggttaagtgccagttatgatgtatgaaaaaatgcagaatgtcagatgaggttcatcttcttccagaaagggttcatccctcccatgctaggcagacagaattatgcaacaccttctaccttcattcagaattagatatcaacacagtcaaaaaaaattttttttcaattttttttttattatactttaagttctgggatacatgtgcagaatgtgcagttttgttacataggtatacacgtgccatggtggttcgctgcacccatcaacctgtcacctacattaggtatttctcctaatgttatccctcccctagccccaacatcccccacaggccctggtgtgtgatgttaccctccctgtgtccttattgttcaactcccacttataagtgagaacatgcggtgtttggttttctgatcttgtgatagtttgctgagaatgatggtttccagcttcatcaatgtccctgcaaaggacatgaagtcatcattttttatggttgcatagtattccatggtgtatatgtgtcatattttcttaatctagtctatcattgatggacatttgggttggttccaagtctttgctattgtgaatagtgccacaataaacatacgaaacacagtcaaaaattgactgtagccatcaaaaattgactgtaacctctctgagttcccccatgcctgcaagcctgagtaatttttgtctcagcatcttttccagtgccttctaacacatggtttctgtgtttattgagactttttagttgctattctgcaagctgctccattccacttgaagcgagtacatattgccattataaagaaataaaataatgaaaatttaactttgagaggaaaaaggattggagtttgataaggttgaaatcactattgccatcttatagggaagagggaattctgaatgtctgtattgtgccatatggaatccactagccacaggtacctattgagcaccggaagtgtaatgaatgcaactgaggaaatgaatttaaaattttatttacttttcattactttaaatttaaatacaaatagccatggatcattcatggctaccgtgctacagaacacatatctgattgtttaattttctgtaatacagggttagaaatatctcattctcaattatgtaatattaaaagcctgagtagttaaaaaccatttaaggtgggtgtaatttcatttggctaaacatttacttgcgtggagtgaatgtatttattttccttatttatcatactttgtataaatattaatgttttgctaaagaaaaggccaggtgtggagattcccatttgtaatcccagctctttgggaggccaaagtggaaggatcatttgcacccaggagctggaggccagcctgagcaacatagtgaaactctatctctacaaaaaataaaaaaattagctgggtgtagtggcatgtgcctgtagtcccagctacttgggaggctgaagtgggaggattgctggtgtccaagaggttgacgctgctgtgagctatggtcgtaccactgtactccagcctgggtgacagagcaaggccctgtctcaaaaaaaacaaaaaaaaaagaggaaagaaaagaaatatcatgtattcaattatatggtatctccccactctccacattattgggagtgttagaaaatctgtagcaactattatgtagcataatatctttctagaatgaatatatgtgtgtgtaggtatatagtatacatataatatatggaaatgtgcatacatctacattttaatctatacatttatctgcatttatctatcatctatctacctatgtaatctaatctgtcacatttaacacctaagtacttcagtatataattcccaaaaacaaggactttctcctacataataataataacattcacactcaaggaattattatcaatacattaatattatctaatatcttataactacattttcccagttatactaaaatatctcttatagcttttttttgatggacttcctgtagtccagtcaaggaacaagcttttaatttggttatcttgttttgttaatccttcttcatcacgaacagttttttttagtttgtttcactttaatacactgacagtttttaaaagtcctgtccccttgttatgtaaaatgttgctcagtctggttttgttagaatttttttttgacaattagattccagttatgtgtttttggcaagaaagttacataggtgatgttatatacgtgccattgcatcatatgtgcggtccacattttgtaagcctgtatctgctaggtctctccattgttggggttctgtttttcatatgcagttaataaaaagatggcatggtactttaagatcctgtgaatattactttcccaaataatttacccagtagttttaaagttaattgatgatccttgcccgaatctatggtcctacctgaatggctgcaaaaatgatgatttttctaaatttatccttccttctgtgttttttaggttggattcatctctgatgaagagttcccccacgtgttttaactaaaagaaacatatagcatttctgtgatcaacccctcaataaattttagtgtacttgttgatatcatctcagaagtcatttttaattagatcagacctccattttaaaaaaccctatgaacagattccaaattctcctcacttttttttttttaacaaaagttttattggagatagaaccaccatgtacacagggaaaagagcacaaaaattcaactgatacagaacaacaactgaaagtcacaattacccaatgtagtttgcaattacttttcagtttcttaaacagctcccctcaactttttttttttaacagtcttgctaatttttcagctgaaacagcatcaagttttccaaaaattaagagcctcgggaggggacccgctttcaagatactgaaggtgacatcaagagtctcctcctaacaggaccaactctatctaaaagttgcttacgagtaacttgaatcttgtgtaatagtctgcatctcacagaccatcatggatgagttagaacactgttgttgatggtccagtatgaagagagggcaaccaaatagctgtattcgcttgtcagctgagctcatataaagaagtcagtgaggagctgagaaaatataggcaatggctgctcaataagaattataagttccgaataccacatataggtagacaccagtgtgcaagttgatgcaactagaaagaaacagatgactttttaaaatacctggccacaggtctttgagaactcaagaaaataatcaacagtagacacaagagtcaaaaatcttctcaggttgaagattaggacatgggtaatcttcctaacagctccaacaggcaaggaaatatgctgtggcaaaaagcattaagtagttctgatttttaaaaaacaaaaacaaaattttctgcttctcctcccttcaaagcttcaaggaaatagaaacaaggaaacaaaacaaaaacaaaaaaaaccagtgatggtaaagagaagccttttgcttgaattatcaattcgaaaaacagtaattttgccattttgtatatataaacaatcttgggacattcttctgaaaactaggtgtccagtggctaagagaactcaatttcaagcacttctgaaaggaacaccagcatgacccagaatctcaaattcccaaacaggggctgcgtgggaaaaatgagggaggacttttgtatctagggttttagcaagttaaaatgaagatgacaggaaaggcttatttatcaacaaagagaagagttgggatgcttctaaaaaaactttggtagagaaaataggaatgctaaatcctaggaagcctgtaacaatctacaactggtccaagttgaagacaaaactgtccaaacaacatttaaatctaaagtatgttgaaaactagttgagaagtttttgctcctgtaacaatttacaaaacacgttcattttggtctcttttgcagttttcttattgtattcatttttaatataaagagttggatttttctcttctatgatgttcctctagtacaactgatcattaattttctattttagctatttttataagtacttgttaatcagcacagttaacttggggctaagtcatatatacacatcccatactcataaatgaaaatttttaggatgtgaatatacaagatattatgtaagcaactgtccccctacttgaaaacttgtttccaaataatgttttttaaaaacatccctttcagtgtaacagaacattacctagtaaaatatcaatagctatgacaattcatttctcttttcaagggaaatcacaaaacaggtgaacaaccaagtcaagggtggtttttctgtttgataaatacatccagaactctgtacagtaaataaagtttgcatgcagtttaagtatctttaaatgacattttaagtaaataaaccttttgcttcataattagtggtgtataagaaccctccccactttttaatagccacagggatctctttcccagttccaaagaggaattaatgaagaccaggtatgtttagaggcttctatttaaaaactgtcttctggaagtcctagccagagcaatcaggcaagaggaagaaagaaaacgtattcaaataggaaaagaataaatcgaaatatctctcttcactgatgatatgattctacacctagaaaactctgaagactcttccaaaagggcctctggaagggataaatgaccagtaaagtttcaggatacaaaataaatgcacaaaaatcaatagcatttttatatatcaataatgttcaagctgagagccaaatcaagaacgcaatcccatttacaatagccacaaaatattaaatccctaggaatacatctaaccaaggaagtgaaagatctctttaaggaaaactgcaaaacactactgaaagaaatcatagatgacaaaaacaaatggaaaagcattccattctcatggattggaagaatcaatactgttaaaatggccatactgggccaggtgcggtggctcatgcccataatcccagcactttgggaggccaaggccagcggatcacaaggtcatgagatcaagaacatcctggctaacatggtgaaaccccatctctactaaaaatacaaaaagttagccaggcaaggtggcaagtgcctgtagtcccagctacttgggaggctgaggcaggagaatggcgtgaacccggaaggtggagcttgcagtgagcagagatcacactattgtactccagcctgggtgacagagtgagactctgtctcaaaaaaaaaataaaataaaaaaataaaggccatactgcccaaagcaatctactgattcaatgctattcctatccgactaccagtgtctcttctaaaatttatatggaaacaaaaaagcctgaatagccaaaacaaacctaagcaaaaagaacaaagctggagtcgtcacgctaccagacttcaaactatgctataaggctacagtaaccaaaatagcgtagtactggtacaaaaacagacacacagaccaatggaacagaatagagaacccagaaataaagcagcatacctacagccatctaatcttaaacaatgctgacaaaaaacaggcaatgggaaaagactccctattcaataaatgatgctgggatggcaggctagccatatgcagaatgaaactggaccccatcctttcaccatatataaatatgcactcaagatggattaaagttttaaatgtaagacatcaaactataagaattgcaaaagaaatacctaggaaacaccatcctgggcattggccttgggaaagaattcatgactaagtcctcaaaagcaatcacaatgaaaaaaaattgatatgttacttaaaattgataatttagttacaaattaaactaaagagcttctgcataacaaaagtaactattaacaaagtaaacagacaacctacagaatgggaggaaatatttgcaaactatgcatctgacaaaggtctaatatcctataaggtaattaaacaattgaacaaacagaaaacaaataatgccattaaaaagtaaaatacatgaacagacactgctcaaaagacatacaagtggccaataaacatatgaaaaaatgtttcacatcactaaacatcagagaaatgcaaatcaaaaccaaaatgggataccatctcacatcagtcagaatggctatgattaagaagtcaaaaaacaatgcatgatggcaaggctgtggagaaaagggaacacttataggctcttggtgggaatgtaaattagtccagctactgtggaaagcagtttggaggtttctcaaagaacttaaaagagaactacaatttgatccagcaatcccattactggatatatttccaaaagaaaataaatcattctactaaaaagacatgtgaacttgtatattcattacaacactattcacaatggcaaaggattggaatcatcccaaatgcccatccacagtggactggataaagaaaaggtggtacaaatacaccaggaaaccctatgcagccataaaaaagaatgaaatcttgtcctttgtagcaacatagatgcagctggagtgaattaacgcaggaacagaaaaccaaatattgtacgttctcacaaggaggagttaaacatcagtactcatggacataaagatggcaacaataggcactggggactactagatgggggctgaaggggaggaagggttgaaaaactacctgttggatactgtgctctctactcgggtgatggaattatttgtaccctaaacctcagcatcacacaatatacccatgtaacagtcctgcaaacaacaacaaaaaaggtaatccatgtgtgaggtgtgtgaaaactgaagtgatgaaatacagcagcaagtggggatgtacaccagggtccaagcttgatgataaaccgggattcagaaggctgcccccgagtactcaaatgctcaggacttcaagtgcaattaattggaggggacttcagcaaagtcactgccacttgccttaaagtcatactgcttcttactaggtctgtctgggtgggaatgtaacttctttggacctcaattttcttatctattgataaaagagattggactaggtgatttccatcacttcttcccactctttgacttctttataacttagtttgtctgttttgctattttcagggcacgaccataataacatccctgacttctgtgctgcacaatgacaaagaattccccaacccagagatgtttgaccctggccactttctggataagagtggcaactttaagaaaagtgactacttcatgcctttctcagcaggtaatagatattcatttccatctgtccttcagggcacatgatacctttttgggatcagttgactcttacatgatgccacctctgaggtttggctgaattgctttgcagatcattagcaccattccctatgcccatgcgatttccctgctgatgaacatccccattattgggccaggttagtggggctttggggagttgatccagtttttcaaactgaaaaagctagaatgtaggttaatttaattctgcctctagatacatcactgagctacccaagagctcttcttaatgggtgaaacttatttagacatttctcatctgccatgagaaaagtatctaattccacaactttgaatatcttccctgtggtgtccctagctccctagactgagctctggagatacaagtatctgagagcagagaatgggctcttaagaggctcactcctgatttagagaagtagacaagtaaacagatcattgtaatctagtaggaggaaggctgccagaggggaaagcgcaggatgttggggagctcagtgggggaatctgcctgcttcctgctcattcataggccataccacttccaagaggaaggaaacttaagctgcctcattgcagcaggaaacaggacaagaagagaaggcaaggcacttttacagaggtaatggaccatagtagcaggacattttctgtagatctagggggtcagaacctaccaacaaatttcagggtcaggaaaaccctgggaatgtggaaggatagtctgcaataattccagagcaccttgatctccctccactcatgatcatacatcttggatattcaatctctacagctaaagtgtgtggtgagtctgtggacatagagttcccttcattttttcctctggcttttgatccctgctttggatctggcactgtatacactgagatgtcaagaactaaggccttcttttaaggatttcacgttttagcaagatagaaaagtaaatacacagataatagaattcccggtgatctatgctccagtggaagcatgaatatgatgaggaaacctagagagggtgagtttctattgactagggatcacagaaatcataaagaggaaatgacatggggcatagcttctgaaggaagcataggagtagagctttttaggcagatgtgacagcaagagataaagcttgaaactttgtggtgtgttggaaattgatgaagaatggatatgcctagagctgagagtggaggagatgaagaatggaaggagtgatatagaacatcagactgggaacagaatgtgaagagtcaggtcaagccatttggcctttatcccataggacagatgggtgttgtttaaagttgtaaaatgagagactgacatgtttagacatgtacttttgaaagtacactaggaaaaaaaatctttggctaaacattgtgccagaagtacaaaggggaacacactatatgagccttctcttttcagcccatcttccctgtgaatgcatttctagaaaaagactgatggaaacttgtagtgtcaaaagagcagttataacgtgggaacacttagtgaagtgcatggcatagagctgatactccataaatatttgttgagtgaagggtgcctagtaaaataagatattaagtagataggaagtgtattcatttttgtttttctgtgtatccagccatccttccagtcattctgccttcgatccatccatctatttaatcatttatcaaatagttactgcatactctttgtgactgttcatgacctaatgttcaaggaacaaatcccctatgtctcttattttcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgctgtcacctgcaattctcccttatcagggccattggcctctcccttctctctgtgagggatattttctctgacttgtcaatccacatcttcccattccctcaagatccaatgaacatccaacctccattaaagagagtttcttgggtcacttcctaaatatatctgctattctccatactctgtatcacttgtattgaccaccacatatgctaatacctatctactgctgagttgtcagtatgttatcactagaaaacaaagaaaaatgattaataaatgacaattcagagccatttattctctgcttgctctagataaaaatgattattatttactgggtcagttcttagatctctttcttttgagtaaaatgaaagtaagaaatgaaagaaaatagaatgtgaagaggctgtgctggccctcatagtgttaagcacaaaaagggagaaaggtaagagggtaggaaagctgttttagctaaatgccacctagagttattggaggtctgaatttggaaaaaaaaactatgtccaggagcagctgtaacctgtagggaaatactggaacaatcatccataagagggatgaacattaagtgtttgaattcatgctctgcttttgtgttactgtaaacacaagatcaagatttggataatctttttcctttgtgtttccaacttagatcatgtctaaatatatgctttcatatggctaatcatgtgttaatgactgttatttttctcttccaaacaagagcaaaatctccagaaatcctcaccaggctttattttttttctattttgcactgcatacttttattttactgaacataaatgcaatggtaattagatgctatgatcctgaaattattagccttatgtcaactctaaagcttaaacaagtgaacaaatcatacacatcaaattctagtcatcttttttccttccttctgtcttgaagtgtatgaaatgagaagtgacacattaaccttttcccagctcatctccaagagaaagtcctttatacttatcatgcatttgtaagataactcatgtgtatagttttataaacacacacgcacatatgtctgcataggtgtatatttacatataatatatacacatgtatatatgagattgatagtggttctttaatataatgagttcatattacacatattattatattatacaacttgctcttttttttaacttttattttaggaggtacacatgcaggtttgttatataggtaaactcatgtcacgggttttttgtacagattatgtcatcacccaggtactaagcctagtactcaatagtgatttttttttgctcctctccctcctcccaccctccaccctcatgctgtccctagtgtctgttgttcccttctttttactcatgagttctcatcaattagctcccacttataagcaagaacatgtggtatttagttttctgtttctgttagtttgctaatgataatggcctccagatccttcaattttcctgcaaaagacatgttttgtaataaacaatatgccaggaaaacttccaaggtagtagaaacctgacaagtcatttcattgggcagattacggaagaaaatatgaaatggctattaaaagtattaaaatagcttaaaaataaaaagtatacattaaagctacattacttgtagtattagcagtaaaacagacatttccttattgaagtaatagataatatagagcaactttttcaccaacactactatcccatgactgtgttgagcttaaagcagggagtgagcagtggttgtattagcaatgttgcccgaagttaccctccaggtggattaaagattctctaagttaagtgaaaatcataggcattaatagtgataagagtcttatgatatggagtctttttctagtgttgtgggaaatgctgtcaatagcatgaagccatgaagccatcaacttctcatcctggtttgcagtttgaatgtctctggttatgggcattgggaggtttggtaaattttctgtgtgctccacacatcaggaatgagactcatcccttaaaattaatctagtttcagattatagggtttcaggaacagatcagttcccagttttactaatttcatagaagaaaatgggattagagaaatctagaagaattcaggatctagtctagtctgtagatagataacaagaactagaaaacaatgcacaggtctacaatccagtaacagatgtaacttttctctacaaacatactttttctctctacattgatcacagagg

SEQ ID NO: 16353 - DNA, 44715 bp, Human
cgcctgggactcccaaagtgctggggattacaggcgtgagccacagcgcccggcctgagtctacagctttttaaaatctgaattcagttactttctatgtggaaaagaatgtacccagcagccacaaaagcaatttgcctcactatacatatagcaactgggtgtgtggaaaaaaccagcatttgtttttttccagcataaatagcaagaacaatctttcctgatagtgcaacttttttgcctaaaggttttggagttcttcaaagccatcgtggcatcaaagactactggaacgaacacacacacacacacacacacacacacacacacacacacacacacaccatcatggcatcaaagactacctaaaaacagcccccctccccagccatcatggaatcagactacttcaacacgcgcgcgcacacacatacacacccatgacatcaaagactacttaaacacgcacacgcacgtacacacaccccaagctatcgtggcatcaaagactacttcacgcgcgcgtgcacacacacacacacaccatggcatcaaagactacttacacacacgccccctagacaggtttttctttttcttttttgagacggagtctcgctttgtcgcccaggctggagtgcaatggcgcgatctcggctcactgcaacctccgcctccgggttcaagcgattctcctacctcagcctcctgagtagctggggattacaggcgcgcgccaccacgtccagctaattttttgtatttttagtaagagacggggtttcgccatgttggccaggctggtctcgtactactgacctcaggtgatccgcccgccttggcctcccaaagtgctgggattacaggcgtgagccaccaggcccggcctctagacaggtctttcaaaagtttcaattattaaccttcttagaaaggtcattaacctaacgggcaaagcaagactcaggttttgacgaatcaagactgatttgcttgtattttgcaatagctattgattataaataatacttccaggcacctttccaccccttggccatttctcgttctcctctactttgctccttctccccatccccgaggcagtaaagttcggggaggcccgggagcgcctgggccacgtgtgcgcccgcgcggctgcctagaggcgctgctgcagggaggcgggacagagtttcgcggctcgcacgtggccgcgagctcacggcctgggggtcagggagaccgtgaagggcccggatccctgttactcaccctcagctgtcgccattatcctaagtgggctgagggctgcgaccgcgccgggaagcgaggcagaactctagaaaagaggggtggtcagagagcttcgctgggcggggaaggaggcggggccgcgcgaccctgcgccactcttttcgagctccgctacagccgcctaacccggaggggtatgggcggagactgaaacgcggatatcggacgaaacaacgccccactggcttcccgccgcaggcgcagagacgcgaccccgcctccgggccgccccgcgctggcgcagtgcccggacaggcgaaaagtggcgcgcactggcggcccctccccactctgcggaagctcgcataccccggccccttctcggctgcgggagcgactcagaagttggagcgtaccaagtcttgacggcctgggggaagcatgcagggaagggcatatgaaggctaaatgctctgaaagagaaatgaggttaagtccgttactcccattacgctactgttgggtgctggaaaataacggagatttccacgtgcagcaaatacagctttccaggcagctcttaggggaaggctagctccaccctacagcatccgtgaccccgcccctcagccgcgggaccgcccctccgccctcgctcgttggtggactcggagggggaggagcagggctgagctggccacgccacctagggacagcgcgcgccgccgcagtagctggggccaccctcgggaaggaagagcctgtcgcgagcgcgagcttctgagctcgacgggccgagctggcagctggttggtgcttacaccttggccgcagcggcaggtccttccacgtgctttcggcggcgacatggagctggaggagttggggatccgagaggaatgtggcgtgttcgggtgcatcgcctcaggagagtggcccacgcagctggatgtaccgcatgtgatcactctgggactcgtggggctgcagcaccggtgagcaacagggtgggggtggcgggggcgtgcgtctccatctctcggagccgcttcccgcagtcggcgttctcatgagcgcccgagggcccgggaggaccgacctctccgacctaagccagtacctgcctgtggcgtcgaccgggttgcctaggcgtgcacgaggggcacctcgcttccatgaactttagcctgtcctgcccaccctcccagccacttatgccttttaggggctctctccctccccgccccccggtgtgtgcacccatccagaggctggccagcttgtaaaccgccggtttgcttggtctagctgggtcagggctcctccccgactgcaggcgggttctagtctcccggagcctgtggctgctcctgtaataggctagtgtggcgtggcggccagtccaggtccttcaacacctaaaggttttcgcgcggggcctccaaccaccacaagcttttgtttgcaagggcagagctattgagcagattatgggtttgaaagtagttatcgctatgggaacttgaggatgctagacttcagacccagggaaagatgactagttgatgttgagaatgactactggtagtagatctcacataaattaaatggaaataagccaaccatagggaacagtgcatctggaaaagattcattggtagacgtcttgcctaatgaatgaaaacgttggtaataacatgacaaaaattaactcccttcttcaaaagggggacaggggagtagtgtctctatgccaagatccatacacttgattttgaaaaattgggagatcctttcgagttaaaaaaaattactttgcttcggtgatctttccttttcttactacctgacttaactggaagttgatataaattattacactaggataagaaaaacaaacctgggtttgatattcttactgaaagtattacagtttccataaggcaatacagtggtaacaacttacactacagttaaggaacttggcaataacacgtaacagcaaaatgggtgcaacacgtataaacgcattccaaaagattagcttttcctccaccaaacttaaattagaagtattttttgctgttttcattgtcccaggtacttcaatttcagtttcacattttgtgtgttccttgtttactaaagagctgagaatgtgggaagcatcaaaaagaatatttttaacttgcgtagctccaatcttggataattgtgggttgaccataatagatttcttgttttttttaaaaaaagtttattgagaaaattagttacgtaatccaaggagaaagtaaactcttgattatgtggtagttgtgagcaacattagtttgtaacattcttagaaactatggccaggcgcggtggctcacgcctgtaatcccagcactttgggaggccgaggcgggcggatcacgaggttaagagatcgagaccatcctggccaacatggtgaaaccccatctctgctaaaaatacaattagctgggtgtggtgatgcgctcctgtagtcctagctactccggaggctgaggcaggagaatcgcttgaacccgggaggcttaggttccagagagcagagatcacgccactgcactccagcctgggcgacagagcgagactccgtctcaaaaaaaaaaaaacagttgttattttggatactctgtcatgggggtgagggagaatctagaggtctttagggttgcctggtggtctgtagaaaatatgtatgaactgtacttcactatatttactttttttgccaaagttattcaagaaattttcatccccctttctccttccctttaaatgtgtgcctgaagaaaaagaggcttttttttttttttaacttacatgttagcactggttggagttttagtacccagtttaggaaaatacttggtattcatggttataggttttttttttctttttttttttttttaatgaataccatttgattcctggttacatatatctgttttctatagttgcttttctgtgaaagaattgtaagattaaataataccagataagggcaataatgatgtgattatgtggttttgaggaacaaatgtattactgaaaaacaatttaacatttctcttgtgtaggcatagaatcattaaggtgcacaaagagggctggttctcacccataatcaattcaaaattttacatgagctaaagtgctcatcctttgggaggactgattctgcttggaagaacaatgacactcccttatgtcttggaaatacaattatctgctgctcgaaactgatagataagggccagaataaaactaagaactttttcttttagtttagttttatatatatatatataaaatacgtgtgtgtatatatatatgtatatatatatcgtactctgagaagtggtggtctgttgcagaaagctctgttttcactttctcaccctcattcactcactggttagttttaaaacaactgcaaaaaggtttgattgtgtttttttcctttttgatgaaggaatttatttcttatatattatcttcttgattttttttttttttttgagacagagtctcgctgtctcccaggctggggtggagttcagtggcgcagtctcccctcactgcaagctccgcctcccgggttcacgccattctcctgcctcagcctcccgagtagctgggactacaggcgccccccaccacgcccggctaattttttgtatttttagtagaaacggggtttcactgtgttagccaggatggtctcgatctcctgacctcgtgatctgcccgccttggcctcccttttttttttttttttttgagacagggtctcactctgtcacctaggctggagtggagtggtatgatctgggctcattgcaacctccgtttcccaagttcaagtgattctcgtacctgtctcccgagtagctgggattacaggcgcccgccaccacactcaggtaatttttgtatttttagcagagacggggtttcaccatgttgaccaggctggtcttgaactcctggcctcaagtgatccaccctcttcggtctcccaaagtgctgagattacaggcgtgagccaccatgcctggccaaccttatctttaagaagatggaatctagaaggtgagatttctatcacttttgttttgtatttggtccagttttttgtcttgggtataatctaatctgaaacatttagtcctggggttaacagaatacctggaaggtatattagccatttcatataaaaataaatagagtatcaattagttaagccagtcatgcactggatatttaacccagatgggttcatccagatgtactccccgtttttagtagttctggctgtcttcagatttattccgtagctctgctttctgtaggggaattttcacatgtcctcttagctgtaaactgtgcatgcatgtgtgtgggtatgttcatgcctgatttatataatcaccaaatgctgttttggtcctgaaaacatcatttcagtagtttgcagagttctgaacaaaccagacaccccttcttagaataaacattttcatctttaaaacacagtcacattttatggagactagaatggcctggacatatttgaagattccataaaaggaattagtaaatgtctgtagatttatgccatgaatcagctaattagcctttccttgattaggagataaccatgcccttccattcaatgaattatcacttctcctggttaggaattgaaccttacaatgacaaacattttcatacttctaaaaatttataagatttacctgatgaagttgggttttctgtctgcagaaacattctgtagaatcttttggttctgttattacgctttgaggaaactgatttgtaatgatctcaggagcacttttcttaagagatttagacactggttctgcaaacagagtacagaacattaccactggaaaggcacttgtgagaatgagagatgcactcagtcagacttatatggatctagttcccagttaatcttcatttagttttgtggagaacacaggatttgattgtcagagaacttactttgggctgccaaattaaggcagggaatatcttacttaattttgattttcatatttgactgaaaatgatcaaatatgtaacattcctatagtgtttaacttttatactcccataatctataacctttatctgagtcaagtaaattttggtttgagggagtgacttattttaagtgtccttgcaaattgttccagtctttgattttagttattttataattcagtgattcttcctttaaaataagtgttttcaatccttccatttataacttttttttttagaacttagctttttgcattagtctgaagcagaatttacctgcccccaaaagtctccaagtaccactgcttggtcattctggtcaatattgggaagagctccttaacatacaaactgaaatctagccccaggttttccagtaacatcagtttaatcttgggcaagtcttctaacttctgagtctgtttcctcatctgttggcctagacttatatattgtaaggtctaatgttcaaattcagtgggttcagaatgatactcttgtgcggttaacccttagcagtttaacctgaaaggagaaactgctaagggttaaccgcacaagagttttatctgacttgcatttatatccagacatagaaaaatacacttttcagttcacttgagataaaaggttataaggggaaaaggaattcttgctatttgctaatactttattcaaaatgtatttgttgagcagaagctcaacaaataggaataatgtacatctaagtatattactaaggcactgtggtagacactgggaatactttaccatacagggcagatgtggtccctgccctcgcagagaccttattggttcaggagcgtagacttctctatgcctcagtttcctcatctgtacattgggtttaataatagcacctaccttataggattgtgattgggactaaatatgttaatatatgtaaagtgcttagaacagtgcttggatatatgcatgccctatgaccctgccttccacttctgggtatgtattcaacagaaatgcatacatatgtccattgagagacatgcaatttttcaaaaaagccccaatctggaaacagctgaaatgtccaacagtgaaatagatttgaaaaagtaatgggatatacgtttatttattaagtaaatattgagatggggggtttcactatgttgcccagactggtcttgaactcctgagttcaagtgatcctcctgccttggcctccaaggcagtgctggaattatagacctgagccactgcacctggctgggatgtatatttttacaatggactattctacagtaataaaaaataacagactactgttgtgagtaaagtcatgggtgaatctcataaacaatgttgaatgaaagaaaagtacatatagtatgaatcccaaactaatctatggtgatagaagtgagaatagtgataatgtttatgggggcggaaggatgattaatgactgggaggcttttagggtgctagtaagttttatgtcctgaatggtggatttggtgtgtctactttgtaaaattttgttttactcttcaattttttgtgttaactaaaaaacaatctcataaattataaatctataaggcattaaagctggattattttagagatccagagagatgcagtgatttgctctgtgtttaggaattagggtcaaagagagactggagctcaggttttcttattagtcttatgtgcattttctttcttctacatgctatattgcattatattatcttttctgatgtctgtgatgggtcattttggaattacagctcccattattaggttggcttctgagtttgactttcagacttattaaaatgttatattgattattgactacctttgaagaactgtggatttttttctttttacatctgataacaataattgcaacaatcactgtgaagtacaatttaaaggaccatgataaccaaacagttacctaactccgggcaagttttcatttactttcagtgttactctcactcttttttctttcttcttcttttaaaatataaactctagctcctgcaggaactttcactcagtgagctatgaaataaattatttctcagcattctctgctctaatacagttcataaacaatatatttagtctaatttatcaaggacaggaataaatatctctgttatcaggaaaaagcaacaagttgtttccactgtgtggaagaacttgttatttctctggctcttaccatcttcatgtgcttttctcttgaagctcaaagttccttggcttttgttgtgaccttcaaataattcttaaataaaaacacaggaaaagaatcattatgtgacatcatttgaaacacattaatggttttcaagcattcaggtatactaaaataagaaaacttaagcagatggacaaataaagaatgagttaagaattaggaatattttggtacaaggtttagaaaaaagttgaaactcttggcttaaattaggtacctatttttaatgatttttaagggtcatttgagcatacaatagtgtaaggatttcatttttaaagagtttttctcttgctaaatgaaaatgcaaagaggaatgtctagaattttttttgttaatgtcaattccaaagttaccatgtctccatttggcagttctgagagttggttttcttaggatgcagtcaacttcttcataaaatctcatttttcttggagggttgccattttttctttgtaaaatgctatattcatattttacatttttatatttcatatgacattgtttccggtctctgtctatcccaaactgcattaattaatcttctggcaatttcctcaaatattttcttgtttcttgtggccccttcaagcattcgcttaattttttcatcagaccatatcaatgctctgacctcactgtcacaccagtattttccggcctctgtgttactcactgttataatctgtaaatgacttttagcatcttctaaaggattacctacaaatcaacatgatttataattattcaaacatagataaatcttgtatttgattatcattcacttaaagcaactgtgatggcataaagtaccaagaatacaataataacttcaatatgagtcaaaagaaattttgtgtccatattcaaacagtatattctaaaaattataagacagactgttctcattattagtgagaaaatttagctgcttttcatcataggtgatcttcactggatatttgtgaatatggaaagtcccagtgtttactaaatttcttttagtgagaagtgggcatagacattttccttctttctctactgtattctctaccaactcaggtataaggaagcattttaggtaatacacaatagagatcttctctgttagacttcatatatcaaaatgacatttaaaatttaccaatttagaccctgcagtggacccagtattattttggggtgatgatgtgcagcagggggtgacagggggaaggcatactccacaatgctttctaacagtgagttcctctcatcttaaattctcctaggttttaattctgaataatttttcagccttatgaatttttttttttttttttttaagagacagggtctcactatgttgccgaggctggcgtggacctcctgagctcaagcgatcctcctgcctcagcctcccaagtagctggcactacaggtgcctaccaccatgcctagtgcctcatggaaatttgaaaatgtgtttaaatcactcttgttggatataatttttaaaagatggtgatagaaatgtaaaatggtgaagtcatggtggaaaacaggtagttcctcagaaactttcagcatatgccatatgaccaagcaattccactcctacatataaacccagaagaactgaaaacatgttcacataaaaacatatacatgctgtggaaaaacagtactgcaggtcctaaaaaaattaaacacaaattaccatatgatcaacaatttcgcttctgggtatatacccaaaagaattgaaagcagggactcaagcagatatttatacatccacattcatagcagagttattgataatagccgaaaggcagaaacaacccagataaccatcgatggatgaataaacaaaatggtgtatccatacaatggaatattaaaatgaaggaaattctgataaatgctacaacatggaggagccctaaagatactataagtgaaataagccaggcacaaatggacgaatattgtatgattccacttatatgaggtacctagaatagtcaaattcacaaagatggaaaggagaatagtggtcaccacaggctaaggcgagttgggatggaggagttattgtttaatggctacagaagtttcagtttggaatgatgaaaaagctctggagatggagagtggtgatgtttgcacaacaacgtgaacgtacttatgggtataatggtaaatattttatgtatattttaccaaaatgggaaaaaaattgtaccagaatgttcatagcaacagtattcataggagccagaaaatggcagtgacccaaatgtctgtcagttgataagtgggaaaacaaaatatggtatatctgtaaattggaatattattcagccataaaaaggaatgaaatactgatatatgctacaacgtggatgaaccgtgaaacaaaagaagccagacacaaaaatgtatattggagggtaccactcatgtccagaataggcaaattcttagaaacagaaagttggttagtggttgtcaggggttacagaggtgtggtcaagcagttaaactactgatggatatggggtttctttcttttttttttttgagacagagtcttgctcagtcgcccaggctggagtgcagtggtgtgaccacggctcactgcaacctccgcctcctgggttcaagtgattctcctgcctcagcctcccgagtagctgagaccacaggtgcgcggccaccacgcccagctaatttttgtatttttagtagagatggggtttcaccatgttggccaggatggtcttgatctcttgacctcgtgttctgcctgccttggcctcccacagtgttgggattacaggcattagccaccgtgcctggcagatacgggatttctttgtggggtgatcaaaatgttctaaaatgggatactggtgattattatataactgtggatatactaaaaaccacagttatacgctttagttgggtgaatttgattgtatgtaaatcacatctcagaaaagttgctgaggtttgagaatagaaaagtaaagacaagtcaagtgtagaggttaatgcagtgatgtctgtgggaagttataaaggaactaaggaaacatgaactgcattgtacggagcttccaaatcttcctctaagccagagtttttatgatgtgattgattaagtcattggctgcaagatggaactcaacctccagccccactctccttcatggaggtcacactggcacaaagctccaaccctcatcacatggtcggtctttttcggtgactaccccctatcctgaagctatctgggaacccacctagagtagcctcattaacacaacaaagatgcctctgtctctggaagttccaaaggttgttgatgctttgtgccaggaacaggagaccaaaactagatatattctttattatgccacagcttcttaaaagtttattaaaatattaccaacagtacaaattagaaaaatcatgacttcataataaacaagttgcctgtatttaagattagcagcatacctatgtctgagctttcttttttcacatttgtaagtcttcggttttctgaagttttagtaataagttcttctctatctggatgtactattggattaaaatgaaaagttctcagtattgtgtttcatatgactaaagtgcattaatttatgtaataattttactgctaagattatacaaattataatgcatgtaaaatatacaaaagtgtttaaatattccaggtttaaggaaaattacttccaatttctttcttttggaagagataaatgaattagaagaaaacataattcttagcgtaccctttgagatggtaacagtagattccttaatgccccctgctggccatctcattgtgaactttttgaattttggaaatatgttttgctacaaccaaaagaaaaatgggcatttctagggttattcttagatgaacattgaggtatttcacttgtgatttttaggctgaagatcagcgtgacctcctctaataggatatattttactaccatgaaacttctatgcttatttaagtatgcttgactccacccctctgacctaaaataggtttaactgtgactgtcctataccagaaagcagtggcttgcgggaatacatagataataaggcattccagctcatataaatggcagctgatattggagcggaattaagtcaattttgtttctcctactcagaagagacaggtaggtgataagattgtcaaacacaaattttctcttttggcagagtcctttctcctttgataacttcttgattccttttatcctctctcgcttatgcttcagaccagggagaaaaataaaatatgttttagatccaaagatctagtttattcaattttcatgggccacttctttttacttaacataataggaatagcctgagcagtctatgattcttctccgtgattgatttccttcatattccattagtcattaatttttaagtgataatctatcggcattagcaaatttttcttccctgaatggaatcaaattgaaacttctgtgtgaatcagtcctctgctggtctgagcatgataacctagctacggtttccagtgctggctatgcttgagaaccgtctaaaaatacgggtgcctgaactgactccaacctgctagatcaaaatcttcagaagttccaaattgggaaccactctagatactcagaatccaaggggtctacagctgtagctggattttcatttgaagtaaagaaaagcttatggcttatagcatacatttaagataggaaagagaatacttttgggggactggttttttggccagatatcaaagttaacaatatggagctattattaataatagcaactccaatttcaaaaattcatcagtgaaatacaaaaaataaaaatgaagtgacctctgtttttacatgtaaatacccatcactttgttgttgttttaaagaaagactatttcatgtgaatttttttccctgaagataaataatccatatttttatacctcaatactacgttctattacattcttcctaagagcggagtggcaatttgtgaatcagtaggtatatattgcaggtgtacctaaaatccttgcctgtttaagtttttttcttacgtatttagctgctgagatccttgtgggtttatatctttgctttgaattttcatgtgacagtttaaaataatataatctctaggatgactatgcatttgtcctgtttcacattttctaaatatattccaaatatttcatatttggcatgcaaacatgccaaacaaaaaaaaaaacttgtacttttgacttaatctttttcttctacatgtaaaaaattatcttgaggttgtacttaagtaagttttccagaggactaacaagctaaaatcttctgaatactaaagctcttaactttttagatggaaatcttttttccttattaaacaatgcagtaatctgattttcttattttttaaaattttattttttatttttagagatgggttcttgctgtgttgcccaggctggattcaaactcctgggcttaagtcatgcttcaatcttagcatcccaagaagctgggattataggcatgtgccaactgcacctggcataatttgatttttaactcttaatgacaaaggccatagctgtgatgcctatggaaacctaagaatctgtcctgtctgataaaccagagaaataagtttgccaggagtataggaaatttgattaactagtttgttaaattaacattgagctttacactttgtgaagttatatgaagctttggactgacagactaggtacaaggtctttttaacagatatacttcagcttgggggcttggtgatctcctcctccccagttttggtttgtgtagaagaggcaaactatcaggtagcaagcacaaaatctcacctccaaacccttagtgccctataccagagggtaatgattctcaaacttgcttgcatcattataacctggaagacttgttaaaacagattgctaggccccaacaccagagtttctgattctggatggggcccaagaatttgcattttgagtaagttctcagttaatgctgatgctgctacacttggagaaaaacagcgatggggaacattgcttccattaattatttccacctttcatttatgtgttttgagttatgatccaacagtacttcatataatgttataacataatttcttaggtatggtagcgtctattaatatatagatataaaatctaaaacccattatgagggcaccactctcatgacctcatctaaagctagttatcattcaaaggccctgtctccaaatacatcacattgggggttaaggcttcaatatatgaatattggtgggaggaacacagttcaggccatagcagtgtcttataatagcattttatgtatatactttgtacacacacacacacacacacacacacacgtacaaaaaaaaaaaaccagaatattattttatgtgtgtcaagaccttgttttttatctgtatctcctatgtcttctgacttattactgactgaatcatcttcagctacatctccagcaatgactgtatgaacataaggggatatatattggctttttaaatttacttcaggatcgtgttttatttatttagattatttatttgtttttgaggcagagtctcactctgttgctcaggctgtggttcagtggtacgattttggcttactgcaacctctgcctcccaggttccaaggattctcattcctcagcctcccgagtagctgggattacaggcatgtgccaccacacctagctaattttttgtgtattttttagtagagatggggtttcaccatgttggccaggctggtctcaaactcctgcctcaagtgatccacccaccttggcttcccaaagtgctgggattagaggcatgagccacaacgcctggcccagaattgtgttttaaactctaatgcagtattttcctttttaaagggaccctaatattaaatatgattagttagattccctacccttaagcatctttttgtcactatagatattgggtatgtatctgagtctctaactaagtcttctgacataactaatggaatcatctttagctgcatctccagcaatgactgtatgaagatatcatgccactgctgttgggctgctttatctgtagtcatctaactgggggagatgtatagttctctagcataccagtttctttcttgtccaccagcgaaatattttgagatttctcaccaacatttccagtcttaactgtctgtggttcccctctcttccctagacgcagactgtcttacaattgggactcatcatttaagccagataataaaatccggagacactgtggttagtagaggtctttaagaccatcttgtccacaccccccaattttggagttaggtctacagcagcggtctccaaccttttggcaccagggactggtttcacggaagacaatttttccatggaccagggggtgagggggccatggttttgggaggattcaagtgcattacatttattgtgcactttatttctgttattattacgttgtaatatataatgaaataattaaacaactcaccataatctagaatcagtgggagcccggagcttgttttcctgcaactacatggtcccatctgggagtgatgggagacaatgacagatcatcaggcattagattctcataaggagcacacaacctagatcccttgcctgcacagttcacaacagtcttcgtgctccagtgttctaatctaatgtgagaatctaatgttgccgttgatctgacaggagtcgcggagctcaggtcataatgtgcatgatggggagtgtctgtaaatacagatgaagcttggctcgcccaccactcacctcctgctgtgcaacccagttcgtaacaggccacggaccagtaagggtccaggtgttggggacccctggtctagagaagacacttggttacttcaagcttccacagagccttacaactttgatttcctgaatcctggtctagaactcattcagtttatttcatgctatcatgtcttagtgtgtatgtactgtatctcaatcctttggtttaaatatactttaaagacatttatgatgggtctcagagaaatgtactacttctaagaaagtctcatgtattttatatttttctaagttcttcaatgccctttttctattttactcaattttaccacaattagtatgaaaatttactttaacttctgccatctggggttgcatatttgctttattaaaattgatctattttaaactttattctgggaatccagttttatttcctcctttttgtataactgtactgtttctattctggggaagatcaaatgtatactaaatctgtttcataataaattcagctagcttgtcaaatagcatgtaatgaaacctatttaacttacatatataatattcctcttatggtactgaacattctcaatacaggttgagcatccctaatatgaaatctgaaatgctacaaaatttgaaactttttgagcaccaacatgatgctacatgtggaaaattatacacttgacctcatgtgatgggtatagtcaaaactttgtttcatgcacaaaattattaagaatattgcataaaattagctttaagctatatatatgaaacacatatgaatttcatgtttggacttggctcccctttctaagatacctcactatgtatatgcaaatactctaaaatctgaaaaagtatctaaatctgaaacacttctgatcccaggcattttggaaaagggatccttgaacctgtgtgatgtaacatgatgttaagattatttttcttcaccttcctacctgtctggtcctctcccatttttacgttggcacattctgtgacatgttctccatcttgggattcctggtctcgtgatttttctgttttattgggtcccagaatagcatccaactcagtaaaaaatttcatactcttagtcatgcctagatcttgagctgttcttacgatcttgtattcatgttttaggtttttgtattttgttctgcactgtttccagtctctgtctattccaaatttctgaagcttggctgcaatttgttgaaatatcctcttatttctcactgttccctctagttgtcgttgtatgcttttatcagaccagatgtctattagagccctgacttctggcacagtccagtgctttcctccttcatttgctacagttgggataaaagttgtattattagagggttccaatactgacgtagagatacctgcattaggtagagaggtaaaagatatatgcattatatacatcagacaaggtaaataattggatgcaacattattaaagaaagcagtttcctccataggagatggagtaacaaatcatagcttagcttttctcttaaacagtggggaaacaaaatacagaacctaaatctgtccattattatgccggttactggctttaataaagttgtgtttttttagtcatattttgatcatctttcctgtataccttttttttctcttccataccactcctttagtatgtagggtgtatgtcagtgtatagtggaagttcaatatataaatgtgtagcatttactatagaaaacagtaattacttaagaaaatggctcattgtagataatttgttttgaaataggataggtacaaacaatttaactcctttcttttttctttatcttacgatttcctttggctatatatcagtctactgggaagcatttaaaaaccaccactctggtacctgcctcatccctcatccccagactgtgaatctaatgtgtagtcagggttgagaactgaggctactcatgagctgagggcttggaagagtcacacagaacaatcagtgcttacgccttgcgaaaattacagaaagactaaagccattttaaatgaagtattttcttttaatggtagggaaatgtgtcagaaatttcataatgccttgttcctaggcagtatgtctccacttagttataaatcctttaatatgccatggtgtgtattaggtctctagaacagttttatacttcatttacattactgacagtacttgactttatattggttattttgacaaccaatcttgtgtttttctcagatttcattttcataaaagaagtaggttcattttctgaattataaacttacaagcacattaactttggtctttgtgttttttttgagacagggtttcaaattggatgtaatattattaaagaaaggaatttttggctgggcatggtggctcaggcctgtaatcccagtactttggggtgccaaggcaggtggattgcctgagctcaggagttggagaccagcctcccaacagggcaaaacctgtatctacaaaaaaatgcaaaaattagccaggcttggtggcatgtgcctgtggtctcaggtatttgggaggctgaggtgggaggattgcttgagtcggggaggtggaggttgcaatgggctgagaatacaccactgcactccagcttgggcaaaagagtgagaccctgtctcaaaataagataaaataaaataaaataagttttttaaaaaagaaagtaattttctttcaccaagctagagtgtagtggagagaccactgctcattgcagcctgaacctcccaggttcaagtgaacctccagagtagctgggaccacaggcacacgctaccatgcatgacattaacattttgtttgcattaaaaataatcttcagccaggtgcggtggctcacgcctgtaatcccagcactttgggtggccaaggtaggaggatcacgaggtcaggagatcaagaccatcctggccaacatggtgaaaccctgtatttactgaaaatacaaaaattagttgggtgtgtggtgcacacctgtaatcccagctactcaggaggctgaggcaggagaatcgcttgaacctgggaggcaggattgcagtgagccgagattgcaccactgcactctagcctggcaacagagcaatactctgtctcaaaaaaaaaaaaaaaacaaaaaaccaaatcttcaaattataccgaagattaatcataatttattttgtttctttttcttttcgtagactctgttgcacaggctggagtgtgtagcacagtcatggctcactgcagccttgaacccctgggctcaagtgagccttcctgcctcagcctcacaagtagctgggactacaggcatgagccactgactgcacctggactatttttaataatttttttaggcatggggtctcactgtgttgcccaggctagtctcgaactcctggtctcaagtgatcccgcaccttggcctcccaaaatactggggttacaggtgtgagtcactgtgcctggccataatttaaaattaaatattacaattaatggttcagtaataattgagtttaggttttggcccctatcatacaaatgatattacaattaataacttttgtcaggttcatgagttttaagtcattaaaaaaactttatagcatttgtttgagatattttatggtgtatttaatgtctttgctttgaaatgcttttcagaattttttttcttatttaggttacaaatatttaatgtctttgctttgtaatgctttttcagaattttttttcttatttgggttacaaataagtttttctattatgtaagttagaagtaaggtttttgcttctagcttcaataagaaattagaagcggccgggtgcagtggctcacgcctgtaatcccagcaatttgggaggccgaggcgggtggatcaccagaggtcgagagttctagatcagcctggctaacatggtgaaaccctgtctctactaaatatacaaaattagctgggcgtgatggtgcgctcctgtaatcccagctagtcaggaggctgaggcaggagaattgcttgaaccccggaggcagaggttacagtgagctgggatcatgacactgcactccagcctgggcaacagagtgagactagaaaagaaaagaaaaatagaagcaaagaaggatttacactgaatttaattcattgggtgattcaaattatccttgacctggttgtggctctgatgtttactttcagatgtaaaattctgtttgtcttaattccttgcctcaacactaaagtgatcatgttcattactatgagtaagtttagccatcagatttcttataatatttaaagagtaaagttcggaaattagagaaccaatatttctaggaaacttaaatttcgtaaggaaatcatttgctttagaaataatttttttcagtgtgggttggcaaaaagggaaacataaatcaattctgagtgtttcttccaggaaaaattgtcaattttctcagattaggaaccagtctttccgtttgaaattagatcagtttcattctgtcccatccattatactatacctagttccattggtctgacatgagaaaccagaagtaaaggatttcctgagacatcttccttatctactgatgcaattgacattttacctgtaaatataacagaattccttttagaaacaacatgactgataattctaatagctttagctaaatgtggtcatattcttgaaaacagatttgtgatagacattttgtaataaagttgtataatatagtttaaatatttgtatatttaaagagaaatctaattttttccatcccattgacatggtccattttgaagttctgctagaattgtttgataattgtttaagtttttagaaatggttgtagttagttttcaagttaaattactttttttttttttgagacagagtcttactctgtcgcccaggctggagtgcagtggcgtgatctcggctcactgcaacctccgcctcccgggttcaagcaattctcctgcctcagccttatgagtagctgggattacaggcatctgccaccacgcccggctaatttttggatttttagtagacacgaggtttcaccatgttggccaggctggtctcgagctcctaacctcaggtgatcctcggcctcccaaagtgctgggattacaggtgtgagccactgtgcccagccttacaatttttaaatgtggtgttttatttataattgtatcttgggtgctctaacagagtaggcatttgctaaataataccagtaatgtaaaagagtaggtcctgcaatgagatagataattagaaaatgctgtttttttggcatgtatgatcaaatagcttagagtttttaagtatcttatataatttattgattgatacatattaaagtttccagaagttaaattatgtttaaatggactaaggaatatgtcatttaaaagaaacatgccaaccataaaaattgaattcctcctttgatttccttgttttatggtttggatgcttttatataggctttcataaaatgaggcataggctactttttaaagtgatcaaatgaggaggatgaagtacatcttagaaaggaatgcagtttacatgatttttaactcaattgacacatgaagatgaattataattacatgaaattgcagactaattgggaggcggataagtatcttttgattgctctttgtaatgtctcaattaaaaatttactcatctcattaatcatttcattgccaaatgtttttccacttctattttattgagtaacaaaagtagcattgtattttacattaatatatcaacttttaggtgtgattttaatggcataaatattcattttaaatcatgattcaccattatgtttacaggcattcccattgaagaaaaagaaaagatatgctctttatcatcttaaaaactctattagggtttctatgttaaaataggaaaacaaatgaaaaataaacataagtacaaaagcacatcactgctttcagatggcacagttgtatttttataaactctcaaggtaaaaattgtcaaaaattttaaatcaggttttataattgctttaggctaaaatgttgtcgaggaatgttttagatttggttgaaaacagggaaaataaaaatctggagttatgtaagaattacctttagagaaacagggcccaggttatttaacacctgagcttgagtatgagagcagtaaataaaggcagggtttctattctattacctggtttagagtccagatttacgtccatagaaaagagtctggaccaaacatacagatggtagtgaaacagaaaagctctctctccaacctcttcagataattttttcttaagttgctcattccacagcatgaatcctaaaactgtaggcagaggctctggagattttaaagtgaaagtcttaaatcattacttgcgatacatttgtataaaataagaggagtgaaatagaggggaaattgaccactgaaggaatgtggtttggcagccataggccaaaggaattctgaggctgaggatgatgagatttagcagaagatgaagcctcttagagttggtcaaaagtgtatttgggtcttttgccatggctctggtcctggctacttgctgcctaacaagtggcctatccttaccacttgcatgaggttgatcccaacagtggaaaaggcactttcgttttcttcccttcttccgtgtatcacacaccaataaaaattctgctggttccgccataggaaaaaccagaaaacattacataatgaatcaaacctggtgcaaggagggcttcctaagccctagggagaaaactttgattaccttaaaaatttttggattctgcagatcaaataaatcataaggcaagaaaatcatgcaaatttctaagaccccaattgacatgaatggtcagtttgtaaaattgtatagaaaagtgttctaccttactggtaattaaacaaatgcaaattaaaagttaccaatttgtatatcattataggccattgtttcttaaattagcctaagtcgttaattatttatttaatttatttattttgagatagagttttactcttgtcgcccaggctggagtgcagtggtgtgatcttggctcactgcaacttttgcttcctgggttcaagcgattctcctgtctcagcctcccaagtagctgggattacaggtgcccaccaccaagcccagcaaattttttgtatttttagtagagacggggtttcaccatgttggtcaggctggtcttgaactcctgacctcaggtgatccacctgcctcaacctcccaaagtgctgggattacaggcatgagccaccatgcctggcctaaatcattatttacttatcaaatttggaaagtcccttcttcccatcaatactccataattttgcatgacagtgattctacagaagggacgctatcatggctagtgaagtacagttattttggaaagcagttgttttagaaataatgtttcaaagtaatggccagacatggtgcctcaggcctgtaatgccagcactttgggaggccaaggtgggcagatcacttgaggacaggacttcgagaccagcctggtcaacatgatgaaaccctgtctctcctaaaaatacaaaaactagctgggcatggtggcgttgcgcctctaatcccagctcaggaggctgaggcaggagaatcgcttgaacctgggaagcagaggttgtgagctgagattgcaccactgcactccagcctgggtgacagagtgagactctgtcttaaaacaaaacaaaacaaaaccaaaaaccaaaaacaagacaaaaacaacaacaacaaaaaaccaaagtaattatatcctcctgaatcagtactttgtgtcttaaagtaataatactaaaaatggacaaaaggtattaattgcagtatcatttgcatgggggtggaagacccacactcagttaaatattatggaaccattaattgtaatatttaattttagaccatgattaatcttgggtataatttaaagattatttttaatgcaaccaaaatgttaatgtgcttataattttataatttaaaaatgtaaagaacaactagtggtattgtggaaagtatatgggaagagggtgaaaactagggagcccggtaaagaggttacattaatattccatatgagacatgatgaagttctggttagtcataatgagaatagagcagagagaaaattttatgcagtatgtcagcagattttttaaagacttagtgactgaccaaaaatcaaggatatctcaaatgtttctgtataagtgattggaaatatagtgatgctaaggtggaagcaatttgtaggaggatcaaattcaggctagatgtggtggatcgtgcctcacttcgggaagccgaagcaggagaatctcttgaacccaggagttcaagaccagccagggcaacatggtgggaaacccatcccacaaaaaattagccgggcatggtggctcacaccccatagtcccagctattcaggaggctgagttgggaggatcatttgagtcctggaagttgaggcagcaatgagccaagatcacaccactgcacttcagcttgggtgacaggagtgaaaccctctctctaaaaaaaaaaaaaaaggtgatgggagaatagagagtttgattttggaattgggagtttgaggtaactaaacgtgcatagttatgttgtaaggatagtccctctgtttatgagtgaaaacgaaggagtttggagccaagggagtacctgaaagcgctgaagatccctttaagaagtagagatattggcacccacatcttcatcagaccaactcctggttaaaatcggggactttcagaagctaagtgatttacttatttattaatcaatatttaaagcacttaaataatgaagagtcgaaggtgtttaattgaataaaataatgcgattgctgtttaatatggtaataactgcaaagctttctcagaatttggtgtcatctcagaaatggaaagaatgtaggcagggtggattcttcttttaatgaaatgatttgttactgagctgtaaacatgaaaaatagctaacttaagttaaccagttgtaatctttgtcctcttaaccccattcacatttggtacttttattatactatttactgttttctctcaggtgttaaatttatttgcagttctgtcctttttgaggtttcgcattactaaacgcatataacttagtgctttgcccatggtacacacagatagtgggtattacagatttttgaataattctgctcttgaaatagcatctataagatttagactatggtagacatctcattactgtcattgatttccctccctttgcctactaatgcttccacagacaatgagtagattctatgtaaatagtgttgggtttaacaacacagcacgtcaagaaacccctgtaaatcacttagtctcagatcatttcatgtactaaatcttcattatacttcattgttaaaatggagctgttcttcttcattgttaaaatggagctgttcttgtaaacaagtaatgaaatagtgtagaacagttattttaaatgtgcttttatttataaatttaggaaaacgcaaattaaataaaggagaaagttcttgtttggagctgtggaaaaacatcagttgagcaatgtttttgatatttttccccttatttaccactcttataaaattaaaacttaaactatttttagaactcaatccatatttcaaaaacatatcacatgcagttggcactagcagtcagtgccattgtaatgtgctttttctgtattttacagatttttttaaagtggtaatatttaacctctttttaaaaaaattcttaaccttgtgcaaaatagcataataaattggttatttttccacagtcttgatatttcagtctatatttatcatatggccacagaagtcctgaacttttacagttcataaaactgtaaaacaaaagaaaaacaagagtacttttctttttttttttttttttttttttttttaccttcagtggtctctggggctgtacttgggctgagcgtttccaggtacctgccatttgcatcttcctctgtaaattgtgtggcaggttcatactgcaggattacatccaaatcatggaagaacttcatagttttagagctgtctccagagttatgggcatatttaactgttctatattcatatttgagatttttgtacttagcccagcactgtttccagtctctgtatactcctaatgattgcagccttttagcaatgtaaataaatattcctttatttcttagtgttccataaagttgttttcgtatatttttttctgcccagagacttagcaaagctttaacctcctcctcagtccagtgctttcctgctccactctccatgttgaaagtgacctggaaatgattcactatttccagccaaggttttgtttcctaggaaaccagatggctggttgtcaataagctccgaagagctgaaaggatgtagtttaactggttcaagctgcctgagggagtaacttgagaaactgccaaataagcaggctttgtgattaaagaagcctggatctaaatgattcttaactatatcatttcagcctgaaggaaaaacttcccttgagacaaaagggaaagaaaaccgttttttgtgtatttcttttcttacataatttactgttttaccaaatgattgttgatttttaaaaattgttttgaaaatggttggcagaggctttttccaagaggtctatagccaatgttaataatatatttcctctgacatgaatcacctagtcctctaacattggttaacttacagaccccacagcatttcactaaataaaagaaatcataagtcaatttatttagtcccatatggtatatagtattatgcatatctattttcagtatttaatgcatttaataaaatcatttcttgaggctgctgtgagctgtgatcatgccaagtttttttagagttttacttggcaacatatttaatgttgtcatttttctcgttaataaaacactgcaacaattgcaatatataattttgaaaaaggttcctttttaccaaataaatcaatgtattaacagctactaaagtctacaggcacatatggaagaggtttactttttgtttctatcctgatatatattctttggaacaaaaattggtcaataaacatctactatttatagcacttgttcagaactattaaaaatggcaaagcagttggaacctttatgagagtttatactgcacagtggtatggatgctcttagtctttactatgtcttgccctaccttcagtctagattttggcttttttctctgtatcaccacttaatcaacactaatgcaggaaatgagacacagacatgggaaagggtgcctggtcagcagagggttttcagaaacaaaatttttttttctaatagcaaaagtgctatttattggagaacatttggaaaatgcagaaaggcataaaaaatggttaccaactatgcattttgcctctattatatttggagattttaatttacatctacatactcatcctgttgaaaccctatttaggggttataaagagtagaggttagaagcataaattctgcagttggattgtctgcattggaatcctggctaccacctgctgtctgtgtgacaatgggaaagtaacttcctttctattgctttagtgtgtttatctgtaaaatgggcatggtaatcatagtacctacttcataggattgttgtgaaaaccaaattatatcacgcatgctatcgacctaaataattaaaaggatcagaatctaatttagagagagtttattcaagcaccaagtttgaggatgtctcacccagaaacaccaactccaaggaatggagtcagcattgcaaagtaggaaagttaaggtttcatttctataggcagacagaggagtttttagcagaatcacaacattttttatacaaggttagcgcgcccagttacagcagtttgattgttataggtggtggttcttctggggaagggtacatttaacatttttttacagaggatgttaatgggttttctttcatttggtctagcaaagcaggacaacaaaacaaaagctaactttttttttttttttttgaaacggagtctcgctctgtcgcccaggccggagtgcagtggcgcgatctcagctcactgcaagctccgcctcctgggttcacgccgttctcctgcctcagcctccggagtagctgggacgacaggcgcccgccaccacgcccggctcattttttgtatttttagtagagacggggtttcaccgtgttagccaggatggtctcgatctcctgacctcgtggtccacccgcctccacctagaagttaatctttaacaaagctcatcacttgagaaggcaggaggttattgtttctgatgtcttctttttttttttttttgagacggagtctccgctctgtcgcccaggctggagtgcagtggtgcgatcttggttcactgcaactccgcctcccgggttcaagcaattctcctgcctcagcctcctgagtagctgggactacaagcgtgtgctactatggccagctaatttttgtatttttagtagagacagggtttcaccatgttggccaggatggtctccagccttgaccttgtaatccgcccacgtcagcctcccaaagtgctgggattacaggcgtgagccaccgtacccggctgtctctgatgtcttttaattctctctagtcattgtatagaacaagaaaaataagaaagtgagttaatctataatctgagaaacagaagttgtaaccatatgtgacttggatcacagtcatatctctctcaaggcctaaagtatatttggggttccaatagcttttaaattatttatttttacaacgtaaaatgctaggacagactgcctggcatgttagttaatattagatgagatatctaattgttacattgtcatctgctgtgattgctaatcatcagcatcagcatcatcaatagaagtagtgctagtacaagtagcatttaatgtgttgtcacactaagttcatggatgcttgttgagaaagtatgcttgataaagttcttcaagaagctaatcaattggcagatttaacagctaatatctttttatattcacaggggtcaggagagtgctggtattgtgactagtgatgggagttcggtgccaacattcaaatcacacaaggtaaatttgaactttaagaaatgttgatgacagaccaagtgcggtggttcatgcctgtaatcccaggactttggcaggccaaggcaggaggatcacctgaggtcgggagttcaagaccagcctgaccaacatggagaaaccctgtctctactaaaaatacaaaattagccaggcgtggtggcgcatgcctgtaatcccagctacttgggaggctgaggtaagagaatcgtttgaacctgggaggcggaggttgtggtgagccgatattgcgccattgtactccagcctgggcaacaagagtgaaactccatctcaaaaaaaaaaaagaaagaaaaaagaaatgggatgacaaagataacaaagacagatgatcattaatatggggagggggatttgaataaataatttgcaatcaaaagtaatattctttggatcagccactttcaactttatatcctaacatttgtcaaattaggatgtatttcttccccagttatacttttttgtctaagaccaactcaaatagggggtcatttatttaaatgctttaagatgctttgatttttttaatgcaaattttagtttttatacttgacaaattttattgcttactacatctgttcttaaatgttttagtgaatagtatcttatgaaacacaagtgcttcaacattgtgaaggtattaaatgccactaaattgttctttttagaatggttaattttatggtatgtgacttttgcctcagtaaatttttttaagtaagtgcttcacagttcttacaattaggttatttgtttttgacttttttttagattagaattctgaaacacagagatattaaatgtacttctttgtcttatttggattggctgggcagagaagagaggcgtttattactagcagtactagtctgtttttttctaagttgcactttttgatttctcaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagatagctgtggcacataatggcgaattggtaaatgctgctcgattaaggaaaaaggtacgtttgtttgtttgttttccctaggcctttttaaatgattaggatgggttaatgaataaaagttaaggatctttgtaaagggcattttctaattgttgctacctgttacctaactgcaacaaacaattgcatcagaatgatctggagtacttgttacaattccagattgtaagctatcccctagagttcgagacaagggtgagaatatgcattttagactcactttttgaatgcactgctttagagatttgggagagttgatttatggatggaagcatagagaaattagagtttatggacttgctatctctttaactctgttgctatgttcaaagcttgtatgagataagaaaaatcaagccatttttcctattctcagactcagcacacttctgtcaccaaataggggggtttcttataccagcagttttccagaggacaccaaatgggtatcctataattcaattgtattctgatagtacctggaggtaaagtcaggttccagaagttaagggctcagtcccagaagttaagggctcagtcccacaagattgtcccgcacttcagatgccagttgcaagtccaggcctttggtacatctgacaaccagttataaattgggagttcctgcaacagccctagcactacctttggtttcaaacatcacaaaactcaagaaagtgctttgtatacatttaccagtttattataaaggatattacaaaggctacagaagaacagtctggtgaaaagatggaaaaggcagggtatgtgggaacgagtgtggagcttccatgccctttccaggggcaccaccctccaggcatctccaagtgttcagctatccagaagctctctgaacctagtcattgtggatttttatggaggcttcatgaagtaggcacgaatgattaaatcatcagccactggtgatcagctcaacctttagcctttgtccccttccctgggggtccagggatgaagctggaagctccaaccctctggttgattcccctggcaactagccctcatactgatgctgtgcaggagcccctagctaccagtcatctcaacagcatacaaaaggacacctatcattttggcaattctaagggttttaggagctgtgtaccaggaaagaccaggataaaaataacatatataaatcttcttacatatcacaaaagcataaaaataaaatggagtataaacttgaagatgacatgaaaaaatgaattggaaacaatgacaggaaactagaatatgggaaaagggacggagactgtttacttaaactcttggttcacagcatgttgtttggagctttctgtgctaatgatgtcaaatttgtgcctatgctttcattcatcatttcatctttctttttttttttttttaactgcctgtctttatattcattcctagtagcttccttttatccattcaggcattcattaattaatgttgagtttcttcagtttattagctcccaataaccttgacttggtaacttcagaacctggtgatatttagtaatagatggttacacgcacaccccatcctataagcattctagagctgggcaattcacatatgatgaacagttacagaagcttaataataatgaactgctgggtcaaaaatatctagaacccaggcttttgtaccactcactgtcattccattttttagttctgtctttagacatttcctagagctttgtccagccctgttcataggcattataatgaccttattgtgcttttctgtccccaaatgaaaaaatacatagttcatttaaaaattcagacaatcatgaaagtataaatatggagtaaaaatttcttaaaaattcaccacttagagataaccactaactcactgtttcctgacataatgacttacctagatgctaaactttatctttacctttagctccctactgaaaatgttctgtagtgcccattcagactcaatctgtgcatgtccatggggctgcccttgtcttggtcagtcctgctcagaactttgtaattatcatagagtacactcaagcgatatttattacatctgctacatttcattgttcaatacagttgattactttcttctatcagtaataatcaatgaggatgggtagccaccattatgatcactaacaaacccagcttgaaagttatcactgtagtgtactacttttataggaatatacccagttcatcaagagtgttgagggtagaaaatgtcagacccacaaatcaaatttttgggaacccctacccactttcaggtctgcttgccttcagatttagtattcaaaagcttttctgtacatctcataaagcacatttttcctgcttgaaaatcttctagatttcctattgcctccagccatggtcatccgttattagtatatacatactattagcgcaggagtccccaacccctgtgctagggactagtaccagtctgtggcttgttaggaaccaggccacacagcaggaggtgagtggtaagtgaaacttcatctgtatttataggtgctccccatcgctcactattaccacctgagctctgtctcctgtccagatcagcagcagcattagattctcctaggagcatgaaccctgttgtgagctgtgcatgcaagggatccaggttgtgctctccttatgagaagctaatgtataatgcctgatgatctgttactgtctcccatcacccccagatgggactgtctagttgcaggaaaacaagctcagggctcccactgattctagattatggtgagttgtataattatttcattatatattacagtatagtaataatagaaataaagtgcacaataaatgtaattcgcttgaatcatccccaaatcatcccctgtccctggtccatggaaaaattgtcttccaccaaactggtccctggtgccaaaaaggttggggactgctgcattagtgggatgcaggatttttgtaactggacatccacagaatgccttatttcttttcattatggttggctactgggtttggggtggggtggagcttcccctctgatgatttaaacttctctttttttctatatagcttctgcgtcatggtattggtctgtctacaagttctgatagtgaaatgattacccagttactggcgtatacccctcctcaggaacaagatgacaccccagactgggtagccaggtaagcagagaactggactaaacttagagctctagtaaggagagttttgccttgcatatgtttataactgaagttattcattcaattattaattaattccaggattaaaaacttgatgaaggaagcacccacagcatactccctgcttataatgcacagagatgttatttatgcagtacgagatccttatggaaatcgtcccttatgcattggtcgtcttattccagtgtctgatataaatgacaaaggtaataaactttagaaggaatatcatttcatagtgtttttccattattgtcctactgctatcaagccctgaaatctttaggtatagaaagttgatgggtgggagggagctaggtaagaaaaataaaaataaatgtattcttcctttttaaagtacgtttctttgagtactcctgaggatgagtccccccccttttttttttttttttttttttttttttggagaccgagtttcactcttgttgcccaggctgctggagtgcagtggtgcgatctcagctcactgcaacctccacctcccaggttcaagtgattctcctacctcagcctcccgagtagctgggattacaggcgcacaccaccatacccagctaattttgtatttttagtagagacagggtttctccatgttggtcaggctggtctcaaactcctgacctcaggtgatctgcccaccttagcctcccaaagtgctgggattacaggcgtgagccaccacgcctggctggatgaatcccttttaatgtttttaatagagattcctattttttcctgtcttaattggctattcatgtcctttgcctagctttttcatttctgcagtatgattttagtggtttcttttcacttttatcaagatatctttttctagccatgaaatcataatgttagaaggaatcttagaagatcatttattttatctttggctcaagtcaaatgaggatccatgtgctcttaaagtcatagaaatggctattctatgagttttatttacttatttatttagtgttagctgttccattgaaatagcctcttaaaatttctggaatccattaattgaattgatttgtgatttacagagaaaaaaacatcagaaacagaaggatgggtggtgtcttcagaatcttgtagcttcttatctattggtgcaaggtaagttttaccttgtttgacatattttattttcccatgttgaaaagaattttttttagacagtttcttatttatgtgaaagtttgaaagttttctttttgatgtctgcaagaaaatatttataaatggtttttcttatgcatgttatgctcagcagttgcactgagtttaatgttctagtaatagcttctaattctgaagctggcattctttcaagatactatgaaacttattttctttattttgtatatttttctctttttacagtacaatatgaaaatagagacttattttagaaaggaagaacttcctcaatgagagatagttatgacagaaaaatgtaagccaggagaaaatgttttctttatactttattcttttaaaattcaatacaacttagggcccttaattttttaattctatactagaacttagtgtttacagagagattataaagaaatcattgcaggagacataccactttaaaaagtcacttctagattttatattgaatgaatcaattgtttctctaagggaaggtactctgtgtgctttataattaatattttcatcagccttaaggactagtttattaaaagtcttctttctttaacattgtttcccaagatattaccgtgaagtcttgcctggagaaattgtggaaatatccagacacaatgtccaaactcttgatattatatcaaggtctgaaggaaacccagtggctttttgtatctttgaatatgtttattttgcaagaccagacagtatgttcgaaggtaagtagatttcttttctttgaacattcatataaatgttttagctatctccttgaaacatggcaattcttgcctcaaaggcttacctggctctttgaaggcatatagttatatgttgtggatataggactgagcccacaagtcataagatcactatttttcacttccttttgactcttggattttgttttttgttaggagtaaggattatgattttctagatctatatgaaggtcgattttttttttaaaaccacacagttgagttccccagtttgtgtattttcacattcatatttttgtatatattgcatttctttttatactcaatctgtagaattctagcactagttttttagaataacactgttatatcatgctaagtaaaaatactctctctccttttccaaacacaccagaccaaatggtttatacagtaagataccgttgtggccagcagctagcgattgaagcacctgtggatgcagatttggttagcactgttccagaatctgctacgcctgctgctcttgcttacgcaggaaaggtattttctcttaattaacatgcagtgaattgctctcccagctgtggaataagaaacccttgcctataaagagaaactcatcaacatttctaaggagaaaggaagctttggtggttaatgttggtttgtttacaagcgttttttattttccaggctttttatccaatggcactattttagtgaaaaccactaaaaggttcactgaaaagaaaaaaacgttcactaaagcgttcagaaattggcacccttctttttaaaaagataacatcatgaatatacagttgacccttgaacaatttgggagttaaaggtgccaaccctctgcacagtcaaatctgtgtatgcattttaatgcccccaaacttaaatactgataacctactgttgactggaagcctgaccaataacataaacagttgattaacatattttgtatatgtattatatgctgtattcttgcaataacgtaagctagagaaaagtaaatgctttgaagaaaatcataaggaggagaaaatatatttactattccttatgtgaaagtggatcttcataaaggtcttcatcctcattgttgtcttcacgttgagtaggctgaggagggaagaggaaaaggggctggacttgctgtcccaggggtggcagagatggaagaaaacccacctataagtagactcatgtacttcaaacccatggtgttcatcaactatatattcagtggaaaaatttacttaatattaaaataaacgtcttgaattatcttcacaagtcactggaatatttgcttgctactaagtatgggtaataataaagctgtttatgttcatttagcatgatgttgtcagtgttacgctttattttcataaccaggtagatggtgtaactgtagtaatcctggggtataacatccaatattcactaccttggatactttattaacttctaaaagaattaatatgcatacattttagaaaagattaccttgataaatgggttaattacttcctatccctaaaaagtatctcattggtctactggtttttatttatttattttaattcatttctttaaaaattatcattttgataatgaatttttctgacagtgatttaatctttgtcatgtcttcatatgcttactgttatctttcaaaacagaggaataatgtttaagacaaaaacattatgagtcctcacaaaatgaattggtttttccaccaagtatattttgtttagtggtttttctttttgccttttttccaaataataaaggaaaattattttgaaattttacttgaatattgtggcggcaacacaacctagagaaaatatttgcctattctgtatattactcctcattatcctttcatttcttctctatcagtgtggacttccatatgtggaggtgctgtgtaaaaaccggtatgtagggagaaccttcattcagccaaacatgaggttaagacaacttggtgttgcaaaaaaatttggagtattgtcagacaactttaaaggcaaaagaattgttcttgtagatgattcaattgtcagaggcaataccatctcacctataataaaactgctcaaagaatctggtgcaaaagaggtaagtaatattaaaacatatcctaaagcataagttaacaataagatactggcataaaattgcaattcagggtagtgaatcaaaatggatgttcaatataataaattaactttttttatcagtttggtttaggaataactgtgtagcaacttgaagaacatgtcacagccacacttacattaaatgtaatccttaatagattaaaaaagctcaatataaaagcttaaggctgggcgaggtagctcatgcctgtaatcccagtactttgggagcctgaggtaggaggttgcttgagcccaggagttcgagaacagcctgggcaatatagtgagaccctgtctctacaaaaataaaagataataataaaattaaattttaaaaaacctaaaatttttacaaaatttattcaaagactaactacacaaaataggctgggcacagtgactcatgcctataattccagcactttgggaggctgaggtgggcagattgcttgcatccaggagttcaagaccagcctggacgacatagtgaaactcacctctcctaaaattacaaaaaatgggtggggcgtggtggcacacacctgtaattccagctacttaggaggctgaggtgggaggatggcttgagcccaggaggtagagattgcagtgagccgaagtgatctcaaaaaaaaaaaagtcaaaaacacacaatagaatgctttttaaaatcaatggagtattgattgctttctctacttgaagacatgcagccaatcccagtgtaatacctttgacttattattttttaaaatgtatttgttaaagacagtgtctggctctgttgcccaggctggagtgctatggcaccatctcaactcactgcaacctctgcttctggggctcaagcaatcctcccacctcagccttctgaatagctgcaactataggcatgtgccattgcagccaggctaatttttgtatttttagcagagacggggtttcaccatgttgcccaggttggtcttgagctcctggactcaggtgatccacctgcctcggcctctcaaagtgttaggattacagacgtgagccatcgtgcccggccaagttatattttaatatcactttatgcctttttttcttttttccttgatactgggactcactgtgtcacctggttggaatgcagtggttcgatctcagcttactgcaacctccacctcctgggctcaagagatcctcccacttcagcctcccaaatagctgggaccataggcacacaccaccatgcccggctgatttttcgtatttttagtagaggcagggtttcaccatgttgcccatgctgatctcaaactcctgagctcaggccatctgcctgcctcagcctcccaaagtgcttgattacaggtgtgagccaccatacccggcctcactttatgtcttgaaaaaaaattttttttaatttttattttttaaattgacaaatgtatatatttattgtgtacatgtttttatatagatatattaagttattttaagatttcaaagcttattctatttcagtagctcatactacagaagtgagatgccatttacaactaatagttatgtaaatttaaaaataaagtctcagcctgggcaacatataccccatctctgaaaaatcaaaaataaaatctcactgtagaagaaagtgggatgaaaagcagcatgccagtttatttagaaagtttccaagataattgggattatgattttccagccttttttatacctgtgtttaggattatgatcatcttactctggaattctgtggaaattatgtaatagatacaagagtttaacataatttcatcatttattgcaatagtgaaaaagaataaagtcaaagaacctggaaatggcatatctccctgttggtgaatataatttagtaaattgatatatcagtgtgatgaaatatgatgcagccattaaatactaagaagactgcgtagcaaaaatgggaaaatctattctaataaagtttaaaaaggaaatgtggacactgagtatagccatgtaaacgtacctgatgaaaggcaaaaaaaacaataacagacaaaaacaactctgttgtagtagtaaggtttttgttataacctggtaaattgtatttttctttttaaaatggtaagataagggataagcagaagtacctggtattacaagagaaaagtggctctaggaatgtaaagacatcaaatgagaagtaggatatctagacaaagaaacttcctcatgattaggtgaaagaaaaaaaaaaccaagaagcagctttgtagaaagaataatttattacccatatgttgttactgaatattctgcaaaacaattttgtattgtatttgcacaatgaaagaattttgcatagtcttaaaaaccttgtgtgcaatgatttctttccaaggtacacattcgagtagcttcaccaccaattaaatatccatgcttcatgggaataaacattcctacaaaagaagagctcattgccaataaaccagaatttgatcaccttgcagaatatctaggtaagtattaaaatttctataaactttgattattaacagagaaaatccaaagcttgacagtctttacacctttagtaaaaaggagtattcagtgtttgttaaaagtagttatatatgttaaacagatattgaatactattctcaacagtgagagtagtgggcatgggcagacaccacagagtcttgtgttggagagctaagccaaggtgagatcagagaaggaagaggtggtttccaggtggagggaagtgcaatcataatcacttaaagcctcccaaaagtcagatcccaagaaaaacaaaaataatttaatcagattctaacagagtaatttggatgtggatacaaatcacaaggtaaaaagtttgtgtaggttcatattcaataatgagataaggagacttcgagatctaagttatcctgggtaagacatcttcctttcaaaatcaggtgatgtataaactgtggaaataacacatgatatttagtcattgtgccttggtacctccacaccatctgtttgtggctggtgtttcttttaacctgtcatgcatatgcctcactggttaaatatttttaaatatcaccctgatgggtgtcatacatgttataagcactcacactttgccagaaactatgctgcctatattatctatattatcataaaaactctacatttaggcaatgtttccaccatcttatatagatgaaaaaatagacttaggaaaactgagtgaacttgagcttaactttgagcctagatcttcctgactttaaattccattttttcaattaagaaaattactcccaaagccctctaattccattctagacttgaagcctcctctgctgttttaaattatgttatcccctagattccaattaaaatttttaaaaataaaggaactgagttttattgattttttttccttttttttttttttaaagaaaggctaaaggagaaatttatcctagcttaaattattctgtttgtaactattctctgttgacgcgtttcttcctttctaaaggaattcttattacatttttatttttccctctttctttaggagcaaacagtgttgtgtatctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtagctggtagggttggatgtgtgtagtttcaagatagaaagttggtcaagaagttatagtggtcacacctcatctatttactgttactcagttggtacaatgtaaaatgccatgcttatgtttataagttttgagattttttttttttctgaaaaggataccaaagtgcgataactgaacatttccaattgcatataatacaacaatatgtggtgttcttttttttacacaagcattggctagcctttttaacctggtcagagaaggcaggtggtcactgacatttcccaagtccatgctttaaagggtttgcaagaagttagggttaaggagaggtgatgccaacaagacaggtgagttaaatataccatttcacacaaagtttgaatagaatacattatacctcataggtgtctagcctctacagttctggctgtagttatgaccttggcttccctgtctaactgtagacaaatctttaaaaaaaaaaaaaaatctggtgcctcagtttccccacatgtgcaatgggatacttattaaataattaataagaatgtgaataagtgtcatacttttgtgatttgagccatcatttcacttctgattttaagacaactcatgattgttagctttcagaaagctaatgattgttaactttttgaaattagtttacaattaattaagatttcattatgatggaaggagacataattggcagatctttgccatctctctttgagatgtcctaaaaagggttgtaaaaatctgtgaaaaagtttttcctacatttgactagaaaatgtgatccatagtatttagtgccctgatactataagctcagcaagtaacctggtacatttgaaataaaaaccaaatttttagattcaaacaatccctttatccttaatttaattaattatcatatgctttttttaatgaagtgcttgatcacttgcaaacatatatacatgtagatgtacatatacatgtacacatacacataaatattattgcaattaagtgatcaagtacagacacaataggggccagttttgtttaaggatcaaagagacaaccactttggggaattagtatcaacttacaatccaagtccaagtatcatcttataatcacttttttctactatattaagatctaatgaatttgatttcttttttgaagttttttcttgtaacatctgagattagaagtttaagatcacttgaccccaaacctttgtttatgtaagaatttttaaacataaaagtgtttgtttctgttatgttaccataatttgatgtatatagtgtccagatccatttagaaatttaatatttattaataactgaaactgtttgtcttcctttggtatatagtctcgcatattatattatagcaggccaagataaaattttgacagctctttaagcccacatgcagcagtgggtcagataaccctgtggcagtgacacgggcaaattggcatttgaataaagccctgggaccacctcaacatgcgtagcctcttgtcttaaatgtactccccatggcagcatggaggaggcaagacctgtgggtcaattttgaactggccttactttgatttttaaaacaagagactcagggaaagtactaaaccaaaatctctgattttactttgcgttttctgtagtttttgttttactgagatgcttttgtaaaggaaaataatactgtgacagtttagtaattctacagattcttaatatttctccatcatggccttttacttcacaattttctgaagtctgaattcaattacaattttttttttaccaatttaatctcaaatgttgtttaactgctttaaattcatatacgtagagtattataaactgcagagatgaaaaatgtgttttcacgggatttatattgtgaactaaactaagcctactttttgtgacttatttgtgatgccttgttgataaatatgtgtaataagtatgtttaaatatgtgtgtccttttttttttttttttaaatagtgactttagttagtgctttatggtaaacagcatggagacaacttccaggctccattcttggcaccagctagtcatatcttatttctctgatccaggcatttcaataaataggccatctcttatgaaccaggcaaaactgctggttgactatgagggacaaattaagtaattagaaaagcagtactaagtaagcactacatcgtggcaagttcctaggaagcactatggggaaagagggagtgtcatggaagagcaggattagattcaaagtgtcagggtgggtaggtaaatgaatagataaactgtagtacattcagacaatagaatattattcagtgcttaaaagaaatgagcaatcaagccattaaatgacagaaggaacataaatgcatattaactaagtgaaaggcaccactctgaaaataccactctgaaaatattgaaggtatccaaagaa

SEQ ID NO: 16354 - DNA, 44988 bp, Human
ctcaagaggctgaggcggtaggatcgcttgagcccgggaggttgaggctgcggtgagctgggattctgccactgtgctccaacctaggcaacagggaaaaaaaagtgtgtagttgatgaattttcgtaaagtgaatatacccatgtaagcattgcccacatcaagaaagaaaacttgatcaacaaatatcgtgcagttataatacagctaaaaatcaagaaaaatgaagctattttacaaacagatacatatatttacgttagaaccatttttttaaaagcaagataataacaaaatttaggttagtgattacctgttggtatttacaaagaacaaataacagtggtatatgcaacattatttaccatttcttgttattcagttggatggtagatttatgggtttcgttttattattcttcattgtttatatatgatagatgttttgtatatatcatttcttaataagatacagttttagaaaagaaaaaaataagattattttaaagaaggatgaatctgtaagatctgattacagaagttattccaggtgaaagctataatgtgctgaggttgtgattgttagacatatggggaaataagaagtctgatttagagtttttatagtgtgagttaaagttagataaaatggcacaagctgtgtcctcagtaaacctacaggctgatggaaaaagatacataaaaacaaatgcagtaatacgtattaatataaaattttaaatacagttgttacagaaacagtgttagtaggaatcgctacaggtttatactggttaagggaaaagtaaagattgttagaaaatcgatacagaaacagcaaatgaagtgtgggaaaattaaaggagaaataagttaataaaagataaaataatttaaaaagctaaaaagatatatttggatcatgtgaagaattctaggtgaagatgctattctgtggtaaaattattttggtaaggcgtgttaagtttttgagatattaggtatttacacaataaaattattatttaaaatagagtttggagctaggcctggcggcacacgcctgtgctcctagctacttggtagattgaggtgggagtataggtttgcgtccaggagatcaaggttgcagtgtgccatgattgcacgcatgaatggccagtgctctccagcctgagcacaacatagtgagaccctgtctctaaaaacaacaaaaaatagaatctagcaaataaagcactgtagataaatgctttcctaaagcgaataatgtatttacagtatgaataaaatgaaatctgattttcatgttgaaagaaatatgggatagtgaatcacattcaaagaatttggagttagacctcaatttaaatacctcctttgccttttttgttttgctttgtttttggaggcagggtcttgctctgttgtgcaggctgaagttcagtagtacaatcatagctcacggcagccctcaaactcctaggctcaagtgatcctcccatctcagcttcctggaaataacaggcacatgccaccacacccaactaatttttaaatttttcatagtcttgctgtgttccccaggctggtctcaaactcctgacctcaagagatcctcccaccttggccttccaaagtgctgggactaaagatgtgaggcaccatgtccagctcttgctctgccttttaatatccacgtgtccttaggtgaataatggaaactctttgcgtttctgtagaaataaaggtagtatctcctagtattatagcaagggctaaatgagagtatggaaagcccatagcttagtgcccagtatatgttaagtattcaatagatgttcctaaatgaggactttataagctctttgtttttcaaatagatttaagatttcttgtgattaaaataaaactttatcactttaataaagaaaatcataaaagttttctcacgcctaataacttctcttctacttattattccttttatttttattacagatcaacgtaagagtaactacaatggatgctgagctggaatttgccattcagcccaatacaactggcaaacaactttttgaccaggtattacactgcatgaaatatgcaacttttgacaccatagtgtgaatgttgttgcatacctctttctctgtttttctgtacttttgctgataatccaacagtgtaccacttggaatttttcatagtagctattcagatatccctactacagcagtagggatattctttattctttcacattcctacatttgtgggagaggacttcttgaaaataattttcagcaggtatttatttaacatttatgagaatcattgtaatggtgactaaaagggattcaaggataatccacaaagttgttgagtgaaatgagtaggaatcctgggcagaaggaacagcaggagtgaaaggcatagggaattacaggttgagagcatctcttatccaaaatgcttgggaccagaagattttggatgtttttagattttggaatatttgcatatgtataatgagatatcttggggatgggacccaagtctaaacacaaaattcatttatgttttgtgtacaacttatacacataggctgaaggtaattttataaaatcctttaaataattttatgcatactgagttttgactgcgacccatcacgttaggttaggtgtggaactttccatttgcagagtcatgttggtactgaagaggtttcagattttgcagcatttaggattttggatttttggattagggatgctcaacctgtataggctatacagagatccctaacaacaatttggtgtcataggttcataatgtatgaggcaaaggttgggatatggaggtcaggtatccggtatgttaaggaactgggactactgatcttatctttcttctcagtcttgagtgcgtattagtcacctgtggagctttaaaaaaagggaaaggagacagtgcttggaaaccccttccagagatgctgatttaattgtctgggcctactctaaattatcagtattttaaaatttaagcttcccagataatgttgtattgcaatgtaagcaagttttgctgagaaaacgaggtaagggattggccccagggattaagtaagaacatgaagaaactgttgcaaagacagaggaaggtggtatatatcatgtgtggcatgaaacttagaggaggataacttttatataaacttcacgtacactttttcttaggagcaggagagcaatagcctgtagtcagaataacttgatcttaaagaaggaaagagtttctagcatttcagcagtaagtaacactagatactttggttttgttagttgtcattctgtcaaatacagattcaaatctgatgaaataaaaattctaaattctctaaagttgtttattctcctgacaagtaatatacttaatctcctgatttggtaattcataaatttaaaagtcctgataaggcctttttggatcatgaaaagctttttgtgtggatgtgcaaaattttaaagcaaaatcataaagagctaagttcaccacaccttgtgaaccaatctccacttttttcttttttccaaaccacttttgttctggtataatatccacttctgttgattcttctgtgcctcctgtttgtgaatatacagtctatcttatttgaaaaaaatgtgaatagagttagcatttattgtacttcatagcaaattgaaatgttatttatagtaagtgagatgtttgtggcagccaaaaactaatcagcaagttatcctctttggtattgtatactgagaaataaaacttgttttttattaagtagaattactttcacttggatacaggaaaatgaaaccatttattatagggcagtgatgtacagtggtttagaagtgtgggcactggagtcacactgcctgcaatagttgtagttgcagctgtttgactttggacaaattaatctctttgtcttatttttctcgtttgtacaattaggatgatggtaacattacttcttcagaggtttattgtgagagttaaatgaaaatctatgtaaagtgcgtagaacagtatttgatggttttgtgtatatctctttctatttatgtagataaatacagtgtcatgtgccgcataatgacatttcgatcagtgacgggccacttatgcaacagtggtcccgtaagagtgtaataccatatttttactataccttttctatgtttagatacgtttaaatacacaaatacttaacagttgtgttagagttgcctacagtattcaatatagtaacatgctgtacaagtttgtagcctaggagcaacaggctgtaccatatagtctaggtgtgtagtaggctataccatttaggtttgtttaagtatactctgatgttcatacgatgatgcaattgtctaacgatgcatttctcagaatgtatccccatcgttaagcaaccctgactacacacacacacacgcacacatgcacacacagttcatattgtaaatggtccaggttattattacttatttctttattaaaaaaaaatttttttttagattggctctcactcctgtcgccccaggctggaatgcagtggtgcgatctcggctcactgtaacctctgcctcccaggctcaagcgatcctcccacctcagcctcttgagtagctgggaccacaagtgtgctccaccatgcccggctaatttttttttgtatttttggtagagatggggtttcgtcatgtttcccaggctggtcttgaacttctgagctcaagtgatccgcctccctcggcctcccaaagtgccaggattacaggcgtgagccaccgtccagcctggtctagattattgagtattgttatctgttatggactcttctcagcagttctttagtccctgttctatttcctgactgctttccttgaactcaaatgcagtgatgaactttccttgaactcaaatgcaaggatcgaaaaatgcagactttacttttgtatgtagtgtgtgtgggataagctggcaggttcaggtcaagccaggggtaaactgggtcctctaaaatgagagcacatagctacatgagtacatgtgtagtaaagccccatgtctgattatgatgttaaatcgaggccagctgctctgtgtttggggactctgagtgcttgaagtcctttggtttgcttcttgctgacttttttcttgactagccttctcctttagctgcttcttgtgggattagtgtaaagagtgttcatacccccaaagagtgtgcaagaacatctgttacggtgaaagaagtattaaaatatatttttaggctagacttggtggcccacacctgtaatcccagcactttgggaggccaaggcgggaggattacttgaggtcaggagttcaagagtgtaataccatatttttactgtaccttttcctgtccaatattgcaaaactgtctctactaaaaatgcaaacattagctgagtgtggtggtgcacacttgtaatcccagctactcaggaggctgaggtgggagaactgctgaaacccaggaggtagaggttgcggtctgcacttcagtttgggcaaaaaaataaataaattaattaaaaaaatatatatatatgtatatataatatgtatttttaaacatttttaaaaatatatgctttatagtgtattagcatgatagtatgtaacttgtaaataaatatacctatgttatagttacgtgcccaagcagattcacttctaaaagtatgtgatcagaagtttatgggagcttaaaggacagcctcactaaaatatattaattaaaaaaaaaacattctaggagcaccttctgaagaagtagagaaccactggggagacagggccttttagggaatttcacagctgagctttcttgttccttgtatttgtgtaatagtctaaagttagttaagctattatcccctgtgcccactgtggggcatctcccttttacttaccattgtgaatctcacagagtgtggaggcagaagctgagcccagctgctttgttatacttctctctgctgcttttgacctgtacattactactcctgccgctccaagcttgaatgttttctatggcactgctggggcaatctgtcttttaccaaagttagattatttggaatctccttttgtccacattgaatttttcattgtttgacattgatcagcttttgcattatcagtatgagactttatattccacatcttctagaaatttctcactttttgcttttttttttttttttccccgaaacagagtcttactctgtcacccaggctggagtacagtggtgcgatagctcaatgcagtgcaacctccgcctcccgggttcaagcagttctccgcctcaacctcctgagtagctgggattacaggcccttgccaccatgcccggctaatttttgtatttttagtagagacagagtgtcaccatgttggccaggctggttttgaactcttgaccttgtgatccacctgcctcagcctcccaaagtgccgagattacaggcgtgagccaccgtgcctggcccactttttgcttttttgatggtaacattttctaaatgcttttttcttatttttaattttttttttcttttttttcagacagggtcttgctctgtcactgaggctggagtgcagtggcataatcacagctcactgcagccttgacctcctggacttaagtgatcctaccacttcagcctcctgattagctagaactacagatttgcttgactacttagctaatttttttttttttttaagagacaaggtctccctacattgcccaggctgttctgaaactcctgagctcctcctgccttggcctcctaaagtgttgggatcacagatgtgagccactgtgcccagccagtgttttttctttttttctgtcatttcagtgaaaattttcaagagtgggaaagtaaatggaagggttcagtttgctgtcttgaaaccaaaagcctggaatgttttaagattatttgtgtgtgtgtgtgtgtgtgtgtgtgtgtgtgtgtgtgtgtgtgtgtgtgttttgagacggagtctcgctctggcacccaggctggagtgcagtggcgcgaactcggctcactgcagcctctgcctcctgggctcaagcaattctactgtctcagcctcctgagtaactgggattatgggtgtgcaccaccacacctggctaatttttgtatttttagcagagatggggtttcaccatgttgaccaggctggtcttgaactcttagcctcaagtgatctagctgccttggcctcccaaagtgctggtataggcgtgagccaccctgccctgccaaatgttttaacattattttttaaaaaacaggctgggcacgatggctcatgcctataatcccaacactttgggaggctgaggtgggcagatcccttgagctcaggaggtcaagaccagcctgggcaacatagtgagaccctatctctactaaaaatataaaaaattagctaggtttggtggtgcatgcctgtggtccgagctactcgggaggctgaggtgggaggatcacttgagcctggggtgggggtggaggttgcagtgaactgagattgcaccactgcactccagcctgggtgacagagtgagaccccgtctcaaaacaaacaaacaaacaaacaaaccaagggccaagcgcagtggcttgcatctataatcccagcattttgagaggctgaagtgggaggatcacttgaggccaggagtttaagattagccttggcgacatagcaagacccctgcctctacagaaaacaaaacaaaacaaaacaaaaaaaaacattaactaggtgtggtggaatgtgcctctagtcccagccattcaggaggctgaggcaggaggattgcttcagcccaggaggtcaaggctccagtgagccgtgaatcacaccactgtactccattgtgggtacagagtgagaccctgtctttaaaaaaaaaaaataagcaaaaactcccacaaaaaaccaagaatgtttattatttaagaactgatattgaatctttctgtaaagcttttaaaatgttaatgaacttttacctcccctggatcattttcctcattttattttaaatacagatttttttaaaaaacatatgcttttgttaggtgtgggtaagtcctgggtgtgtatcctaactccaccactttatttactcttactttattttctttttttttttgagacggagtcttgctctgtcgcccaggctggagtgcagtggcacgatctcggctcactgcaagctccgcttcccgggttcacgccattctcctgcttctgcctcccaagtggctgggactacaggcgcatgccaccacgcccagctaatttttttttttttttgtatttttagtagtgatgaagtttcaccgtgttagtcaggatggtcttgatctcctgactttgtgatccgcccgcctcggcctcccaaagtgctgggattacagacgtgagccactgcgcacagcctacttagtcttacttttgagtatctaccacaggctgatcattctgtgagatgctatggattttaagacacataaatcaataatctctgtccataagtattatgcagtcaaggagggtaaatagacacactgctaataacacaattatgatagagtaaattttctaatagcaggatagataaagtcctatgggaatatcagggaacaagtgattaattttatctagatggtaggagagctttattcacagaaggcacgttagttgagcttgtccttaaagaataaattgttcaataagtcataaaaatacagaagacccattctaggcagaggaaaaaacatcagcaaaattgtagaagggtggaatttatggtatgttctaagaatggtttcttgctcagtgaaggtagaacatggaatatatcagacttttcttatcaccaaaatgataccatttgccctaaatataccaatagggtacttgtgggggtaaatagaaattggaacgtatgattatgaaaactatatatatatatatatatattttcaagactcttgttattgttgaggtcatgatagataaggaaaaggaggtatgaaaaagtggatcaagtaagaggattgaagtgacactacaaaattgaggattagaggccaggtgcagtggcttacgcctataatcccaagactttggaaggccgaggcaggcagatcacctgaggtcaggagtttgagaccaacctggccaacatggtgaaaccccatctctactaaaaatacaaaaaattagctaggcgtggtagtgcatacctgtaatcacagctactttggaggctgaggcaggagaatcacttgaatggagacggaagttgcggtgagccaagattgtgccattgcaccccagcctgggtgacaagaacaaaaaaaaaaaaaacaaaaaaaaaaacttcttttcaaaaaaaaaaaaagaaaaattgagtatagaaaacttgaatttgagttttcaaaaatgttcctttaatatcttaaatttagggaaagccttttctatggcaaaggaatatacgtatacttacatagttttgttctccttttgaagtgtagtatcatctagacacaatgtgtatgttggactgaaattgtgtttttttgttgttgttgtgttttaggtggtgaaaacagttggtttgcgtgaggtctggttttttgggctgcagtatgtagacagcaaaggttattctacatggcttaaactaaataaaaaggtaaaatatgtacgataacattaaactaataattatgttaagttgaagttatgaatttgtgctggaaaagctaagtctgactgattgcaagcttccttttgtagttatctgttaatcattatgaggtaccatgtttttttaaattcaatcaggcaccatcagcttatcatctcaaaaaaaaaaaaaagaaatgcttacttttcctatttgaaaacttagcctataacaaatattaaagcagatattacaaatggcatactaagtacttcaattttgatgtaaatacctgtaggataagcttctcaagaatatgaaaaaaagttttcaatttggttattagaatctgagttataggtcacattcaagagcatagaatcttttaccacatatatttgtttacagatttagactattacacactaaaatcttcatagatttagaatctatttcacttcattttcttccaaaaagaatttgatgtgactaggtctaattattgtaaacttaagatttttgttgattatacttgaaattatttttccaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcggtaagtgaaacatgcgtttgcattatattgtctgaaaattgtattctagaagtctataaataaaacgtttttcaggtttttttttttttttggagacagggtctggacctgtcacccatgctggagtgcagtggcgtgatctcagcccactgcaacctctgcctcctgggttcaagccatccttccacctcagcctcctgagtagctgggtctataggcacatgccattatgtccgctaattttttttttaatgtatttttcattgagatggggtttcatcatgttgcccaggctggtctcaaactcctgagctcaagtgatctgcccgcctcagcctcccaaagtgctgggattacaggcatgagccaccgcacctggcctcttttttttttttccagattttaagttgccagctggatcatggggtatacttctaaaaatcattacctagcacctccatagatttatatgctctgtaattacctaaggttgatctatctcttctttcctcattcccatagggtaagcaataaatggaggcagtgataatttggacttgaggaaaggatgtgactgttgctgcttggtacaaattctaacacaggcaggtgcttaataagtgagagtaagtggcaggctgtgttttcttcatagaattctctgactttttccccccccgagatagagcctcactctgtcacccaggctggagtgcagtggtgcaatctcagctcgctgagattggagtctgcctctcaggttcaagtgattctcctgcctcagcctcccgagtagctgggattacaggcatctgccgccatgcccagctaatttttgtatttttagcagagacagggtatcactatgttggccaggctggtctcgaactcctgacctcaagtgatcctcccacctcggtctcccaaagtgctgggattacaggcgtgagccactgctcctggctgaattttctgactttctgaaaaggctttttaaactaggttttcagactcctaggctggtgcattgttcttatctacagtgtactgctgcttctataatggctattttaaaataatatggcataggaaaaaattatcagaagacctaaattttgagtaccgattccaccctttgctatatatgtgaccttaggtacatgacctaaaacctctgagctcagtatctaaatctgcaaagtggggataataatccttctctggctaccttctagtttatgattataattaatgaactatatgatttacagttttaattgtcaagtgtgaaacgtgttatttagtagtattgatggaatctagaagatggaacatcaaatattactttttaattttttttttttttctttgagatggagtcttgctctgttgcccaggctggagtgcagtggcacgatctcggctcactgcaacctccgcctcccggattcaagcgattctcctgcctcagtctcctcctgagcagctgggattacaggcacacacaaccacacctggctaatttttgcatttttagtggagatggagtttcaccgtgttggtcaggctggtctcgaactcctgatctcaaatgatccacccgcttcggcctcccaaagtgctgggattataggcgtgagtcaccatgctcagccaaaattcaattattaaatgtcacagtgttccgccctttaattttgtagcaatagtagtcaccttggaaaaggatagaattatgtaagttgttcaccaagagagtcaggaatatgagatatctgatagtctgtttatattctggttttgaatgttattctaacctaagattcttcatcttagattactgaattgagtaatcagactattatggtggaatttcatttcatataaggattaccttttgttttataatcagaattactttaattttttttttaaatgttaaagaataggaatgctttatctaaacaagtacagcattgatctttcagtgttaagccagattgctgtttggttgagcagcagatgaagtaattggcttacatttcataactcatgtgattgaaaaaaatctcttaaacactacaataacacacaagcacagtttattttaaatatgggtgtgctctaacctactctatttaaaaagaaggaaggtggctaaatgctttagatagggttgcttgtggttgctagtgcaaatgcctatttcaagatttgttccttaattttgtaggtcagttgttccttcagagttgatattccatggaggactaattcaagccatgttatcttaaaatgagacttagtcataaagttagaataccatttttttttcattttctgtttagaacagagaggatattttcacagtgattggcttattccagtatggtatatcggacactttttctcagtatctaagtacagtctggggaggaaatgagtaattaggttatttggtgataacaaatcaaataaaataatttagtgattctgatacattctgatttcttgtattgaaaaacccagatgagcaatctgttcttactgtagaaaagtttagctcttgtggtatagataattagctccaccagatagtattgcttccctttgaaaagagctaaatatacataaacttttacataccaggtttctgacttgggcggctgggtatttggtaataccttttatcaaaatgagtggaagaaaaaatacatttgagggggaagatgaattcagttttgaacctattgagtttgaaatatgtgcaatataaccaagagagatatctggtatttatttgcatatgtgggtgcagaccttttagaaacagtcttggactatagatacagttttgggagtaatcagtgaatagatggtaattaaaccatgagaatgaaagagatcaacctaccaagtacataaaaatgagaaaaagacctaggacagatcttgttggacctcagcttttgtctttgggttctgcattcacagagtcaaccaaccacagattgaaaatatgtgaaaaaaataacacagcaatgaaaaggtacaaaattttaaaaatacaggataacaatacatagcatttgtagtgtattagtgtattattatactacatagtagtaataatatagtgtattagtattattagcctagagatgattgaaagtatacaagaggatgtgcataggttatatgcaaatattgcaccattttatatcagggacttgagcatccacagtttttggtatccaaggggagtcctggaagcaatcctttatggatatggagggacaactgtactgagacactggccacagattcaagaataattctatactagaagatggctgggcatggtggcacatgcttgtaatcccagctactcgggaatctgagacctgagaatcactggaacccgggaggcggaggttgcagtgagccaagatggcgccactgcactccagcctgggcgacagagcgagactccatctcagaaaacaagaataataccagaagagtattatatcatggaagccaaggtaaaagaatactttgatgaagagaatggtcagcactgccaaatggtaccaagaggtcaaatatgaggagaactaaagtatctgttggaataaggagcttggtagtgaccttagaagagcagtttccagccgggtgtggtggctcacacctgtaatcccagcactttgggaggccgaggtgggcggatcacctgaggctgggagttcaagaccaggctgaccaacatggagaaaccccgtctctactaaaaatacaaaattagccgggcgtggtggtgcatgcctgtaatcctagctactggagaggctcaggcaggagaatcgcttgaacccgggaggtggagtttgcagtgagccgagatcatgccattgcactccagcctaggcaacaagagcgaaactctgtctaaagaaaaaaaaaaaaagaagaacagttaccatagagtattgggtgtttgagccagattatggtagactgggggcagtggatgtcaggtatggaaattgaggttagtgtataatggacagtccataaaagaaagttgtctctgaaaaagaaaaaaaaataggggttgggaaaaattgattaattcatttattcactctacaaattttcgaggccctctttagtactggcattgggcatataattatggtaagcaattgactgcactgggttatgtctccaaggctgattgcatgcctctctgtgagcccagaggccagacagcaagaaagacaagaaactgtggaaacctaagctctctcagaaggaagataaaactcttctccccaaaagcaagagcttggaaaagatgcctagagaaaggagcagagtataataagaacataacagtatgtctgagacccctttaaggaatttactctaagtagtaggtaacttatccagggggagattttatcattcctttatgctgccaagaaatccttgggtttcatgcaagattttttatatagtaaaacagtaatattttaacaccacagcttctgctgtcagtaaagtaggatctggtaaataaaggtgaataattatcatatgagccaaagagaatagaagtcacaaactgtagtgtgcatagtaggtaacttataatcatgttgactttgctgatttggtgttaaaatagtagtagtagaatataatgtttgtatttggctgggcgtggtagctcacgcctgtaatcccagcactttgggaggtcgaggcaggtggatcacttgaggtcaggagttcaagaccaacctggccaacatggcgaaaccccgtctctactaaaaataccaaaaaaacacacaaaaaagaaaaattagccaggcattatggcgcacgcctgtaatcccagctacgcgggaggccgagagcatcgtggcacacacctataatcccagctacttgggaggttgagacaggagaatcacttgaacccaggaagcagaggttgcagtgaaccgagattgtgccactgcactccagcctgggcaacagagcgagactccatctcaaaaaaaaaaaaaaaaaaaaaagaatgtatttgctcacatttgaattaagaacactggaaggatacaaaaacaagttatttggggggtattggactggagtatgacttttcactctactttttaattgaaagtattacctacctaaaacaacaaaattagtagcaaaaaagtaaatacataaaggaagaattagggcccaagaattctggttttcagtctggtctttatctattaacaatgagccatttttttatctaatgttttattcctttgaactgtttgggttcctataagctatctttgtaatcactttatggagcaagtattatttcaaggaatttaaggatcctagacacttaactttgagataattactgattattatgcagttgtaaaaaaaagagatccctggtatccttctcccagcattccctgatggtaacatcttgtgtaactacagtacaatattacaaacaagatattgacattggtacaatctagccaccttattcagattacatcagttttacctgcactcatttctgtgtgtatgtaatttagttctatgcaatttcatcatgtgtattaattgtctgacaactaccacagtcaagttactgaaaggattctttacttttaaagtgtatgcttttgaatcttaaagtcattataatttttttttttttttggtcctcttagtgtattggaacaacacaaactaacaaaagaacagtgggaagaaagaatacagaactggcatgaagaacatagaggaatgttaaggtatttgggtagctattttctatgttttcttttttccttcaaagtattttcatgtcgtaacatttattattacattatttccaaaagattgtttgacttatgtaaagtactaatttttaattccaggtattttgcaactttagtttgatatgctcctacttaaatatattacatttagttttatttcaacagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagtaagtaaattagttgcatagtgaactagtcattgttcagtggtctaaatgacgttaatcttatgtcctgtttttcaaagtagtttcttgtcttgattacccttactattttcaaactaaaagatgaattaatgacacatagacttgtagatattttacctccattttcttatcaccttgcagtttcagagttctacttttcagtgtatttatcaaatgagatgattgacttttatttgaattgtgctgcttttagctcttgtgagttatgtctagtaacttaattaaaatttgctccctcgataggtgagaaataattctttaaaatgctattatgcttgacaaatagattgaaattgaacatacataagaaatcaggagcaatgagagaatggatttaataaatatgtctatcacatcttagaggatttttttgaacatttatatataggaattgttttaaatatgtttggacattaatacaatagaatatccctgtattacacatattgaacactgtaattatatcttgaaattgaccaaatagttttttattatacatatataattcatcaatattttattatatgtataatatatgtatatttacatatacatgtatatgtactatacaaatacatgggtaaatactatatagagacggtatattatacacatacacatgcaatataaaatacatcagactcttacttttcaggattaataactcaattgtcttagactttaatttatttaccataccacataagcatgcaagtctatgccagtaattaatgccttttcctaaggcattattctttattctaggttggctccagaattttaatttttattactacagatatctaataaaatactaatttcaaagcatatgtgattccaaacaagagcattttactatttttaccctaatatcttctcatgtttttattacaaagcaagttagaaggttatatcatttagaagagaaatttttgaaaagcaaaaatgacttcaagactaatttttgtaaactgaatctttttcttttgttttagagaatgggatcttgctatgttgcccaggctggtcttgaactcctggcctctagcaattcttgcgcctctgctttctccagtgctgagattacaggcgtgagccactgtgcctggcttcttaatttttttggtggtggtggttctggcacatattggagcaatttttttaaatgttaaaaaagttattgtattagcttccaggcttacctcacaagagtgttatgagaattatatgaggcaattgctttagaatttttcaaagtagcatataaacgtagcatagtgttctctaaaatactatgttgcattcctgcagtctccgttttaagcatgttactttgacttatatcaggggccattagagggtcctctaatatgcttattgagtaaagaatgttttatgtagaaaagactctgctgtgctgcagtacctactctgcttgagaactaaaaggaatataaataggtaaaaattcatgctgtgttgtcagaagcctggctaaaagatgtcttctggccagtataggtgtcaaaatcatttctcagtcttagttattaggacaataggacaatagtgatgcatttgataggtagtctgaaacagtaaaatacatgaaaaggcagaaacaaaatcacttattccaatatgattccctatatctttgtgtgtagggtggtaaaacggagtcaactgctgtgtatagtctcaagagtttgaattccatctctatcatttatccaaatatttatgtatgtgagtgtttaaaatttttgagatataattcatataccataagattctttcaaaatatactgaaaattaagtatttttagtatattcgtgaatatccagacattttcaaattaaacacaggaaggaagtactgtttttttatttgcagtaacttgcccgtaattcacatgagaagttataaaggcctttttttttcttcccacttcttacacatatttaaactgtagttgtagcttgaatccaaacaataaaaactgaacagctagttcaaaccccaggaggctcagttctacacttgggtcaccaggtagtttttttagataattttaggaaaatacactgcttttaaggttcatgacacatttatgaaatctttggacagttgtttgttttatatgatttatcagttttccccttaaaagataaggtcaactgtagttatgaataagttaatacattttgaaaatctggaactcttaagattggtcattcagtcagtttaggtcctaaacaggaattttattcattgtttcctgcctttaattaaggagatgctttcattttttaaggttaacacctaaaattggttttccctggagtgaaatcagaaatatttcatttaatgacaaaaaatttgttataaagccaatcgacaaaaaggcacctgtaagtaatttctttaatattttgtgtattaactgtttaatatctgctagtttcccatgatatcacttgaagaataacagtgttcatttattaaattgcttctgaggaccattctctttccataggtcagctttcccagtgatgaaataatatgttaataaaaatccaaagatttaattttttaaagtaagatgtaaatattagaattttattttatttgagattcagttataaatagataatatttattaggaggctaatgaaaacaccattcctaagaagcaattttaaagtgtttcttcattggtggctagaatgtagtagaggtagccctattctaaattaacttcgtttatacagttttgctttatgaactttgtatttttgtaacttgaagccttgaacttaagaaatctttttatttaaatagatttttaaagttcctctaatgtcaagtatactctagtatcctaaccctgttagttactgaaaaggtaaaagtaagaagaacaggctgggtgcaatggttcaggaccataatcccagcactttgggaggctcgagaggagcagatcacctgagatgaggagttcaagaccagcctggccaacgtggtgaaacttcatctctactgaaaatacaaatattagtcagatgtggtggtgcatgcctgtaatcccagctactagggaggctgagacatgagaatttcttgaacccgggaggcagaggttggagtgcactgagatggcaccactgcactccagcctggatgacagcaagactccgtctcaaaaaaaaaaaagaacaattctaggttaaaaaaaactctacagccatgaacgaagaaccaattttgacattaatggcaaatggtgtataaggaacaggtgctcatagttactttcgagaacaaaaaggaataaatgacatttaatgtattgcaaggataagaatattagcctctttacaaaactggttggatatgaaaaggtgaggaaccagttatgtgaaagtatgtcatgctcactgggagttatgaaattgtatgatttcttatttctaaactatatgtaatatgacattaaaattcatacctcatgttaaaatttagtacagattgttatgagagacagtatccttgaggaagattttaaattcagaatactttatgtttaggattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaaggtatggggtttatgacctttcacttttaattgataggagtaggctatctaaaatttaagactgctcagttttttaaatgtaccttaaatttgtatttattaatattttcattatattaaaattcaaagacagtattatcactctgtcctttaaaacgagtatgtataattttcaagttagaaatctttgacacatatctcgaagaaaatagctttttgtgactcatttcttgcttttcactgatagacattgttttagatatagtagtttgaaactttcaaaattgttttgcttgtgacttatatttcttaattttttcagggtaagaatgtgctgaatatttaactttgaaacaatgtcagtgacattgtagaacacaactgaaacgtcactgtgccaagtagggtaacatcagtactccctgccaaagaccctaatctttttaactctgtttctcttagacttaaaaaagaaactgttaaatatattaaattgataatttttaaaattgaatggtagtgaataaaatttatatcaaccctggaatcagattactgggtccagtgacattaatttccaaatctggttttagattaatttcaactttgtgctttacttgaaaaaatttagagaccaaactaaagttaacctttattgaataaatctttatggaacaacgtgatagtctaagaaatagagtaagtccttaaaaaaaatttgaagagccctaaacatatgtattttaaatattggatataaggtactttgtatctagaaggaagccatctgctagataccattttgctactatagttttaggttttatattgaatgattttttttcttattcaacaactgttctgtgtaagagattttattgatttttacctattttgtcatattaactcaaattatcttccttagagaagttaaccacataacaaaacattttttatatgggtttgaagcttgtcagtaattactaatcccatcattaaagatactgagttggtgagctgaggatggtggcatgtgcctgtagtctcagctacttgggaggctgaggcaggaggattgcttgagtacaggagtttgaagacaatcagggcaacaggcaacatgcagtgtagtaaaaccctttctcttaaaaataaaaataaaaaaaagtaatgagttggattgttactttgatgggctatgtccttttttattgtgctcatgtgctgtagcattacattgtggttctaatcttaaatgctttttaaaaatactctttattgggctttactttctatacagtacattcttatacacatagccttgcatttccctctgtcaaagggaagacttcttttagtttccacttaatttttttaaatcgtcttaaagatttcactgtctcttaaaggttttctagcatgagataaatgaggaattattttatatacagttcctgtatctcatactcatcactctatagtatgcctaactgttctgctcattcataatgttgatatattatttacattctcaacttactatatttatctatatatcctttatttcatggcttatagagaaatactgtattgcttctagtacaggtagtatgtttacttagtatcatttggtaatggtgctatattttagttactctaaggcttagatggaagtggaagacttaagtttcttttttggcacaataatccgtagttctcctggataaatgttagagctcttcattagtaagcatttattgactgctttatactcagttggaattcagtaacttttattcagtttgaatgcctaggagatatattattctagtcacctaggaattggcagtctttcagaaatggcatgctgagtcatttattccctgctttacaggtcagagagagagaaatggcagctgtatgtgtggaaacaattttgattaagcccattggcaaagtagccagcagatatacctgggagaatgcccagaggtatgctgcctgtgctgctagactctcttgggcaagaacagtagttgggaaagagtagcaaagagacctctttccctacaatactttggtatatttggctatatttactccctataatttttataacctaggggttttttggcaatgaaaatgaccttatacactatgagtggttattccatgtagtttttgaagctcttaaattattggcatccaaattgaattatgactgataatttttgcacgtttttgtatggctaaaattgtttccacatgtgaaaactgaaagccccaagtttacagtttagagttacatacctatgtaccaattgtaggttagctgtgggagattctgcaccaaggctggctagtgtcatacaaagaacacaggctttggaactagataaatctgggcttgactcctcttctaacactcaatcgaacagataattttgagcctgtgtttccttgctcttactatgaaaataatattcttaccttcaagcgtttttgtaagaaatcatgacagtggtatacaggcatttagcaaagtacccggtacttaataaaaaatagccattataataattcctaatattattataaactaagttggatatgtttttaatattcatggaagaaaagtgtaattagacccatttgatctttaaaaagtaagatattctaaagtaattttttgcatattaatacaaggaataatagtttattaatgtgatttatgtccttgaaatagaacaactgcattgaaatgagtgttttcaaacccaaactccaaataaaaatatctgcatctattgttacagtaatcacaaaagacttcatgaggaaagtgggactgaagcttgaaggttagagagagcaagagatacgttcagaagaagaagccaacatagatgaatatgtagagataaaaatatgtgtggtgtgcctatgggccagtgaggtcctctaaaatgaacagcatttaggggagcagcaagatctggtttcataaaggagacaagacaggcctacaaaaactagatatcactgagtaatgtaaagggctgaaggcatttgtattatttgaatgaagtgttggctggagatggctattgtcagggtaggattcttataaaatgtgagatacgagcctcacagagtacagtaaactacaacatgttttaaatattataatcagtttaaatatctgctgtatacttattccatttttcagtaggaagaccattccccaccccctcccaacttgcatatggccagattatcttgattctttttttctgcttccatatctccttcacctccatccctgaagaacaaatgaaacatcaatagggaaaagctaaataaaaccagcacatccatctgcagaaagggccatatatgccagagctgggtctgaaaggctcttagttggtggaatatgatggtagacttctggttgagatctggtttgcagtgtaagtcctcgagaattgtcttgggaccttgggaaaggagggagggaggtagttggcttgggaactgtggcagaactggatgtgattgcatagaggctggggagtgattgggtagtctaatcaacatcctagggtggcagacaacctggcatggacaagaatagcttttggccttactagcaattacttgaaaagtactgtgcttttgcttcttttgctttcacacaaagcgtgatgtttcagctatctaaagaacacagaaaggtcagcagccactgtgggggccaccaggcctttcttttgcccggagagattgggaaacacaaactttcccttaaactcacgtcttctagaagtgtggaagcttgtatctccttaaatctctctgcctgtatatgctttataaattgaaataggataaagagaaagaggtgaatgtcctgcagagtgagcccaaatactggggttaggaatagttactggctcttcctccttgctgttgcgaaagtacctcgtaggcatagggaactccagaacagagatggagcttcccttacatgaatgaccaccaggccctagtttttttgttttctatttgacagggtcttgctcagttgcctgccaggctggggcacagtggcacgatcatagctaactgcaacattgacctcctggacacaagtgatcctcgcaccttagcctcctgagtaaccaggactatgggtacacacaccatgcccggctaattttttattcttatttttagaagagatgaggtctcgctatgttgccctggtcttggactcctaacctcaggtagtcttcccgcctttgcctcacaatgtggtgagccaccatgcccagcctctctagattattaaatggtggaaggattcattaaaccagcagcaaggtgtggtgacccgttatgttttagcttagtgcatgcactaggaggtcaccatcagtgtttgacctcttgctgacttgtgacacctctacctgtttgccccaaaggtaagctctctttctgttttaggggcaaatgggtatctaggagctgcaggaattttaaaatgtaggtttataaataagggcgaaatttttgatagcaaaacttttctgataagtttatcagagactgcaagttgagaaactacagggttttgtgcttgaaattcagaattgacagtaggtggcagtgctctttttgtggaacattaaagcatactcagataaatttcagagatgaaatcataactgatttttaagttattaaagtagtgatttgaatattgattcaacttaagtaaacaatattgtctgataataagagtttccccatgtgacttttattcctctttatatttttgcccctaacatagattctgacccatggtaggctcttggtagatgtttggtgaatgaatttggcagtatttaaaagaaacactctcatcaggcccatggcaggtgcagctaaatgatcaaggcattttttcccactgagctctgatgatattttttaagatcattagccacctactgtcattctaatggaattgtgaagggaggtgaaattgatttgttgtcttgtatctaggcataaatgggtactacccaagaaattaaacttggattaattcatttttaatgattgaaaattgttgccctcccttttatttaagatacatgcctttgtttgctcccttcagtcctttattatttccccagtggaggtctccggttaatctaaagaagatattttcttggggcatggcaactgtgtggttaactcttttggtgctgacatttaatttgttgtcagagttcatcccgtatgcaaatggtaaatctgatttttcccccattaaagtgtgccttataagcatgttctatatgcaggaatatatatttgacagttatactttactagcagttttgtaaactcatcctttgaggatgttcctaaatgtctaagtttttaatattttttaaaaatagtctcagtggtctttattgtgaacccacaataagtaatacattggaacccagcacatgtatgtacgtacatgagtgtatgtatgtcatagtcctgtacttttaactacatatgctattttgaacacaagtgtaatacaatgaaaaccctgttaaaatatttatgttgtcatttcttcttagttgattcagttcttaggtttcacatgaatactatttccaattattattattttatttcagtagtttttggaatataggtggtttttgtttacatgaatgggttctatcattgtgtattctgagattttagtgcacctgtcactcgagcaatgtacactatacccaatatgtggtcttttgtccctcaccccattcccaaccattgcttctcaagtcaccaaagtcgattatattactctgtctttgcatcctcatagcttagctcccacttataagtgagaacatatggcatttgtatgttctgagttacttcacttagaatcatggcctccagcttcatccaagttgctgcaaaagacattattttgttactttttatggcagagtagtattccatcacatgaataatatttttgtgtattaatttgtaacagcaattgcaattccttttaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaaggtaaaagtttcttttttgaaaatggattaaaaattattattgctctgttgtcagatagtggtattttttttagtactcttaaaccttatttgttatataggacaattgtatatttaattggcaaattaatacttagtggaatcacatcataaacatgtttcactaaggcacattcatttatacagtgctgatgtttctcttaaacatgcagatatttttctttttttagttttttgttttaaacatgcaaatatttttcatatgtattcttaaataattgtaaatgtatatatgggctttataaacaaaaaacacatatgcaatacattatggcatttaaagaaaagtatgcaatgctttatggctgtataagtaaggcatttaagtaattaaagtaatttaagctattctgactatatgaacttttttggaactcaattcctaaaaatattttactttattctactagaaaatacacaacacatagacgtgttataacgttttttgtttgtttttggtaatgtgtttggaagaacttacttcttaggcaatatataaccaaagtgctactgtatatagaaaggatatactagatttataatatgtggtttatattaagtaactttaggatataccactttcactcagcgaatagtggagaaagcaagaaaaaaaaagtattgcatcaataaaatgtttttctcctctctaagcagcaggctctcaggggtaacatgaagtctacactctttataaaagctctatttaataatctgctttcttacaattggtaaaacaagctattcagttctgttggaaatagccaacacaggttgaatatcccttgttgaaaatgcttgggaacagaaatattccgattttgggatgtttgcattgtcctattgagcatttcaaatctgaaaatccaaaatcggagcttttttttttttttttgagacacagtcttactttgtcatctgtgctggagtacagtggcatgatctcagctcaagctattctcctgcctgagcctcccaagtagctgggattacaggcgtactccaccaggcccagctaatttttgtatttttagtagagagagggtttcgccatgttggccagactggtcttgacctcctgacttcaagtgatccacccgcgtcggcctcctgaagtgctgggattacaggcgtgagccaccatgcccggccctgggcattttctttgaatgccatgttggtgcttaaaaagttttggattttgtagcatttcagatttcacgttttttggattagggatactcagtcttatttaagatatattttgatttcttacaccagcctgctgtggtggagacgtactcttgagcaatgagtagaataattgtaagggagagtagctagaggggaaagccacaaagattgctataaatgcgcaagctgattgatcatttcaattccaagaggattagaaataatacttctaggagaataaatagcaataacctaggctgggtgcggtggctcatgcctgtaatcccagcactttaggaggttgaggcaggaggattgctaaaattcaggagtttaaggctagtctgggcaacatagtgagatcttatctctccgaaaaataaaagtgagctaggtgtggtggcatatgcctgttgtatcagctactcaggaggctgagaggtgggaggatcactccagcctgagcaacagagtgagaccctgtctcaaaaaaaatgaaatatctatatatatagcaccagacctgcattcagttactgtcccagcaaatatcaaagtgaattccatcttcaagaagataaaccacagaaaagagttggtataatgatttcattcattttggatacaccttgtgtgtactaggcacctttctagtagtgagattatagtactggacaaaaagagttcctattctcctggagtttacattttactgggggaagacaaagcaatatattaaataatacaattattttacatagttttaagtgctacaaggaaaggaaacatgataatgttatgaaagcagtagttgtgggtaggaggggagtgtctaatttagatatatattgtttacaattttaaaaagctttacttctgtcattaacctagaatatgactataagcaagtcattttaacatcttaatttccttaggatcctaatttctaaaatggaaataatccctaatttagcattctgagattaaaaagaaaatttctaggtgggttcttttggtgagacaggttctcactctgttgcacaggctggagtgcagtgggtgtgatcaaggtttactgtagcctcaaactcctgggctcaagtgattctcctgcatttggcctcccaaagtgctgggattataggcatgagccattgcacccagccttatagttttattttttaaaaaacaaaaaatttggccaggcgtggtggctcatgcctgtaatcccagtactttgggaggctgaggcgggcagatcacttgaagtcaggagtttaagaccagcctggccaacacggtggagtgtaaatctccaccaaaattacaaaattagcaggtgcctgtaatcccagctactagggaggccgaggcaggagaatcacttgaacccaagaggcagagttggcagtgagccaagactgcactactgcgcttctgcctggatgacagagcgagactctgtctcaaaaaaaaaaaaaaaaaactttgaagtacagatacagtaatatacgtatttctcaagtatgaggctcaatttttacgaagtgaatttactcccataagtgccctgaacatgatagacaaaattatctgccctcacacagtctccttttctctttttcttataacttcaaatgtgatttctgtcattctgacttataccatcatatagagattagttttgtttatcattttctaatagctttgttgagatatagcttataatttacacaccatgtaattacccatttgaagtatacagtttaagggtttttagtatattcacaaagttgtacagctatcatcataataaattttagaacattttcattatcccaaaaagaaatcccatacccattagcggtcactcccatttcttctcagtaccccttctctctgctgtagacaaccacgaatctttctctaaagttttgtctgttctagaccatcatatgaatggaatcatgcaaaatgtggtcttttgtgactggcttcttttgtttaacataatattctaaagtttcgttcatattgtggcatttatcagcactccactctctttttttttttttttttttttttttgagccagaatctcactctgttgccccaggttggagtgcaaatggcgtgatcttggctcactgcaaccttcgcctcccaggttcaggcaattcttctgtctcagcctcctgagtagctgggattacaggcgtccaccaccacacccagctaatttttatatttttagtagagacggggtttcgccatgttggtcaggctggtctcaaactcattttatggatatggtatattttatttatttgtttgaaatctgatgttttttattgtttccactatttgactaaggtgactaatgctgttatgaacattcattgtgtaggtttttgttgttcatatgtcctcatttcttttgggtgtaacctaaggagtggaattgctgggtcatgtggtaactgtatttaactttttgaggaactgccacattggtttctaaagtgactgtaccatattaccctgccaccagcaaatttgatttctccacatttcaccaatacttgttaatgtttgtcttttggattatagtcatcttaatgggtgtgaagtggtattttatagtttttattgcatatctctaatacctggtgacgttgagtgtctttctatgtgctttttggacatttatattgcatgtatttttttttttcctgagacaaggtcttgctcagtcacgcaggctggagtgcagtggcatgatcgcggttcactgcagcctcagtctctgagcttcaagcgattctcatacctcagccttctgagtagctgggattacagatgtgcaccaccacgctcggctaatttttatatttttagtagagacagggttatatacttgttggccaggctggtctccaactcctggcctcaagtgatctgcctgccttggcctcccaaattgctggattacaggcctgagccactgtgcccagacatggatcagtttttattcctgttactagtgtttgaaagtacatttgctctatgtccttatcacttcttccactagtttttattgttagggtttggttttgttagccattctggtgagtatatagtgaatatacaggttgagtatcccttatcttaaatacttggggaccacagtgttttagatttcaggattttggtttttggtttttttctttttttaaaattttggaatatttgcattatacttactggttgagcatccctcattcaaaattccaaaatctgaaatgctgtcagtaagcattccccttgagtgtcatgcaaatgctcaaaaaatttaggattttggagtaatttggagttcagatttttggattaggatactctgtctgtagtttattttcttgattaccagtgatgataaatatttcatgctttacagaccacatggtctctgtcccagctattcagctctgctattgcagtgtgaaagcagctgtgtactataatacctaaacaaatgagggtggctatgttccagtaaaacttaatttaccaaaaaaaaaaaaaagcattggattgggtttgctccatgagccatagtttgctaactcctgtattaactcagttaattggagaggaaacagcagaaaccatttatgggctatatgactgttaaaaagcttccttttttaggagggactggagtagacctgatgttttcagaattcattttaaacattttttaaaacttacacttttatacaattcttaatatatcacaaaatagctattgccttatctgtcatttttcaaattgacctttattacaaaaagctgataaaatgaatattggggaatgtttcaaaatttaactttgtaacccagacttatttctcttttttgtctcataatacagaaacaatttttattatgagagaaaataaagcattgaggtttttggctttttttttttttaatttttttttttttaaattttttgagacaaagtcttgctcttgtcccctaggctggagtgcgattgtgcaatctcgggtcactgcaacctctgcctcccgggttcaagcgattctcctgcctaattacaggtggctgccaccatgtctggctaattttggtatttttattagaaacgaggtttcaccatgttggccagcctgatctcaaactcctgacctcatgtgatccgcccgcctaggcttcccaaagtgctgggattacaggcatgagccaccgtgcccggccagttttttgccgttttaagtaatgtagttcactgatgcaaaatatattgggaatgttgtgcagccatcaccactatccagctacataattattttcatcttgtaaaactaaaactctgcacccattaaacaatccccatttcccccctccccacaacccctggcaaccatcattctactttttgtctttgtgattttgagtattctacctgtataagtggtatcatacagtatttgtctttttgtgactggcttatttcacttaacataatgccctcaaggttcatccacgttgtagcatatgtcagaattgccttcctttaaggctgaatgatattctatttgtataccacattttgcttatctgttgatgggcactcaggttgcttttgtgttttagttattgtgaataatactgttatgaacatggatattcaggtattggtttgagaccctactttcaattctttagttatttgtttgcttgtttagatggaagataaaaccatgagctttgtgggtgttgttttatatatcagtcaatcagatgaaaagaattaattattaaagtttgaggctgggtgcaatagctcacacctgtaatcccagcactttgggaggccaaggcgggtggatcacctgaggtcgggagttcgagaccagcctggcaaaccttgtgaaaccccatctctactaaaaataaaaaaattagctgggtgtggtgacacacgtctgtaatcccagctactccggaggctgaggcaggagaattgcttaaacccaggaggcagaggttgcagtgagctgagatcgtgccactgcactccagcctgggcaacagagtgagactccatctcaaataaaaaaaagaaaaagaaagaaagaaaagtttgataggccagcttgattatctgaattttagaaggcagattctaaaatgagtaatcgtagaatatcgctatggtaacatccagtgccgtatacattttgtctttatagccaaatagccacatagaatttttatattatttattttttattgaggtaaaatatacacatataatacagaatgtacacatctttgcccccccgcccctttttttttttttttttttggagacagagtctcactctgtcgcccaggctggagtgcagtggtgtgatctcggctcactgcaacctccgcctcctgggtttaagtgattctcctgcctcagcctcctgagtagctgaggttacaggcgcccgccaccacacccagctaattttttgtatttttagtagatatgcagttttgccatgttggccaggctggtctcgaactcctgacctgaggtgatctgcccacctcggcctcccaaaagtgctgggagtacaggcatgaaccaccgtgcctggccatttttaccgtttttttttttttttttgagacggagtcttgctctgtcgcccaggctggagtgcagtggcgccatctcggctcactgcaagctccgcctcccgggttcacgccattctcctgcctcagcctcccgagtagctgggactacaggcgcccgctaccacgcccggctaattttttttgtatttttagtagagacggggtttcaccgtgttagccaggatggtctcgatctcctgacctcgtgatccgcccgcctcggcctcccaaagtgctgggattacaggcgtgagccaccgcgcccggcctatttttaccgtttttaagtatacagttcagtagtaataaatacatttctattctttttctcctcccttcaactccccccacccacttcctggcctttgataaccaccagtttatttatctttatgagatttagctctgacatatgagtgaaaacatgcaatagttgtctttctgtgcttggtttatttcacttaacgtgatggcttccagttccatccatattgctgcaaatgacaggatttcatttatttttatggctgaataatattccatagtgtatgtataccacattttctttaagcacttaggttgacttcatgttttggccattgtgaatagtgctgcaataaacgtaggagtacaactatctccaatatattgatttcctttgttttggatattgctggatattgctggatactattgctggatattgctggatactatgttttggatattgctggatactatggtaattccgtagttttagttttttgaggactctatattgttctacatagcggccttactaatttgcattcccaccaacagtgtatgagtgttccttttctctacatccccgccagcatctgttactgccttttttttttttttttttaaaaacagagtcttcctctatcacccaggcaacctccacctcccgggttcaagtgattcttagcctctgccacccaagtaactgggattacatgtgccaccatgcccagctaatttttgtaaatcccaaagtcctgggatttacaggcgtgagccaccttgcccagccttgcctgtctttttgatacaagccattttgactggggtgagatgatatctcattgtggttttgatttatatttctgtgattatagtgatgaacatttttttcatatagcttttggccatttgtacgtcttttgagaaatgtcagttcagatgttttgcccatttgtaaacgagattatttggttttctgctatcgagtttgagctctttatatattctggtttttcgtccttttttagatagacagtttgtagacactttcttctattctttgtttatctcttcactttgttggttgtttcttttgctgtatagagctttttagcttgatgtaacacccattatctctctttgcctgtgcctttgaggtcttacacaaaaaatctttgcctagaccaatgtccttctttcacttctttggttagattgattcctaggtgttttacttttttttttttgctattgtaaatggaattgctttcttggtttctttttcagattgtttactgttgttatatataaatagctactgatttttttttttaattttagtttttaagaagagatgatgtctcactctgttgaccagactggtctcaaactcctggcctcaagcggtcttcccacctttcccttcgaaagtgctgggattacaggcgtgagcctaaccaaagcctaaccaaagagtcattcttctccaaccctctcaaaaccttccaagtgttttttttgtttgttttttttttttttgagacagagtcttgctccgtcgcccaggctggagtgcagtggtgcaatcttggctcactgcagcctccgcctcctgggttcaagagattcttctgcctcagcctccccaagtagctgagattacaggcgcccatcaccatgcctggctaatttttgtatttttagtagagtcgggatttcaccaggttggccagtctggtctcaaactcctgacctcaaatgatccacccacctcagtcacccaaagtgctgggattacaggcatgagccacaacacctggcctaaaaccttccaagtcttaactgcaattactcaactagttctgatcaagaccaagaaaattaagaacagtaagtaaaagcttgtaagttacagttagctttcaaatttcatgacatatagattttcttagtatacagtaagggaaaataattctttgtaggaccttgtactgtcttactaggtggcattctattgtcttctgtcacagggcttaaataattgtcaaaataatatttaaagttagtactgttaaactctcttaaaaatttattttcctttcctgttcaactcattggaataagaaaagagttgatttagtgatctatgcacctaaggattaaaattcatgttatttatctcccaatattgcttatcttcatgctttaggaatgaatatataccaataactcacatttttcaataattcatataatcacatcaaaattcctattttggggtcagtaaatactgttttcaatcttaatttcttggatttacttattagtttagataagtaaaaccttagtggaagttttgaaatgtattatagatttctgaaacatggcaatttgtttactgaggtcaaaacttcagatggagagattattttttaaaaataaaatagttacgtgcttgtagcctttttacataacttgaattgcagaagattttcatttctctttaaaaattattaggcttttgccaagttggaaacgaggtatagcgcctgtagtcctagctacttgggaggctgaggcgggaggattgctcgagcccatgagttcgaggctgcagtgagcttctgcacttcagcctgggcaacagagcgagaccctgtctcaagaaaacaaagaggtatatatgtatttacatgtgtgctaacttttagaaattgaacagatttgatttcttgctactattttagcttcttttgataatgagaatgattggaattaatcactgttggggggaatacacatatttcatagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagtaaggaactgtcttcttagagaaaaaagtttaaataaaagcatagagtgaaccctctaaaaaagaaaaaaagaaaagcaaccattttgtgctttctggagagcaagccaaagataacatgtaacttaataacaaaatgtagacaaaaacctagaaaatttatttctgcctaaacaaaaacctaaaaatacaaaagaataaggcatttttctatagattatttgtaaatggagtctactgtcagcaaaaggttctgattcactttgacattggacaggttcggtaataagtcagttggcgtcttttgctttagataaattaatatgttatagttatataatatagatatatgttatagttatataatatattatagatatataatatgttatagttcctatgaggccataattggttgggtttttttatttagtggacttgcaaataattagatgtaagcgtgtcacttaaaagatcctggatttaaatattagttcacacatgtacttgctatgtatgtgtctttgggtctttctgagcctcagttccctccctttgaaaagaggaatgatggccgggcacagtggctcacgcctgtaatcccagcattttgggaggccgaggcaggtggatcacctgaggtcaggagttcaagaccaccctgaccaacatggcgaaaccctgtctctactaaaaatacaaaattagccaggcacagtggtgcacgcctgtaatcccagctactcgggaggctgaagcaggagtattgcttgaacctggcaggcggaggttgcggtgagctgagattgtgccactgggctccagcctgggtgacagaacgagactctgtctgaaaaaaaaaaaaggaggaatgatactacctgttaatgatactacctgttaggattattggggtattaaatgagatgatttgacaaagtgccatttaaagtatatagcattagataaatattttatcttttgtggactttaacaaatagtttattgatggaaattttttaaaaaagcttttaagttacacattttaagttcctgctactgaaagcaggattaactagtctgtagaataatagtaattttttaattttgtctccttagctcattacctaaaggacttattgtaaataagctatttaagatcttaagaaatactgtatttttttaaatggaaggctaagaaaaacataaacagcctaagcatgtgcattaaaactttgttgacttataagattattcaaaatatgttattttaattttggaattatattgtttactttaggcagcagaacttgctgaattcactgccaagattgcacttctagaggaagccaagaagaaaaaggaagaggaagctactgagtggcaacacaaagtaatcatttattcatttactagcttttattgaatagcttttatacccaggattatgctgactttgtagtgataagtgtaagatactgtcataatttagagtgggaaagatactcgtgttatgtgtattgtaaatatctatctacagatataaaccaagtactttgggaacacagaagaggtgattaatttctgggggaccagagagttgtcgggagacccatatacatttaagctgggtcttgaataatgaattaaattttgggggtacaaaagattgggatgtaaaattgggaatagttagagactgaagaagtagtcattctagacagagggaactgaatgagtataggaagtatgaatgtatataatagatttgaggataaccaataagcagccgaggcttagtgttgttcagaaatgttaggagatgtggccctcaagtttgataatagggaattgtgaaaggctttaaataaatgctctgctacagcaaggcagtgggagtatcgattgacttggggcttagaagatttcaaaacaggattgtaacatgatcagatatgattttataaaaaccatgtagtgatcagtgtgaagaaaggattgggatagtggatacttaagagataaagacccaaactgaggatgtgaaaatgagaataaagaggaatgggaagatataagagacattttgtggtcacaaaaaggcatgggaaccagtgattggatatgaagttgaattatttttatttttttagagacatggtcttactctgtgtcccaggctggagtgcagtggcacaatcataattcattgcagctttgaactcctgggctcaagggatcctcccacctcagcctctgcagtagccgagactacaggcatgcaccatcatttttatttttgttgagaatggaggtcttgctgtgtaacccaggttggtcttgaactgctggcctcaagcagccctcccatctcagcccccaaagtgctgggattgtaggtgtaagccactgtgtgcagctgacaccgagatttctaatatgagtcctaagtagatgaaaccactgttgtctaaagtagcacacaattgtaaaatcaggctttggttggagagtgggggaatataagataatgagagtttaattcaaacaacattaactcttaactgaaaagataatttttttacccccaaagatgatatttagttttagaagatgatttttctacaataaaatgtacttatacagaaaacagttttcttgcactcttaagtaaatctttgtagcagtttaaatttcattgggtaattttatatgtattgaaaattagttatatataaataaaactacaaaaggaatgctactgttaatttcccagttactctacttgtttattagaattttttagatcccttttagggatgatttatgaaatttagagacacataaactttaaaaaattagcatattacagatatcaagtctgtgaattatagaaaattagaaaatgcacacaaaagacaattgtattcccataaactaggggaaatactgcaaaaccttagtacatattcttccaggatacttcctgtttatatattcaacatgaaatcttactgtatgtactatttcattttagtcaattttcatctcagaatattagactatattaagaatttcccaaaaagtctcatagctaatttgccagacaagtgttcagaggactttgcattgtctgtatttgctgtaagtctcttttaatggagggcagtttctctttttattattttgatttattgaagggacctacagaatgtctcacctcctatatttgtttagttacttccttgtgtcattgaccttatcctttaactccagtatttcctttgaaccagaagttagatctagaacctggggaattcaaattaaatgttttgactacagtgcatcaaaggtgagacttccatataattgaacatctaaactggagtacttttgagaaaaagggggtattgttcataattacaccaggacaacagtgtaacaggacttttccaggtaaaccaagataatatgatcacccaaataattggtgatgttagatatttcaggttgtatcatatcagaagacacttaatatctagttaactcaccattagtattttttagtgatcattggatttgagtaacgacagtctcattcctccgttattcggttacattttccccttgtggctcaaataaaatctattgggtgtgagattcttaggcattatatgaatatctatttctcatcaactatttgcacaacagttttagcaaacaattgataatccttgccagaattaatagttctttttttgcatgtatgcttgtttttcttttaatctgtcactttgaagctcacagagtaattctaatagggtttgcataataatgtttttgattttctcttttacctgttgacattcttttatgaaaatagaggtttcataaatagggcctattttcattaccttgaaatacagtttctattaaaaagggagtataacttgattgttttgattattaatttttgaagtaagttgctcataaacgtatttttaatgttcaggcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggtatttaaaatttgcagttgtatgtgcatttgaaatatagtttgcattttccccatcttagacaaacttagttaaaaagaatatagaagttttaatactggctgcccttgtgattggtttgtgggtgtttggcctatagtcatgttatttcatttcttccgttgtgtgaacccattagcaaatacctgttagctttgtataatcagaccttaactagtgagttatttaattacagcttgacccattttaaaaggtagaaagtattctaatgtcatgttgaaaaacgtgaatttagtttttgatcagtaatatgtacattgagggccaggcgcagtggctcacacctgtaatcccagcactctgggaggccgaggcaggtggactgcctgaggccaggagttcaagaccagcctggccaacatggtgaaactctgcctctaccaaaaatacaaaaattagccgggtatggtggtatgagcctgtaatcccagttacttgggaggctgaggtattgcttgaacctgggaggtggaggttgcagtgagccgagatcatgccactgcacttcagcctggacaatagtaagtgactctgtctcaaaaaaataaaataaaataaaatgtacattggaaagaatgatagttaatatactatgtttaagacattacataatcttaattatttgttgagattttatattggcaaaaggtcagtatattacatggacataactaggtcaaagtagaggattttaatattatgagctttcttttttcccaataagttatctaatattttaattgttaaaatctttaaatattaaaagaaaatgaggtgatagttacaataaatgtattaagacttttggagaaggcttcccttgaggtatagattttaaatctcatagtaatattagtctgtaatggctacattgaactttttagccatttcaagtattagattagaaagttaaggaaatttagaataatgtacaaaataccatggttgataaatgtggaaaggccatgtgtattcctcccttaccactgccaccactattactaaaacaaacttatacctaaagaaaaaggtttcacagtggaaatgatttggtatatgtatttttgcatcttaaagccattttcataaatttttttaaatctaagaaaaaaataatagttgtactttttattttttaaataggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataa

SEQ ID NO: 16355 - DNA, 43102 bp, Human
ctttgaacttcattcattcatttgtgtcttcaacacatgtttttatgttttttcaggacctaccctggctggtactgtgctgggagccgctggggaccccaggccctggccggtccacgcttctcagccaccctacacaggccacccatacgtgctcccttttagggcctgaaccttcaaagcctctgtgagatactccctggttctgcctttcagctatcactccctgctccgagctccacaccctttacaaatgttcattaaagttatctatatggtatgttaatccatttctgagaaaataattttcttggttccatttccgtcaacgtttgacagtcctcaaggccaccatactctctggaggtcttgcttcatcctcttattttgtacagaaggcttttgtttgggatgtctgctcacactcaaagacagagaggccttactgtctttatgtctgcagtctgtggagtgaatgaaggatgctcagggctgacaccagcatgaaatgtgatgggagaggttggggactgtgtgaatgtgaggaaagggagcccatctgcccccccaagtacaaccccaccagttgggcagagtgatccccccaccacccctgcattgctgtgaaatttagattgggcagggcccgtttgaccatctctctcaatctcaggctctccattttcaagtgagatgtaataatatgcgtcctgtttacctctcagcctgtgatgagaatctaatgattagggtgtgctagcacacaggcacctgtaaatcccattgaaatctgagggccctataactcctctagtgattcccaagcctcgtgcaccccaccctctctgttcatccttacttcccacgtgtcccgttagccctccggatgcagtcaggcccatttcccccaggacgcccggcactaagccgccccatccagctggggtctgaggggcctgtctcttgccccacgcctaaaagacctaaccctcctcctatcccttcgatacggcagtctttatttgctggagtctgcacaacatcactgcccaatgatgtgtctgcttccacgattcccaaagagactgagcttactgagaccagggcaaggaccgcgccagttcctcatcgcccccttcctctgccttcccctcccttccccctcaccgcagccatggcgcccagaccaagaaagcagagcagaggttccgcaattcttttctaagattgtctgactagagggttcaaagccctctaatccaaggccggcttgtgtctctagggaggttgcagaaaggcgccagaatgtggatggcgcggacaatgtgggatactggagtctcgactgccgcgcgccaaggaagggcgtcacctagccaagccggccctggagttgagtgccccgcagcccgccggtccacccgcccggccgcttgctggcaccctggtggccgcgccggctttgtgtcggcatcaggtgcaaacccccagagcgccgggcgtgcgcgcacgcgccccggagcgcgcggagcccattcgttgcccccaccgggatctcctctaggatctcctccggcgcccggggccggagagtgggggagggaggaggtcggacacgtagcctgcctcgcagcagggctcgactccacgcgggagggcgggggagccggggacccgccgctccagcccgctggccttcgaaagatcctcctgggccaatggcaggcggggcgacgcgaccggattggtgcaggcgctctgctgatcgctgtggaaactcgggcggcggggaacgcgggaggatgtggaacccgaggcggggggagccggaggggcgggcagaggaggtgtcgaggccctgagctcccggggagtttttactggaggcaaaagtccatagcgggagggctgagggaggggcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggtaagggtctgggggcgccccagccacccttctctgctgcaggcggagtcaggatccctggctccccgtgggccaaacagacctccggcgctgaatggagcttgggacgtcctgtagggaaggaaagtgcatctattgcactcgtaccccctccccaatcctcctcctcctctgggccgactggggtggagaccggatctgggacccggggaggcggcgctgcggtgaaagtcccagcggtggagaacagggcaagcatctaccgcgcgcgccgggacccacgcgtcctccccttcctcggggtttgtctggaggcagggactccccaagaggggcgctcgggccagacggctttggcgcccccagcggggaagatggccgcccctgcgcgccgctgaaaggagcgggagcgcaggcagccaggtgtgggactccgcgcttgtcccgcactctccatccagactgggtggcgagaaggaaagctcgtccccggccggagatcgctcctgctgggactcttgtctaagaagttcctcaatggccacctgggaaaaaccgcccagcagctcgggttcccacgctccagggattatctagactcaccccaagctcgagccggccttcttggggaccggcgtccgggattggtggaaggagaacggcctggggtttgcaaagcccaggtcgagtgaggccttgagccggtggatttagcagcactagactggcttggcaacaggtccgtctgcactcgaggttactctcgggcgttcaactcaatggctctctctttttaaatcctgccaagaacacccttccctcatcttgcactcctaaaggttgtgggcctctctggagccattgctgcccaccttacccccaccaaatgcgtggctcagtgattaccccgcaccagctacccgcaccggggaccccagtctgaaatcctggcatttatttaaggatgcagctggtatcccatggattcgaatgggccagaaggaaaagaacagaggcaaggagggaagaaagggcggcttttggtggtggtagtgaattggatgcagagaaaaaaggtctgatgggatacagaaattggggaaagtgaataggagagaggcagaaaggagggatgaacttgacgtagatcattccacctggaggtctaggatgcccaactgttggtgggcttttgctctctaagctgtgtaggcccgacccttaacttccccacctcttgcatctcatggagacaggcctaggggaaggccagaccaggccaccataacccaagctggacaatggacaggtggtgtgggccagcagggccagggcttatctaagattgggaaggtcagcgatactgaaattccctacagctttcagtcccatcctgttttacttgcttgtggacattgcttaagcccagtgggtttgtgatgctatttagaacttaggtgggtatgtttcacataccttcagtgctatctcacctggacctttacgcggcccagtgaggaggttgggttaatgtaactcctaagtaaaggaccttctggatcctggctgggatctttccactatatgttgctggacttgggctggtctgtttctgatttcataggtaaattgtagaaggttcctgtcctgtccaggccctcaccaaaaagtttccagaaggaaaagtcaaatacgatgaatttggtctgattattccacattgttaaacatattttcttatgtgaacgcttagtctggcaattgccttgacctttctggtttaattaccatatcagattgatttatttcttccttgttctggatgttctcagtgcttacctgaccttaacactgagttccctccaaaaatcagtgctcacatctctcctaacagaggactagaatgacctactcttccctgaccttttctctgtctcataaaaatgtaatagtctcgtcatttctggtcctgctccagcgctttctgtataactttcatggactataaatctggtatcttggatgttggttgctttgttactttcataagctagggtgggagccaaccggggctgcaaacagatctagaattgaagaaagatgtcattactgggctcatccactaagtgttgtcacttgactgagccccatctcctcatctataaggtacacctgtacctgtttcaatgagactgatttgtggcaaagcacccagcaactgtaaccactagatgaatgcaatggggtgttatcaggcaaacgggaataagaacaagtattatgaaacagctagaatggaaagtatgcaaagaggaatttgaagaaaaaatttaaatctatgctagctttatttggtgtagcaacacgtaaaagcaatccctgtccccagagcttcctgtcttctaaaataagacttttggggcatgaaatacacgaactggggatacagatttgaatgatggtgatgatggagtgagcagctgggttctctttgttttgttttgtttttttaaactgtccaggaccaggttggaaaaaggccttgagcagcgtggggtgggtggggcatgtggaaaggggacctaaagagagaagcaggaacaggctactgaaatccagagacccttgcctaggctgttgagcaagtggctttgccccttggggtgatggtttgtcccccagagcatggggagtgacaatttatggaccaggcacagtctggggagggactgatcagaagacagtttggattccctgcaacattcccaggcaatgttctgagcccatcacagtgcagtcattcctaacacaaggctggaaacaggtcggaagtcaaggtagccattcttgggacaatcctcgaagtcagggaagccattctcgggacaatcaggggcctcaatagggcattttcttttttttgaagagcaaaagatccaggtagtcaagatccatctccctagaaggatggggcaactgttacgtggtccttccacagaagctaaaccctgaccttgcctataataatgcaagttgcttgatttttgcaacttacaaaacacattcatatgtatcacttcatttcatactcggatcagccccgtaggcatctctcactgctctgaggtatcaaacctggcttaagtggcagtgctcagacttaaactcagaatctgacctcaagtcctcccctcccagcttccttcccttcctgttgctacctctgatctcttccctttggtactgcggtgcttctctcgccttttccttgctgtgggcaaaaggaaccctcacccgcgccctaagagcgtgtctgctcttttcacagcagtcccaccactgcagaactgttcatcttcagcgacaattcatcaaacattaattgagtgtctccatggctctgagctgggcccagacacagagatgaattattcacagacagagacctgaagctgtgggatgtgctccccctgctctctctcaagctggggcttggatctggaccctctgcctctagacatcagccccctacccctagcccttgtctcagcaactgttcctgcccggtctgcattggtgacctcttagaatcaagggaaggtgagaagagaccagaggtttgttccacctttcaacctgctcctatgttattcttgtgaaaacgcaacagatcgaaagtggaactctggcctcctttgcacggggcaggagggttgtagtatttagaggcaggagacctgggttccagccccagctttatgaattcccaggcctggagggcagctccatctccccagctgagatctgggtgggagctgtccaatttctgtggctgtagcctcagcatccccaggaagcagttctgagatgaaagtggagaatggcatcaatttcttcatgcccaggttgcctttgtaggggcctgtctcctgtgcagccctgcctttctgccctcagggtagtgcatggaccctgtgttatgggggaggctctcactgcggggctctttggccacagagcactgccccaccagcctccattgcttctttccttggaggggacatggcataggggcttcctgccctgcctgcctctctctgctgcagaaaggaagtcagcatccctgtcttgctcttcatttccactggagaatgcgaggatccctcctgtgcatctccacactcttagatcacttgttccataaagttctggtccgcagggctgccacctactgcactgtgtgccctgtgcttgcccgtgctgcacttcccacatcctaggcaaagtgcccagttgtgcagcattcgatcagagattagccttgctccccagaggacatgggcacggccataaacaaatcctggcaccaggtgctcagtggatggcgagcaactgtgagttgtacccagagtggggcaggggcagggaaaatgtccctgtggagaagttgactggcatcagacctgggtgatggcagaagcaggaactggcaaagagcgaagtgtgacaagcgcttcagaatcagggtgttctgacctccccacctcacacacctgccctgccgaggcgggtgcatctctgctttctccacctgtttaccaatcctttctcttccccatgtcccgggtcctcttcctggaaagtctctggcttctctcccgttacactaggatagagcctggttccaattcttggtccaaagacaaagtttgggttggccctcccttgccttgaatcctggtctgccttatacctgccagatatttctgtaacccggcaggtgctggaaaccttctgccagcgtttgagacacatttatggcaatgtgaagggagagacacaaaatataatcaactctcagggaggaggacactcatgttgagggaagcctttgtatgaacagcgggcaatgctcaaggtagccacatgtgactcaaactctactcagctcattcccgagtgtgatagtgggcaggtggctctgccaacctacgcctgatttcttatctctaaaaaaggacctgcctcacgaagtttggtaaagatgcctggctgatgtatgcaagccactcccatggccccgtggctcgcctgcgtcacctcagcaggtggcagctgtagcaaccaccagcgtggggatgccggagaaggcttttggtgttccagaggcagaagccaagttgtgtgaaacgcggaagaggacaagtgtctggtcatgactgcacagtgggaaagtatgagatcagagtgtgtgcagctgtggggtcctgggtccatttattccctcgtgagccatcttattaggccccgttacaggcactgtgtttattgcagcgaacaagacaggtgcaggccttcccaactggggtttatgctccagcgggggacgcaggccataaacaagtgggtacgtcacgcagtctgatgacgaaccttgatgactgctatgaagatctaacagggcaatgacccagggaaggcccagggctgggagagctcttttggatgtgatgttgggaaaagcctcttggaggtgatgttgaggctgagtcccgaatggaggcagccctggtgtggaaaggagcgtggtatgttcaagggcggtccgcaccaggcctgctcggaaagctgccacactgaccatgggcaaggagctgatccaacagactgctcggttttctaaaacggcaggaagcgtgtggcacgtgagaaaagagtccttagaggcagatggacctggatttgatcctggctctgccacctggagcccaggactttgcttcctgagctcctgcatcttcacctcagaagttggggcttgaggcctaagggagtaacatgagcaacactcctggctccctgcctggcgcatgcccattacccctgggctcagggaggtgaggctgcccgagagccctctggaaatggctgagcagcaaccaaggtcaaggcagggctcgtcatctgtctgctcccttggagttggaacctcgactgcagggttcgggtgttggggaggcagcaggagtggagatgagtctatttgcaagccattgagtcttgcctttcaatgagacaagaggaatccattagttatcagccactgcagctgcttctcaggaaactgccttaccagggacttcctgttcatttctcaaaggccgtggtgtgatgtgaggaggaccaatgaaggggctttttcaggcccagccctgggccctgactttggcagctcctccgggcctctcccagggccttgctcattttgcataggcggctgaggctctggtggggactgatcaccccacccagagccagcaaagctggtcaccactgcaaccctgggctcctccctgcccgcaccctgggcctcctccctgcctgcccccccaccccagccctcctccctgcctgcccccagggcctcctccctgcctccccagggacttctccctgcctccccagggccctggaatagcacgtctcttttccctgaaaatactcttgacctgatcctctgctaccatcccttttcggctcggctagtgggtcacaggcattttttaagaaaccgtgggcccagttttctcctgcacgaagtgttgctttgtcagtctgttctagacacaaatagaacaaagaccaagcaaaggacttgatgccagcaatgcagtaaggagatgatgggagactggcagttacccttgggagatccttacgtgtggggctgaaaagatttccaggagtggttagcactttctccaccttcccccgaccctttttttttttttttgagatggagtctcgctctgtcgccaggctggaatgcagtggcacgatctcagctcactgcaaccttccacctccctggctaaagcaattccctgcctcaacctcccaagtagctgggattacgggcgtgtgccaccacacctggctaatttttttttttttttttgtatttttagtagagacggggtttcaccatgttggccagtctgatctcaaacttctggcctcaggcaatccgccgcctcggcctcccaaagtgctgggattaccgcacccggccccctcttctttttaattttgaaattttcccaacatccttaaatgttgaaggaacaagcaaacacctgtgtatcctcaaccaagattcactagtcttaacattttgccacatttgcgtttttcctctttatatgtgtgcagttgccttttgaaaataagctgcgtcattgtgtgatcacatccctaaggtcttcaacatttccggagaaaaaaggaagagatgctctaacatcatcacagtacctttgtcacatttaagaaaattaatagtaattccttgatatgatcaaatatctggtccatattcattttttctcattcaactcccgaaaaacctggtataacttcttttttccttcaagtgagagcctgtcacattaaagaattgcaggatgttgttttgtttgtttgtttgtttgttttttgagtcaaagtctcactctgtcgcccaggctggagtgcagtggtgcaatcttggctcactgcaacctccacctcctggtttcaaaggattctcatgcctcagcctcctgagcagctgggattacaggcgtgcgccgctacacctggctaatttttgtattttcagtagaggtgggatttcaccatgttgcccaggccgatctcaaactcctaacttcaggtgatcgccctgcctcggcttcccaaagtgctgggattacaggcatgagccactgtgcccggcctgtttgttttttgagacagggtctcactctcttgcccaggctggagtgcagtggcaccatcattgcttattgtatcttcctgcctcagcctcccgagtaactggagttattggtgcaggccaccatgcctggctaattttgtttattcttagtagagacaggggtcttgctatgttactcaggctggtcttgaactcctggcctcaagtgatcctcctgcctctgcctcccaaagtgctgggattacaggcatgagcccctgcgaccagtcaagagttgcagtttttatatcattttagtctcttttaatctagaccatgcttccgtacttttgttttttccacaaacttgtatgtttttccccagctatattgatttttctgattgtttctcatggtggagtttgactggtttgccaatcctaccaatgtctggaagcttgatttgatgcagattacacagtgttcaccactgggacattctattgcatcccctcaggggagcctggtgctggctcatctctaatagaaatactagattttttatgagataattcatgtaatatgcataatatgtatagaaaaaagctggaaggaaaaatgctaaaatattagcaataatgaccactttctgggtgatatttattttcctctttattctgctgtgccttttctaacttggccaaaactcagcacgtttttactttataattgggaaaaaaagattaaaatgtgtatcattatagcagtgttagagtttggaaagtaatgaaaataaagcaaggcataatccagctaccttaacatgtgcaataatagcctagatcctcctaggctttttttcaggaacgctttttacataattctgtgtttatttttttatttacttcatcacagcacatttccagtgccaaggtagtattcggtcttgtccttttcattgaccaccctggacatgtaggtgaggaactagtaagagatggtgggtggtgtggtttgtgcaccatgcaaggcactcagctcacgagcagtcgaggctcaagtcctccctgagccccgtgtctgcctggtgcgccttcctggagggtcaccatttcccgacctgcccaaaggcagcctatgcatctattcacaaacccctggggagtgtagcatgcctgcaccagcacagaagcccaggtggctgttgccattggcgttgggcactgagggctctgtcctggaaaaatgctggagacggcatttggggccagatcacaggagaccccgtttggtgtctgggtgcacacatggagctgttgctggtgagcactgtcctccttggggcccaagagcagacagagttcaggtcttagcctcatcactgccctctgctctccaggatgccttccgcgccttccaccctgacctggaattcgtgggcaagttcttgaaacccctgctgattggtgaactggccccggaggagcccagccaggaccacggcaagaacgtaagtctggcttgcaacctgggtgggggtggagacgaggctgggggtggctgggagtctgagagaggctccccttgccccatgaccagtaactggggctgaggcaggggtgcttttgtcctggaggagccactgtggttcacctgtgttcagggagggcctcagagcctccctgggagccggggtttgacaacaactagtggcgtctcctctctcctggccagtttcattttccttctcctccatccctttccaggaaggtgccagatgacaatctaggggaaagacaggacagaaacaccgaaaaatgtcatttgatgacaagagtggctttggggtgtgtggtccggggcacctctttgagaaagaatgaccattccctggtcatctgttcattgtctgcaggtcagacgcccccctgggtgctgggcttccaggacagccatgtgtgaaaatagcaacccctgaggtctcatgggctgttgttttgttcaacaatgaagtctccatgtaaatggcggagccgtttatagaagaaagttgggacaggaggcaggggcagggcaggacggggaggagagttgttacaaggagaggagtggtacccacaggctgtgaccagggtggtcatggaagtcccaccctggcctcagcaagctcttcctcctcttgttgccagcctgggccagacccctctgtttagcagagccagggcaggaccagggtctctcccggcctggactcttggccagtcccccaccacccccattgcctctggctttcctgatgagctgcgggccaccctgcaggtccttcaaaggccaatgcccctcctctcaccttgccctccatggcacatgagatcacctgccctgtacccatgccagcccatgcttgtcccctcctgcctccttcgcaagtgggtccatctcccactctcacctccagcacctcctggcctgcggcttccccagctctgctcgtcctgccctgtagctcccttgtccatggccttgctccttggctctctccactgctctccctttctgctgcagatcctgcaccatttagcatccaagctcccaccaggcaccaccagaaccacccttcatagcaccttggtcatgccctgtgggtaccgctcctctccttgtatccactctcctccccgtccggccctgcccctgcctcttgtcccaagttccttcttcctcgcaatgccattgtgttcccagggccctccttgactccgctttgcctccctggctccatgtgcccgggactcacagccccctcctgcctgcctcagctcgccctcctgcgctagtttgtgtcgcccccaactcaacccctcaagacccaacagtgtgcgcagagcaagtggtgctctgtttggtggtggaaaatgcaagttttatttttcttttcttttctttctttctttttttttttgagatggagttttgctcttgttacccaggctggagtgcagtgacaccatctcggctcactgcaacctccgcctccaggttcaagcagttctcctgcctcagcctcccatgtagctgggattacaggtgcccatcatcatgcctggctaatttttgtatttttagtagagatggagtttcactatgttggccaggctggtctcgaactcctgacctcaggtgatctgcctgcctcggccacccaaagtgctgggattaaagttttcttttttaaaaaagtgtggtcaaccattttggtcatttgacgtgtacagttcagtggcatcaaataagcacatttacattgttatgtaaccatcaccaccatccagttctcatcttccccaaattgaaattccacatccattaagcactcactcctcattctcccacctctcagcccctggcaggcaccattctactttctgtctctgaatttggcctctccaaggacctcctgtatatggaatcatacaatatttgtcctttggtgactggcctgtttcccttagcatgatgtcttcaaagttcactcacattgtagcatgtgtcagaatttcctcccttttcaaggctgagtaatattccattgcatggatagaccacgtgttgctgatccattcatccatcacgagatctttgtgttgtttctacctttttcctgatgtgaatagagctatgaacacagggtgtataaaatgcaagcttttgagtcaaagcctttctctgtcactcttacctagctgtgacaaatatacaggccccagggctgtgtggggcatgtggtaacagcagctattgtagggactcctggagggtcgaggcttgtggcttggccccctcttgccacagcttctctgggttgtgcattggctgttgaaatggcagctcgagacatatgttccctccagagtggctggtggctgactcctttccctgtgctcttggtcaacagtcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggtgaggcgtgacaccctcacttcccctagctgacagaggcctggtgcctgtttgctgaggctgtgacagcacgtgtgaccctctctccccaggcccaagctggatggctgcaacatgattatggccacctgtctgtctacagaaaacccaagtggaaccaccttgtccacaaattcgtcattggccacttaaaggtaagtgtcagcagccctgggcatctgtcctgttggacagcagttgagacagagggaccaggattcctctctgctcagtgctctgaggctacagggtgacaaggcaggtgtgcctatgctgagggccatggtgactctccattctgctgacttcctgagccctgtctctggatcaggtccgaaccacaaagccatggtgtactactcattatgaagacaggcacacacctttcttgtcttttggctcagcggattgtattttttgatgttccttagctaaggactcatctaacaaatctgtttttgtttggggacagtaaagtagcagtatttttttttttttttgagacagagtcctgctcttgtcacccaagctggaagcaatggtgtgatcttgggtcactgcaacctccacctccgggttcaagcaattctcctgcctcagcctcccgagtagctgggattacaggcactcgccaccatgcctgactaatttttgtatttttagtagagatggggttttgctatgttggtcaggccggtatcaaacttctgaccttgtgatctacctgccttggcctcccaaagtgctgggattacaggtgtgagccaccgcatccggcctgtagcatcttttttgatgagttggtatgcttcctttcactggggatgtgagctctttaatacgttgtgctgggtgtggtggcatgcacctgtaatcccagccacctgggaggctgaggcaggagaattgcttgagcccaggagttcgagaccagcctgggcaacatagtgagacccccccccatctctcaaaaaaaaaaaagaaaaagaaacacattgtgctcctctcttcccctcagaagccaagaggtacaaagcagcatttgaaacagcaactatctttagtctgtgtttttggtgcccccattctctccttcctcatctggcatttatgcttttatctttattttagccttccgttatatatgagtcttttatctcaagccacttcaaatactctttggaaataagcggggtacaaaaagtaaaagtcatcctataaggcctcagataggggacaccaaactacggaatgatcagctggcccaaaggacaaaagtcattagaagtgcaggagttaaggaagttccactctcacctccccctagataaggaagcagaccacagagtctcagcatgtttgtagaaagacaagctggaattgccaactgccttgttctgatctgacaggcgttatctcctcagttttgaaaatgagtctttgccaacttgctctctgaaatagactatccccatcccagcctgacccaacagtacctgcttcctgagaaaagctgggtcctaaagaatccatccctccacaccctggcaagggacgagctacatgtggggtgtagcttatcccctcttccacccagaccgcaacggggcccttggcttgccggctgcagatctcactggtggccaaccacccctgagctggtcaccagtttcgcagcgagcagcttgcctggccctgagcctgaagcggcctgagaacctggtctctgtccagaatctcaggggcaaagggagagggtgcacatagtggagtgctttgtttcattttatactcttctctgttggatcaaaccctcctcagtatggcaaagtaacatttaactcctgacccatgttagcccccacacacttaacaaagatgggctgtgtcctgcttccagattctgggcaggggccgggcaggggggattgttcctgtccaattgccctcagtctttgaggggccccagagcacggctgttgcgtcaggcgggagacggggccaggacagaggactggtctccatgtagaacgtggatgacagcaaacagggtccttgggcttggggatgtgggctccactcatggcccaccagcccccactggctgtgtccttggtgctgtgtcacagagacaggccaaggacatggacatgtggctcactcaggggtgccccagagcacggaggtcaagcttgcctgaaattggctctagcactcggcaggtgcacagccatggggacaaatcttgtaggtctgtgtctcttcccatcactgggaaaaaggggactggctacagggaggtcctcaagggcctcgccaactcagatgtcttagcacaggctggaaagacctgtgagtaggttaccaggtgctgtgagaggctgggacccccttcttcctgttggctgcactgctaatgggatttaatgggagttcttcacatcctgacctgtttgccttcagcccgtgtcatgcccagtggacatttcttccaaagtgtgatcttttacaaagacgattctgaggttaaaactctttcgtagttcagcactgtacttaggatgaaatgcaaacttcagccaggcacagtggctcacgcctataacctcagcgctttgggaggtcaaggcaggaggattgcttgaagccaagagtttgagaccagcctgggccacatagcaagaccctgtctctactaaaaataaaagaattagccggggatggtggtgcatgcttgtagtcccagctactggggaggctgaggccggaggatggcttgagcctgggatttgaaggctgcggtgagctgtgatggtgccactacattccagcatgggtgacagagtgagacactgtctctaaataaataaatgcaagctgaaaggcccagtgccatctgggcgctgcatctggaaatggacatcaccagactttctgcagcctcatctcaggccaccagggctgggattagggtgaaacaagtaaggcactcgcttagggtataaaatctaaggggacaccagacaaattctaaggggacaccagacaaattcagttatcaagataaatgatgttttaatgcaatgtggttttgttttgttttttgagatggagtttcactcttgtcgcccaggctggagtgcaatggcgtgatctcaactcactgaaacctccgtctcccgggttcaagcgattctcctgcctcagcctcccgagtagctgggattacaggtgtgcgccactatgcccagctaatttttttgtatttttagtagagatggggtttctccatgttgtccaggctggtcttgaactcctgacctaaggtgatccacctgccttggcctcccaaagtgctgagattacaggcatgagccaccacgcccggcctgcaatatgtttttaaaaaaatcaaaattaatgcaaaaaaatccacaatgaacaaaatatcaaaattttaaataaagatcaggatgaactgagggaaatggaaaaacatgcaaccctctaaacatgttcgtgtgtcattttttaatggttgattttttttccagaggattaaagtagttaaaaaaatatttaacaatgaagaagttgatgtattaaaagtcataacattctaagtgtaaatgctttatttataccaaaacagaacttattatacttttgcttcagttgaatgtaattagaaattagttaagaccgggcgaggtggcttggccgggtgtggtggctcatgcctgtaatcccagcactttgggagggtgacgcaggtagatcacttaaggtcaggagttcaagaccagcctggccaacatggtgaaaccctgtctctactaaaaaaacaaaaattagccaggcgagggtgctcgggaggctaagacaggagaatcacttgaaccagggaggtggaggttgcagtgagccgagatcgtgccacagccctccagcctgggtgacagagtgaggctccatctcaaaaataaaaaataaacataaaaattatttaagctaatcgcttggttgacagaaaccatcaaactcagcaattctttccattgaaaatgaaatgaggccaggcgcggtggctcacgcctgtaatcccagcactttgggaggttgaggagggcagatcacaaggtcagaagatcgagaccatcctggctaacacggtgaaaccccatctccactaaaaatacaaaaaattagccgggcgtggtggcacacgcctgcagtcccagctgctcgggaggctgagacaggagaatcacttgaacccgggaggtagaggttgcagtgagccgagactgcatcactgccctccagcctgggcgacagaggaagactccgtctcaaaaaaaaaaaagaaaaaagaaaaaagaaagaaaatgaaatgaggcaaaaagtaggctttgaaaatgttatcgatgagtttgtttccattaaagccagaagtgcactttttttttttttttttttttttttttttgcctcaggctctgatatggcgccacccagcactgctggtcacagttataccgaggagctttcctctggcttctggagcactctacactcccccttcctctcccagggcctcccgtaggctcttgcctctgtcaggaaagcacccctcactctgcctggccaacttctccagctgcgtggacacttagctttcctggccccagctcagtttgggtttggtgtgatgaggccagaccctccctcgcagctccgtgaggacaagggctttgtctcttggttcacctcccaggcagagcacggcagctggcttagggtaggcaacatctgcaccacattctgggaacacggagctggccattgttcctgggcaaggcgggcttcccggtgcccggaaggaggggctcttgaaggacaagcagggcttcacctggcaaagaagaatggaagagaggcccggtgcggtgggttatgcctgtaatcccagcactttgggaggcggaggtgggcggatcacctgggttcaggagtttgagaccagcctggccaacatggtgaaaccccatctctactgaaaatataaaaattagccgggcatggtggcgggcgcctataatctcagctactcggaaggctgaggtaggagaacctgggaggcggaggttgcagtgagctgagattgcaccactgcactccagcctgggcgacaagagcaaaactctgtctcaaaaaaaaaaaaaaaaaaaatggaagagaatcacagcagaggaagtagcatgaacaaaaaatgctttcattacatctcatcccgagtccagggagaaccgggactgcccacctcactgcctccttgttgtcagcccgtcttgctttcctccatctgtttgttcaataaacatctctgggttggtatcctccaaacatcacgcttacttgtttcatgccttgctcctcagtttctttgtgccagagatttttccatttgattcttcccaggaattttgttccttttgacaacaaacgcaaatgtgtcatttgattcctcgagcctctaagctttctttctttcttttcttttttttttttttttttgagacagactcttgctctgttgctcaggctaaagtgaagttggtatgatcttggcctcctgggttcacaggattctcctgcctcagactcctgagtagttgggattacaggtgcccgccaccacgcccagataatttttgtagttttagtagagacggggtttctccgtgttggccaggctggccttgaacgcctgacctcaagtgatccacacgcttcagcctcccaaagtgaagcctctgagctttcactctctgactttttttttttttttctctctctctctctctctcatgggttttgaggcctgccagtttccagggccctgaggttactgcaaaggccacagctgtccgttgctgttcccacccatggctattagtgtccatagactgtgtgtgccaaaagcatctcccaagtaaaatgtttgtttagcaaataggcattttttgcaaacccttagccaaagcattgatccggcaacagttcaccaggatagtcgtgatgccaaagggtcaggaaagtgtgttttctttcatctgtcgctgggcaactgtcgagggccataactctgagctgaggagacggacacctgtggcctcaaaagaaatatccatgttatgtgtcttgtctcatgggatcctatttgagtgttagaaacaggaaagttcttcttgttcatgttagcagttgtttgttgagccctccctccagccttcctggtgtgacacgaatctcaggacccaccctcagcatagcagcacaactgcgctctccaaatcgtttattgagatacagttctcactttttttttttttaaacagagtcttgctctgtctcccaggctggagtgcagtggtgtgatctctgcctcccgggttcaagtgattttcctgcctcagcctcccgagtagctgggattacaggcgcccacaaccacgcccggctaatttttgtatttttagtagaggcggggtttcaccatgttgcccaggctggtctcaaactcctgacctcaagtgatccacccgcttctgtctcccaaagtgctggaattacaggtgtgagccaccacgcccagccagttttcccatttaaagtagacaaatcaatgacttttggtatattcacagatttatgcaaccatcatcatagtcgattttagagcatcttcatgatgctcaaaagaaaccccacgtttcttagccatcacatcccaaccccctcactccctcccctaccccaatcctagccctacacaactgctcagctttctgtctctatagatttccctattctgggcgtttcatgtcggtggaatcatgtgatatgtggtcttttgtggctccttccttcccttagcatgttctccaggctcatccgtgttgtagcaagggtcagtgattcgttctgttttacggcacagccaaatgatattccactgtgtggataatctgcatttcattcacccactcatctgttgatgaacatttgtgttgcttttgctcttctggttcttttgaagaatgctgctgtgaacactgctctatgagttggtgtgtggacatgttttcatttctcttggatatacgctcaggagggagatttctgggccacatagtagggaccacttctcactgtccctgaaacctcggctttaccttgcacagctctggttccacacctggtgacggagaggcagagactggctgccacacctgctggagcgctcaccgtgtggtccctcagcagcacgcctcatctgccaccatcgtcttatgatcagggaaactgaagcctagagagataaagtgacttcactccatctggggctggcgcatgctctgagctcagtcatggcagggctggattctggccttgtgggggcctgaagtgctatccccgagggttgaaggttccgggaactgctcctaagaagggcctgttacaagcgagctcggttccctggtggcttgcatggctcatccccacccctctctccccacagggtgcctctgccaactggtggaatcatcgccacttccagcaccacgccaagcctaacatcttccacaaggatcccgatgtgaacatgctgcacgtgtttgttctgggcgaatggcagcccatcgaggtacgactaagaggatggtgttgacctaggaagtgtttgtcctgggcgaatggcagaccatcgaggtacaactaaggagatggtgttgacctaggaagtgtttggcctgggcgaatggcagccatcgaggtacgactaaggggttggtgttgacctaggaagtgtttggcctgagcagggagcagggaaggaagcctagagagctgacattcagccaggcaggtccacatctcctgctacacagatacctctcctaggtaccctgaattgttctggctggaatgtatgtggaatggcctcacctgtaaatacagacacagctcctcattagaatggtagatgtctccctcctacccttaggccaggaagggcattttctggcttgttttttcccagggtagagggaaatcttgttccagttcagcaggaaggcaagatttcaggggctcaagcttggtcgccaaccgactagctcatgttgagaaaaccttatttggagaatcatcatcctgtacactgggaggagcctcaacgtggcttggtccaatctgcttcaccagtggataagaaattgaaggtcagcgagaggatggaacacgttcagggtcacataatttatttagttttttttctgagacggagtcttgctctgttgcccagagctggagtgcagtggcacaatcttggctcactgcaacctccgcctcctgggttcaagcaattctcctgcctccgcctcccacgtagctgggattacaggcatgtgccaccatgccaactaatttttgtatttttagtagagacagggtttcaccatggccaggctggtctcaaactcctgacctcatgatctgcctgcctcggcttcccaaagtgctggtattacaggcatgagccaacgtgcccagccgagagagtcacgtaatttagtggccagtctagggtgaggccccagacctttggactgctaggccattgccttccatttactataccattttattttcatattagttcattttattactacaaatatagaacacacttggtataaacttctaaacagtacagaaatatccagaattaaaacacgagtctcagcctgggcaatatagcaagaccctgtctctaaaaaaatacatatttttttagttagccaggcatggtagcacgtgcctagtctcagttattggggaggctgaggtgggtggatcccttgagctgagcccaggaggttgaggctacagtgagctatgatcacaccactgcactccagcctgggtaacagagcaaagctatgtctcaaaaaagaaaaaaaaagtgagtctctcaaacctcccctttgccccaaattttatgcccttgagggtaaccactgttaacaagatgctatacagtcttctagatatttttatatgtgtataaacatgcatatatctgtttctttacaaacaaaaattttaggccagctgtggtggctcacacctgtaatcccagcgctttgggaggctgaagtgggagaagtgcttgagcccaggagttcaagaccagcctgggctacatagtgagaccccatctctgcgaaaaatacaaaagattagccaggtgtagtggtgtgcgtctgtggtcccaggtgcaggggaggctgaggtgggggaatcacttgagcctgggagcctcaaggctgcaatgagctatgattgcaccactgcactccagcggggacagaagagggagactctgtctcaaaaataaaaaaataaaaaacaaaaaaattctaccttgtatcctgcaacttgccacctctgcgaatgtggatgcccttcccccccagttcatgtagacaggtctcgtctccctctagccatatggtattctgttgtacttctgaaccataacaggacctacattattttatatggtagacaaattgagtgtcagtagttcataatttctttcttttcttttcttttcttttttttttgagacagagtcttactctcttgcccagtctagagtgcagtggcacgatcttggctcactgcaacctccacctcccaggttcaagtgattctcctgcctcagcctcccgagtagatgggattacaggtgcacaccaccacgcctggctaattttctcatttttagtagagacggggtttcaccatgttggccaggctggtcttgaactcctgacttcgtgatccgcccacctcgccctcccaaagtgctgggattacgggtgtaagccaccgcgcctggcccataatttcttttgaataaaagccccaccaatgcgttccacaaaaaaatgttcttatttaatacattctttttttttatgtagagcctctatgtcgggacctaatttagaagaaaaaaataaatatatgcgctgctttttggaaatacattaatgattaaaatgaaagtttagaagatccttgttgcttttatgcagatcttaggagccacaaagccatgcatagagtagggttcaatcagcatctgccaagtgaggccaattttccctcactaaggagtggcaccgtgagtgaagtagtattcccgacagccttggcgcctaaggcttggaacaaggcgaggagacagcctggctccccagttctggtttgtacaccctcttcttatttcatttccacccgtgagactatctgagcaggaacgtggatttttctgtaacatggccaattcgcaggaaatcagccacagttctgtactttggaagcctctctaagctgccagggattccattttctgccaaagtacaggctattgttattcttctaggaaacagtttgccagctttaattagaggtgtctagaaaacagaactgatgaacttgaggccctctgataagtggggacaaaggcttcattttctcggcgaggctttgtaatgtagagccgttggctgtcctgacagatgttctctgtgtctccaacaaagaaagtctagtcccaccagctgcactggcaagaaggcgtctttcttgtgcgtggtggccagagaagcctctcctttcccgacatcttctcacccccgacacttctggaacgctggctttggggcaggagataggggtgggaggctgtgaggatctggttgttcagttaccagcggcgtttggaagtccccagccagtgccgcggtgttctgtggaaatccccgctctcacactcatggggaaaggattggtgcttcctgggttcctggtgttttgacctgtgctctggctctcgcaggacccggccgccctggaaggaaccctggtctcttgactgaagtgacagtgggtctgatgggacttgtcacatgccagtcccacacaccacagcagggccaggtggggcggccaggtcccagggcctcaagccaccatcccagtctccagagcaaggatgccggccagggcttctatctctggggacagataagcaaagcagccctgccaagcggctcccagcacgtggaactgtgaatagcgcgggctccgcagtaaagcccttttcctcgttttctgcattttggtcttattgatgctgtccaggaggattctttttgtcatatgtagcaaagtatattcactttacccagagattcatttcttgtgtgcttagaaagttcttcatacatattattttcagttctttaaggttttgtgtttcaatctttaacttctgccaaatgggatatgggtaggatgatgttcggccttcacttttctccagagtcggccagttttcccggcacccccatgaggtggcattgcttcttcatatgaggcagtgagtgctcctgagcccgggcttggcctgggctgggctgtctgtcctctcccaggccaccgtctggatgacttgggggccacactcacactcattcatccttggcacttaactcattggaagctcgtagtggggtgcctttccccttctctttctctctctttttgtttttgtttttgtttttgagacaaggtcatgctctgtcaccttggctagagcgtagtggcgcaatctcggttcactgcagcctcaacctcctgggctcaagccatcgttctgcctcagcctcccgagtagctgggactacaggcacccgccaccatgcccggctaattcttgtatttttagtagagatggggtttcaccatgttggccaggctggtctcgaactcctgacctcaagtgatccgcctacctcagcttcccaaagtgctgggattacaggcatgagccactgtgcccggccaaggtctgtacttctttatatgtctcatggatgtttcttttaaaacgcaatccttatatgttttatattttgtcattatgattggaggttctccagtactcgggaaagcagtggatattggggtagttatcttaattttcttttttttctaaatttttgtttgcatggccttccaatgaatgggatagttatcttttgtcccgctagtgtccacttacgtctcttcgtaattctagttgtgtttcggttgattcttttgagtttcctgggtagatgatcatatcctagaaaataatgaaaacgtagtctctcggcccagcgtggtggctcacatctgtaatcccagcactttgggaggccgaggctggcggatcacgaggtcaggagatcgagaccatcttggctaacacaatgaaaccaccgtctctactaaaaatacaaaaaattagctgggcatggtggcacacgcctgtagtctcggctactctggaggctgaggcaagagaatcgcttgaacctgggaggcggaggttgcagtgagctgagatagcaccactgcactccagcctgggcgacagagtgagactccgtctcaaaacaacaacaacaacaacaacaacaaaacaaaacaaaacaaacagaaaaaaagtgtagtcactctttctttcttctctttctttctttctctctctctttctttctctccctccctcccttccctccctccctcccttccttccttccttccttccttccttccttccttcctttccttctttctttctaatctggatgttgaagtagtctctttctttctaatagctccactctgttttctgctttgggttttattgcattgacgggaaatttcagagctgagtttaatagcggtgatattggcagcagccttgttttgttcttcttttgccatatccccgttttctgagggggctggtgagaccattatcccggtagcagtgtaaaggggcctcagaagccgtgcggtgcctgagatcctcctcctcctcccatccgggaaaccacctctgctgctctgactgtctgaagctaacctcctgggcttcctgcttgaggcagaccttcatgaacaggcttaagccacccatcccgccttgggacacacatgccgccctctcagggaccttggactgggaccttgccattctgctcctgctggggaggtcgtgccgcctgtttctctctgtgtgtgagtttgcaggttcccagaggcagagactgggctttgcgacagctcccctcccccaaccctcgatggacaaggagggcccttgtcattcctcagacattttgttccaaagctgaaaggtcccctccacatggcccggcatcccccaggccctcatccaagcctggccttgaggtgcatggagaggccgaggacaggagagtcagccccgccgccagggctggctgcactccctcccttgcccctggcctgcgtctctgcctgtcaaccgcagcctgggaaggcactgttgctgatcagggggaggtccatgtgtgccacccacacccttggccgcagcccagccaggtgaaagtcatgtgtcttccttgcctcttgggctttctctgtgtgtgtgacggggactcctctggaggaggagatgtgtggggtcctccactccccacacttggggctctgagcccccagttgggaagaagcctgactcttgttgagtgagtctgtggaccgggcactgtgatgggcagtgtgcgtgcacaacgtcacttaatccttgcttaacccgtgaggcgggagctgtcatcgacccatttcatggatggaacagctaaggccaagagacatgaagtgacttgttcaaggtaacagcaaggaaaaggcaacaccactgtccgaacccaaaccatctggctgcaaaccacagcttcggagtcctgggggcccttgtgaaatatgtttgttgggtagccccagctttctgatcaattaaacagccaggcactcacccccctagcttgctacattctaaaatacctctccctcccttccctggtcccatgacttaaacggcaaagctctggcaaagaactgagcgtgggaaagatgagagcagagagttagccacagggcagggcttcgtatcccaaacccacagttgtactttctggtttgggaggggagtactggccatcccccagcagagccgctgcagctgaggccatcgagatgggcacagatgtgtagtggtatgtcaccatacgcatgtacatacacgtgcgtgactgtgatgagcattttgctcaccgtcccacagaggcccactctgaggcctgctgctgcctggcaagcaggaccccctggctcccgagggtcattctggggcattgaagggacgcacactaaagccagcagtgcttaccagcagaggcagcccctgtaacctgtgttgtccacccacaggccaccatcacccatgagaacagggtgcctactgtgcacatgcagctccaaacagactccccaggtgcctcccaggcccccacaacagcgtggccagccctcagtccctccataggatgccctggcccctgctgacctgcctgggttgccctctgtgctcacttccgagtacagccggcccagcccgagagggatgggatgctctgtgggacagagatgcggtggggaggagctcttgagcagagctggagacactgcatgccaaggctggggctatgagcctgctccctggcctctgggagaagcttagagcaggactcaggggcctgttctgtgggccactgcaggccccgagactggccacctcgagagcaacgtctgcagtgctggctcctccagcacctccgtccactggagactcatgaaaggctcctgtgaggcctccctggctcggacctctccatggccggcctcagccctggccttaataatagtcttcctgcaagtggccgtcctttctgggaatgagtgagatccttgccaaggctcaggaggccacacagaacaaagggactgtttctgggggttcttcagctggttgtgccgtgaccatggccattggcgccaagatgcaagtcttggggacagggtggacctggttcccacccacagcctcttccctcaggaatccatgctctccctgtgatttggacaatcattttactcacctggatgagaggggcactggcctaggcatcatccaaggtcccttccctctgtaactcactttgacctcctgactgcaataagtatgactggacactataggaggaggcatctctggccttcggatccaggggtatagggagggtgacgggcagtgtcctggggtcagcacttggcattatgcccatgttctcattggctcctcttaccaaccactgattcaaatgccagacaaggctcagcaaggctaagcgactcacatagtctcagcactggtgagaggcagagtcggctcaagcgcatctgctggctgcaagcccagcctccccacactgcaagggagaggagcaggtgtcactcagtgagcggcatcttttggtctcagtcctggaagtgcagggtgggctggtccctaggggctggaccatggaattaagggctccagggatcccctggggccgtggttcctatgcctggcattggacaatgacgatgcccaggacccagcccagccctcctccattagagcctctgggcatcaggctgcccaaggtgcaggctctgatggggaagaaaccggtgccgtcatggggacctcaggtagccagatgtggcctgaggagtctgtgctgtggcctcctctgtcctcaaggttaggctccagctggggaggagtgattcactcttgtaaattacagggaggctccagggaggcagatgctcccagcctgatgactggcagcaattctggggcccttacctaggttctccctgccactgcgggctccgggagctctccatggtgacctaggaactcccctgggtgcttatgctccgccgagagttgctctgttgcacattcattcaacaaacatttgtttagtgcctgtcacatgggctcagagtcagctttttgggttctgatcccagtcagggccacttcctgtggccttgggccatggcttaacgctgagcctcagcctcagaagtgccggccttgtagaggatcgatgccatcgggccagtgctcggctagggctgaggaagcgttggccgctgctggctgtagcatggggagcccagagggctggaggggccccaggcttggtgggcccagggtgcagattgacaggaaagggacagtggtgtgccctgagcagatagaagggatggtggctgcaggatgggttggggaacatgggaggctgggagctgaggctactgggtgctcatgatctctcctctctcctcagtacggcaagaagaagctgaaatacctgccctacaatcaccagcacgaatacttcttcctgagtgagtgctcggcgccccgaaatcactctgggaccctcccctccccccagagtggcgtgtctctccctcctacctgacatctttttcagatccagaaagtgacactaaacttgttagaagcgggggccacagcagccttgctgtgcagacccctcagcctgcgttacaggcctgatggggacacagaggctcagagagtcccaggggtgacacacgtcctcaagggctcccagccttctctgcaggccccggggtccctggctgcttctgcccacgtctgcagggctggcccctgcactcagtgctgggcctgggttcccctgaccttccggcacaggcagcgtggaatggatgcctctaagcgcctgtctctctcctgcagttgggccgccgctgctcatccccatgtatttccagtaccagatcatcatgaccatgatcgtccataagaactgggtggtgagttggggacacagctggcttggcatggggaggagggtgactgggacagggggacccgggggtcctacgctgcctcctcgtgtgccccagtggagcctgtggggccccaggcatctcctccctggggtagctgcctctcaggaaaggactccctctggggccaccaggacctagtcctaaagatctctactctccctcagacatagggagtccactggggcagcccctgcttttgcagagcccccgagaaagttctcaaaggcagcaggatgagaggcaagtgtggccatctcccttccccgctccctgtgggccctgagtcccatgaactgggttgccccacaccctggtttgaagttggagcagctgggcgttggctgagatgacaggtgtggtcgtttgcgaagaccgtatgacaaagcaccacgaactgagtggcataagcagcagcgatgtgttttctcccggttctggagaccggaagtccaaaactgaggtgttagcagggtggattccttagggctctggaaggctctgttctgggcctctcatcggctggttgatggctttcgtcctccctctcggtacatcatctctctgcatatttgtatctgtatctgtgtccaaatatccctctttaaaaaaattattttgtttatttgtttatttattgagacagagtcacataggctggagtgcagtggtgtgatctcgactcactgcaacctctacctcctgggtgcaagcaattcttgtgactcagcctcccaagtacctgggattacaggcaccggccaccatgcccagctaatttttgtatttttagtagagatggggtttttccatgttggcgaggctggtctcgaactcctggcctcaagtgatctgcccgcctcagcctcacaaagtgctgagattacaggcatgagccaccacgcctggcctattttttaattttctttttttcttcaccaaaagtggattcttgaaaatttttccttttttttaaaatagggacattggtcatattgcattagggcccattgtaattacgtcatcttttttttttgagatggtgtttcgctctgtcgcccaggctggagtgcagtggtgcgatctcggctcactgcaacctccgcctcctgggttcaagcgattctcctgcctcaacctcctgagtagctgggagtacaggcgccggccaccatgcctggctaatttttgtatttttagtagtgatggggtttcaccatgttggccaggctggtctcgaactcttgactcgtgatccacccgccttggcctcccaaagtgctgggattacaggcgtgagccactgcacccggcagataaattgtttatctgaaaattatcaaagactaaattgtcactttctgaaatgcttgcttaaaatccagtctttctcagcagtctatttgtccctcatgctccaaccaatagccatggggaagtttttcctctcttaaccaaatgtggacttgtttattgattactgttttttgtttgtttgtttgtttttgaggtggagtttcgctcttgttgcccaggctggagtacaatggcgtgatctcggctcaccgaaacctctgcctcctgggttcgagtaattctcctgcctcagcctccgaagtagctgggattacaggcatgcgccaccatgcccagctaattttgtatttttagcagagacagggtttcaccatgttggtcaggctggtctcaaactcccaacctgaggtgatctgcccacctcagcctcccaaagtgctgggattacaggcgtgagccaccgcgcccggcctgttgattactgttttatcgcttgctaactgaagttgtccttttcaccctgactgtgaatttaagagcagccaagtcaaattttatctccaagtcttggacccatatatccaatctaactccatttggaggtgtcccagccattgcaaatccaacatattcaatgtaagtcctctcctcttctcccacaacctaatcctgatggtctccatgttaatgaatggctccatcatccacccagtggctcaagttagagactagcaccattatgttttttccctccttatacatgttacaccctctccttgcctctagcatccaatcccgttctaactcataagtggcctattgccgggcgcagtcactcatgcttgttatcccagcactttgagaggccgaggcgggcagatcatgaggtcaggagttcgagaccagcctggccagcatggtgaaaccccgtctctactaaaaatacaaaaaattagcctggcatggtggtgtgcacctgtagtcccagctactcaggaggctgaggcaggagaattgcttgaacccgggaggcggagcttgcagtgagcaacttctttttttttgtttgtttttgactgtgcttgttccctaaggaacaaagtattaaacaggaaaagaaatcaccctatgttcctaaaaggggatggcagagtggggacaatgtgatgagcccatggggctttcagagccaggagcgcacctatgacctggggcactggttctcaggggagctgttctgccctttggcagtatccggagacacttttaattgtcacaacttcaggagaggagggtgctactggcatctggtgggcgtctagccaggatggtgcttagcaccctgccatgccctggagaaccgcccatgacaacaagcagcctgtcccaggtgccaatagtgtggaggttgggggaccctggcttagaggaaagaggtgacaaaccctaagatctttgaaggaggcttcccggggagatttacatgctctggcaaggttccctgttcccggggccacgtcctggatcctgagatgctcccacgcttcaccctcctggaattttgctgtatctgacaccactggccactccctcttgcagttcttcctgttggcttccaggtccccacctctgctggcttcttcccaaccccctcgctccgcctctttggctgcttctgatctcttgggctctctgcccctgaaaccagcgatctctgtgtatgtgttgctctctacactcaaaagaagtccaggccaggcatggtggctcacgcctgtgatctcagcactttgggaggctgaggtgggagggatcacctgaagccaggagttttgagaccagcctgagcaacatgggcgaaaccctgtctctacaaaaagctgggcgtggtgatgcgcgcctgtaatctacctactttggaggctgaggtaggaggatggcttgagcccaggagtttgaggctgcagtgagctgtgatcacaccactgcactcaagcctgggcaacagagtgagaccctgtctcttaaaaataaaagttgggccagggcaatggttcacacctgtaatcctagtactttgggaggccaaggctggaggatcacttgagcacaggcattcgagaccagcctgggcaagtaagtgagacccccccatctctataaaaacttaaaaaaaattatccaggtaaggccagacacagtggctcatgcctgtaataccagcactttgggagcctgaggcaggcggatcacaaggtcaggagatcgagaccatcctggcgaacacggtgaaaccccatctccactaaaaatacaaaaaattatccgggcgtggtggcgggcacctgtagacccagctacttgggaggctgaggcaggagaatggtatgaacccaggaggtggagcttgcagtgagccaagatcacaccactgcactctagcctgggcgacagagcgagactccctctcaaaaaaaaaaaaaaaaaaaaaaaaaacagaaattagctactcgggaggctgaggtagaagtatggcttgagcctgggacagagtcatgatcacaccactgcactccagcctgggcaataaagcaagatcccatctccaaaaaaaaaaaatccgtaaccccatcctcattttgtttccatatatgtgtagatacactgcacactattgcaccacacacacagaatagaaggaatgtgatggaaagtgggagcagaactggctacatctgcctccctcctcaccttgaaggccaccttattggaacgtgaggtcctgccctcggccaatgttggccccaaggccatctccagcctctcctgagcgctcccttcctcctttcctgttcagctgctggcacccgacccctgatcacctaggaccagcctagattccccacagccaagcaggcacaaatgcagccaccgttgcctctgacagttctggaatctgtcacctccttgtcagtgccgtgggttctggtttaggcctctgtcatttcatgtctgagccgctggaataacttcctagtctccccctctccagtgggtggggatctattttaagacacaaatgtgaccttgttcttcagtcgtttgaagtgagacagggcagtcccttggcctcaccttccacctcggacacctgtgctgagcctgtggcatgtcaccatacctaaactcatggcaggatgagcgccctggcagtgggaacaggccatgcagaggccccggggagggagtaagctaggtcagggggctgagtaaagacaggttcttaaccccatgaggctccgtgggtgactgggtgggatgggggctttagcaggggagagttgggacctgcttggagcgaaggccactctggttgccatggccacgaggacaagcaggagactgtgggaagctgatgctgtggtccagttgagacaagacttgggtggcagagagacagtggacagggtggagccgtgaagtcaccctcccagtacatgagagaagacgtccaagcccagtccctgacaccagtccagccagaggcagggaggagagcagagtggagggacacaggatgacagtggggcgtggggaggccagcctctgctgtgagagctctgagatagggacgatggtacctctgaccttccctacccctccaagccctctgtcctgctggaaggagatgccaggaggagacccaggtgctgaggaggagggacaggactgggggacggttggggacctggccccgggttgggggcgcaccttcagaatcgcccttgccccacgagagggctgctgacccccacccctaccccatggctgcccctcagcaggagggtccgtttctctcccgaaaaacagggcacagtcacttcctgatgctaaaacactcagcatttccctagaaacaaaggcagccatgcaaaccccgagcaagcaggtggcgtgtagttgcccattgcatttcagtgggctgcggtccagcttctagaggcctgagtgtgaggtgtgtgcacatctggggcacgcacttggtgccagggcagaggagagggcaggttgcacctaacttcatctttccccgcaggacctggcctgggccgtcagctactacatccggttcttcatcacctacatccctttctacggcatcctgggagccctccttttcctcaacttcatcaggtgcctgggctttgctgattcatccctgggccctccactggcactgatgatggctttggcatgagaagaggctcggacggctccactttgcctggggacctcccatcctggccccttggcaggggctgtcctgggctggttgggagagtggatctgttcccactgtggctgggcccccggaggcccctgcgctgagctgtgttctcttgcaggttcctggagagccactggtttgtgtgggtcacacagatgaatcacatcgtcatggagattgaccaggaggcctaccgtgactggttcagtagccaggtagggaagtcagggccggtcaccagagcctggtcccaatgtccatgtcctggccccagatgatctgcacctgctaacacagggctgtgctgggcctcccggggctgcctgtgtccttttgctgggagcttcagggctgagcaagaaagggcagcaggaatcccccagagggacaggtggggcatctgggtgggctgaggccatcaggcaggacggtatgatgtggacgggtggcctggagaccctgggtaaggctgggccccctgggaatgaggccgggcccttgggccttcctttgttccctgacactcatcccctccactgacagctgacagccacctgcaacgtggagcagtccttcttcaacgactggttcagtggacaccttaacttccagattgagcaccagtgagcgcggggctgcggggaggcggggagacccacagcgggagggaagtggccgctatcccactgggcagaatgcagaatgtgggggccacctctttgtctctctgacaaggtctctgcccaatatagagcaaggctcccagccagccccgctgaggtcaggagaggggctcccctattccatctccctgagggtcatcctgtgcccctcatgctgtgccacttggtcatagtggttaccacctccctccatgtgggcctgggactttgtagttatggagcctgcacacgcacctcatgaccctgtgaggctagcagggcagggctacgtagcttgcctggaacatcggccgagggactgccctgctgccccttgtccttgcttcacctcttgtcactgtttttttttttttttattaaaaaataaaaaatgtagagacagagtctcaccctgtttcctgggctggagtgcagtggtgctttcttggctcactgcagcctcgaacgcctgagctaaagtcatcctcccacctcagcctcctgagtagctgggactgcaggtgcgtgccaccatgcccaactaattttttctttttttttttacttttatttatttatttattttgagacagaatctcactctgttgcccagactggagggcagtggcgcaatctcggctcactgcatcctccacctaccaggttcaagcaattctcaggcctcagcctcccacgtagctgggattacaggcgtgtgccaccacgcccagctaatttttgtattttttagtggagacggggtttcaccatgttggccaggctggtctcaaactcctagcctcaagtgatccacctgcgttggcctcccaaagtgctgggattacaggtgtgagccactgcacctggcctaattttttatttttattttttgtagagaagaggtcttgccgtgtcgcccaggctgatctcaaacttctggcctcaagtgatctgcctgcctcggcctcccaaaatgctgggattacaggcgtgagccaccgtgcctcacctcactgcctcttttcctagcattccccagctatttcatttcttttttgaaaaacatgacactttgtctctggccacccaatatcttcccagctccatagagcacaaacgccctcctgctcacggagggctgcaccctcccctccacacacgtggcaccccactgggcacacacgaggagccacactttgagactggtcctggctgtggacagggtctctgagggccccagccagcctctgcccaggtggtgggaggaagcgggagcagcatggccctctgagtcctcacgctctgcccaccctacacactcctcagcctcttccccaccatgccccggcacaacttacacaagatcgccccgctggtgaagtctctatgtgccaagcatggcattgaataccaggagaagccgctactgagggccctgctggacatcatcaggtgaggggtggaggtccacaggcgctgggccctgggatcacccgtggtgcagacagtgggatcacaagaggggctgggccctcctggcacagtcacccaccagggcacctgccttactcccgagcctgtgttaggagctgttgggcttttctccctgggctgcgagaagaccatccctttctgtgtggggttcctggtgggctctgagctgacagccccacaggcccagtggcagtggtaagccctggttagggccaaggggacatacatgccaccttaatgatggcctcctcagcccttgcactccctggggccactcccgtcctggtccctgaccctggtccatccccaactttgcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccagggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctcacttcctgtgtttcctgcacgccaatgccaggccatggtattgggtgatagatgaggcccttctagctgggcctgggcaccaggaggggtccccatgcttgcatctctctgtatcccctccctcccctgtggccatcccacccgcctctccctgctgcctctgaaattcattctggggcccggaacttggtggaaatgacccaaaaacattggcccatcttcctcctctcagcagccgaccccagcccaattctaaaacagggctgagagccacctctcagcagctgacccctacccaaggagggtggcatggaggggcttgcagagactcttcctaacatcctccccccccagctgtctccccaagtgcaatctgccctcccatccctgggccagccagcttccacagagcgccaggccaaacagaattcctggcctccttggaaggggctggagaaggccgggagcagtggctcatgcctgtaatcccagcactttgggaggctgaggcgggcagatcacaaagtcaagagattgagaccatcctggccaacatggtgaaaccccgtctctactaaaaatacaaaaattaggccgggtgcggtggctcacgcctgtaatcccagcactttgggaggccgaggcgggcagatcacgaggtcaggagatcaagaccatcctggctaacacggtgaaaccccgtctctactaaaaatacaaaaaattagctgggcgaggtggcgggtgcctgtagtcccagctacgtgggaggctgaggcaagagaatggcgtgaaccccggcggggcagagcctgcagagagctgagatcacaccactgtactccagcctgggcgacagcgagactccgtctcaaaaaaaaaaaaaaaaaaaattagctgggcatggtggtgcgtgcctgcagtcccagctactcaggaggctgagacgggagaatcgcttgaacctgggaggcagaggttgcagtgagccaagatcgctcactccagcctagcgacagagtgagactccatctcaaataaataaataaattaattaattaaattaaattaaaagggggctgaagaaggctctggaggctgatgattctttttgtggctcccgtgcccatatatgcaatggctcattcagaacccacaggctgtcgggggggctgatatcatcctagcccagggtcaccagttcataggcacagagattggatcctaggtctgtctgaccccagaggctgggaagagtctaaagcaacatgccaggggcacttgtacagtccgtctcccatggacccccatgctgctccgtcatcgtctctgggctggctttcctggcagggctgatcctgggaaagtgccaaggaagggccaagaggcactggctagttaacaccttggggcctccccttggctttgtagctgctcccagcagggctggggagggctcctgagtagacctcagcccccgcctgcttcccctgacccccgctttgcctggccgaaatccagccaggtagggacagccagcagactggctggggtacgtatggctccccagtggccacagggtgtcctgagtagggcctggcattacagaagccctgagcgaggtggccgactcaccccagattcaccaagtggctctggggagtcctttgccctccctggccctgtgggccatagtccacaggggcaggctagaggggccccaaggatgccattatctcaacacccgcttaccctaggccttgccctcctggtggacccgctggcagtggccttcaaggttacaagaccctggcaggcacggctcccaccctctgccctgtgcctgtgacccgcctccaggatggcgaccagcccaggcctcccaaccctaccagttggaaatccatgggtccatcacccataacaaccagggggcttggaattggggatactggaggccagatggacgctggggctatgagggcaccagataaat

SEQ ID NO: 16356 - DNA, 84171 bp, Human
ctaattcgtttatgttctttaaaatacacaccaccctgaacgtttacaagaaatatgaatagcataaaaaccctttgcatagttgaaaagccgagatgtatcttatttttattggcagttaatgtagaggcctatataacagctgcctcaatagccactagattagggacataaaactgcaaaacctgttccctgtgcgggaggggaaacagaaaaataagagaagcgccctcacccaggttttggaattccaagaaaggtgttgaacgcctgatgaagaattcattttgaatataactgtcttcatttagggagggtgtgtgagtgttccgtttgtctttgaaatgaaacctttccaagaggcacgtgttgatttaccaaagacagaatggcaagggggagcccagaggcaagaactggtgaaatctctcagaagacgcgggaagaagccttttttcccctgcaatctctcccgcctctctccagagtccaggaggaggcagtccccgtggcttaggctttatctttaagacaatagcgccgctcgccgccacccgcgcgactcggatcgggcatcccggcggccgcaccccgcgcgctggctcatctgcacaccggccacctgcattgtcggccagagcccccgtcccggcggcttccccagcagcttggctgcccctcaggtcctcccatcccaccttgcacctccaggacgccctggacccgcccatcctcctgccccactagctcatcgacttacgactccctcagtccctacggcccacggaaccctctccccaacccgcgccacagcccgagcggcggcggcggccttaagaagcccgcagtcccgcccgcgccgccccgccggggccggaggttggagccgggagcacggccgcgaatccccgcacgtccccagcgctccgcgacaccgggccctgctcgctgcaactcggggacggcctgcgtctcgcctccaccctggccgcgggcccctcgagcttgtttgcttgtcctcagtcccagggccagccccgctccctcctcccggctgctccaacagccgtttgcttcctgcggtgtgtttcttttttccccttcctagactccatcaaaggtggctctgttattgaaatatgaagccatttcctctccaaaacccttggttactcaaggcgggaatcaatggacctatatactctcccagaagttataaataaacgtctatttgttcaggaggcgttttcccgcgtgtcccagcatcttccccactggttatttcaggggtgtgtgtgtctgtgtgtgtgtgtgtgtgtgtgtgtgtgtgtgtgtgtgcgcgcgcgcgccctgtgcccatctggttctaatcctggttatggatccacaacccaaccccacccatcccgtctccccctcgcattcctcgttctataaataaatccaggttctttgagctctgtcatccaaggatacaatagcagttgtttgttaagagaaatttaaactcaacaccaatactgagtccagtaaaccagaaaatatgcttctggtgatttgggtggaaggccatctccagtttaagaagctttatgtgccactatcatcattgtctgttatccttgatctcctttggtgaggggaaggcgggaaagagaggacctctccgacccttggatttttcttttaagcagaggctaataaaacaaagcgcaaactgactgtcctgaggagtctgctcacaccgctgccccgcagatcattccacagaccccttgtcccatcccttctggacagacccaggactgatgagggttcgggttcgggaggtgtggtgtggtgggggcttgtgtggctgtagcggccggctttcctaaaccccagagcgggatactcgggatctgagcagaggggaaagtcatctaagaggctgctgctttacaaggtctgggcacagagctgcccctcccttcctccctgaagtttgcatgaagtgcacattaggctgtaattaggggatttgggaggagaactttcctggtgacgctttgcttttcttctgctcttggtgagaaagtgcctccttcttcccaggatcaggacctctgccatccagcgccacaaagagacattctgcacacacactcacacacgcacacacacacacactctcacactcgcccagagacaaacttaaggtgaggagaaagagcgctagcttcacttgatctccagcttccaacttaagcagaacttgagagcatccgaactcctggatttcaggacaaggtaaaacttgcaaattgtttccccctcttttggttatacctttgtgcctttaagatttcagagggcaatacacatgcaatgtatatatacattaaacaaattttattcttttcttttgagtttagttttcatttgaatttaatatgacacctcaacttttaaaaaagtttcatattgtcggataaaatatttcactacaataaacaggctcagtctaaaaatggagaaagaattaactctagtatcttagcttctgctagtgctcctgtaaatctggtagggtcatggtttccaagtggtgacttttctatctgtatctcaacaaccatttttatagcacctgagatgaaacaaggatagtataggctgaagggaaaggtgaggaatgggaatgtccagccaggcttatgaattttgtttcagagaatatatagggttatgtgaaaaagaaagttactttaggcataggtaatacctgttagattaataatcttagaaatgttgccatttttggcccaggcttccttctccagctaattatgaacttaagatcatagaatgatgatgcatttcatatatacaatgatgttgatggataatttgaatgcactgaagagaatttatagtcatagttaagattactgttaaaagttgcttaaagaaattatttgtatgttgagactgttccccaccaaaaacaaacctaaacttgtttgggcttcgattaagtagttttcttccattgaatgtgactgttgtgttcaaaataagatggcttattaatttgagaataagttgctttattttcatttatcactggaaaaatacacacagtggccagtacatttgggaatttttagggtggaaagtgttcctgtacatgttccagtgtgatgtcataaaatcaaacatactggctggcttcttggaagctaatagttcttaagaaattaaggctgtggattgatttctaaatgaatgtaatatttattcattacaattgtagtttctggtaactatttctatgtgattatttctgtgtactaaatttgcagagattttatacacatttcagtcatttcagtattttaatggaatgggaatattgttctatcaaaagtatatcatagtagttatctttggagaatttttaatgtgatatgattcataattcttatatcagttaacaaattccatttacctacaaaaatgaaagtttctcttccattcagtaaaatataatgtataccaaaggactcttcagatattagctttagtctttagtcacttttataccacccattttaaaaaatttaattgtttcagctaagaaatgaatttatacttttgttgatgacctcttccactaaattggaaacagcttaaaaacagaactagataagaagtaattttacttaaggctaattaaatgaacaagagataaccaacaacctcaacagaccactgctctacaggaggaatgtacccagaggccagtattctcgacaggaatgccttatgggcctgggctttctatgagaaacaagaaggtggggaaacattatgtacttatttataaaatgagccatttattttcagcaaggccctgtctctcagaggaatgactgacactgtaatttagaagtactgaagagactttcacagagaagaatcaattcattatatccctagtggtttcacttccttttccttcctttgggagcaagtaacacatccaggataaatacattcagagtacacagaaagatactttatgagtaaacggtctactaaacaatcctgccttttagcatcttaggtgtggaatattggtattttctgaacagttgaagaagtcctttgaatcttaagatagcaatgcacttcatctttgtaaagatgaacaaaagttatattcagaaaatgactcccttccttagaaaatactagttttctttttcatttctttttgccccatgcacattttatttttcagattgcatttttaagatcatgatctctcaccagttaaaattctgacgaaataccaggcaaatttgaaaataattttgatagtgcttcaaattaattttctgacatcctgcagccatgagtagtaaccatagtacttagtctatgtcatttaagtgtacttagcctgtcatttaaaggtagcaaaatgctgttggaagaagtaggaaaggatggaaacctgaatatacttaggattttaatcaatagtgtttaaggaggattagaggaaacagctggttaaacaattattaggagtagagaggacgaggtggtataaattaataatgcatctctttatttacactgaatgggagggtctgtggtggttaactgtgtgaagcatggtccctgtgtgccacctagtggataagtcaaagaaggctttctcaccggcttcttaaaatactctgactccctcggttgacgtttgttgaacattaactacacgccagacattgggataggtgctcagggtagaaactaaagcaagtgatgtttatataagttaaaaattaaggtacaactaaacagtttatgaaatccctactggttgtatttaagatcactttactctttgttggatactttaccattaactttccgcctccacaaggatatagcttaataactgcaactcacttctaatataggatttgttttagacagacaggtcatggaattgttcaaggactggtggaaagagtttgaccatcttaaatcactgttcctgaaatagaaataaatttctctaaggtttaatgttactgaatttagttgggaaaataactactagcttaaaaggttaccacacagctgcacattttgtttcatattctttgatttttttattaaattggaaaggatagtagtacaagttgtttttgagtaatgaggtctattttataaaatattgctctcaaacactaataattagcatgtaaaacaacttcatctatacttgttgttcacttggagttttgaagcaggaacctggcttccatgaagttgatctaatagaaaaaaaattctagacaaaaacaattacatggaaaaccaccacttgaaggaagcattaagataccatagaagattagtccatttgagtattgcactgagagctttaaaaaccttttctttaaaagatatacgaattatcactccaactggctctttgcaagttatgtgacaattgcaacagtgatcaggacaatcagcattaatcaatacaagttgtgaaattcatataggaaggtaaaatgcctcagtagaaaaaaatgatgaatttgttacttggggagctttgtaggtgtaatccaaaaatagagttaggcgtgctgttgtggaatggaagtttcctctttggaagagtttggtttttgtatggcagggaaacctacacagtgaaagaaggagacccgctcattaagttgtttttcattaatatcacaaaattataacctgtgctgattggaggtactgtttggaattagcatcatcaattatataaaataaagcagattatcttaatctttatttccagtagatcattatctaccaggaaaaaaacacattctgttaataatttcattggatcatccttgtgatttagaatgaattgcatactcattctagtgagagagctagtgagagactgcctaaaagtcagaggtccttaaagtagaagtttaatcataacttttctagtttttgtttttttttccttgagatggagtcttgctctgtcacccaggctggagtacaatggcgtgatcttggctcactgcaaccaccactccccaggttcaagcgattcccctgcctcagcctctcgagtagctgggactacaagcatgtgtcaccatgcccggctaatttttgtatttttagtagagacagggtttcaccatgttggccaggttggtctcgaactcctgacctcaggtgatccacccgcctcggcctcccaaagtactgggattacaggcatgagctaccatgcccagccttcttttaaagttttctgccatgttacaagaagttttaatgatttcggatgacttaaggatactagacaagaacaaactttacaagagaaaaccagccaagctctctgaaatggtctgatgcttatagttatattgcctttgctccacataataacttctcccactgatagagacatggaaggagatagctgttattaagagtttttagctatgtgtctcagagatagccagaatttaagtatcaaatgttgctgactattttgagactccactgattgttttacggcttaacaggggtgacacctgagatcagggtattgctacaagaccaggagactatttacaaaacaaaaagaaaaattcagagtaaaaataacttggaaaacttactaaagttaaagggctggttctcaatctgtttaagacaacagaaattttcccttctgcccaatctaacatccaaaaagaacacaatttactctactggttactaaattccaattactataatatccaattaaattaaataatattcaaattatgtttatggtaagtctagatttccctaagcctttcacaaagtcttatggatattccttggttttgtcttcattcatactctgtgaattttttttctcattttcgctctgttattttgaatttggaggatcacctcatttgatcattcatttattcatttgtttattcaacaaaaatgtattgagcactggctatttaccaggcactgtgctagtcccatgtgatccccctcattttacactatgaaaatccattctaaaataatcagaaagtcaaaactgatgtcataaacccgaaatgttacaaggtcctgaaatgtactttgagtaacaaaaataaccaaaaagttctggcctcatagttttggtattaagaaaattttgagcatgcatttttaaaaattattttcccttgtgtgcaaatgctgagctgagtggataacagctttgtttcttggctgtgtggacacagatgggcctggaaaggcagttctgacactccaaaaccccaagaggactagggttccaataatatgtctgcttggatggacaggaaacacaaaaatgcatttgcacagaattgttgtccaccagtatgaaactaaagttcagattaagcaagaatgatttagtgcttaccatttgcaccaggcaggcaccacgctaggtgttgcatagtaattggctcaaggagttcacaaaccagtggaggagacagatggatacgcatcatgaatcactagtaaaatttgccaagtaggtgaaatttgccttcctaatttcctggctccctttctttgcatttacccaagccttctaacccctctatctcataaaccgagactcctgctctctacccctgcatcccagaggatctgatagttctctggtttattgatttcttgactacatttaattgtgaatgaggttcactcatgcattacacttaagtgtgaatgagtttcactcatgcatttacaatttaagtcctttatttctttaaagtaaatgttttgttttctgtaaaaagaattttaaacatctgggagccttcccatccttacaccaaagggtgtaattaagcctcattgaatcccccaaggtcttcagtctctcagttatctccactccctgtgtgagaacagatggattccctcaaggcctgtttccttccagaaatgtgaaggaccatgttaactactggctcctttcagctgagcctgatcaacctgttcttccacctcccctagcgctttagccagacagatctctcttccctttgccccaaggggcatccaacatccatcctgttttaacattcctgttcactttgccttaatctctgctcttgatcccctcagcccttcatgacagtgcttcaactgtggcccctggacaggtagcgcatccatagcttcttaagttctacagtttcgagcccttatgccaccccaaatatccaggtttagtgggagggagcagtgagaatccacatacttggtccaagaattcctcaaagtcgtggagatgaaaaaggaatatgcataggagaagcacaggaatcagccatcatgttgaaaatacgggtcaaagccaacatcttttaaaaatattttctcaggtatgtaagtacagtaaaattggtttcagagacatttcagtgttgatgctgatcatagcttctggaaaactatgaaaaaaaagaaaacagtgaaaatctgctttggctttataaaagtgacatgaatcagagtcatttgtttaaatatcttctcagtttatgtttaattagcataatcatagccatattttattaagtatttcattaatttatgtagttttttttattataccccattagattatgctaccatcgtttggtgctcttgtaagctattgttctggtcttacaacataaagatgtgctcacagcctattaaatttctaggactgatgaccctgatttagagaggtgatttcctttcgtgtctttccagtagcctagaggagaggggtcattagcctgcattattcagctggcttggagatacgaatgcctgacatcctgttgccgctgttggtgtccagcacagtgcagaacatggggcttcgggggtgtcctgactttctatcccaagtgcctatatttcagatgtctgaatacctccaaacccaaaccgttccccagctctgtttttgtttccttatgtctcttcttacccagcaatgttgttaaatttataaactcttttaagatgtaaatgataatcactacagtataaaattaatcatgtaaataaaattaattgttaatctcagtaaatctctaaggaaagcaagactggaggtggaaaacccattcagaggtcatcaaaacagcgtaggcatgactgaatgggatgcattgactggatgtggacgagaagtctgagatagtgtgactgttttaaggatggatgattacctgaggagggatgcaattgactaagattaggaatataggaagaatagaagtttctgggagaaaatgattagtctaatttaggaagaagtgccaacaggacagccaaaaactcataggagttgaatgcacatttcttaagtacatgggagaagtcatggctggaaatggagatttggaagactctggcattaaaatggtagttgaaaatcatctggaagagagaagggatcgatcatcccagggatatactaagggagaagcagttaaccaagaactgaaacccagggaagaattagtaagaatgagttttgacatgattaatgcatgaatttaactttttattttattaactataaatatccactcagttggataacagcaatgtttattaatccttacatctcacagtcctagtcagtcctctgcatatagaaggtgccagacatgtttgttgaattaaaggaaattaaaatggtatttccgtgccttgaagctctaatgacagattttcataatgataaccctgagtaagaccccaaaatgtctagattatagttgtttattacattttgtccaataccgaactaactttaaatatatgttgctgcattttgttgtttaaaaatcagtaatcaatgtgtggtgtagatggtaattcaccagagtacttgattaaccatagcccatgttgtttagcttaccatataaatgagtttgccacagaatgcagactaattcaagtctatttataattcgttttctaattccttgattctgaaggcttctaaatcttaggtcagatttgtagtccataatcctggatttctctggacttctcagcaacttcctttttttttttttgtccaggttctcctccctccccttataggactgcttgataaaatacaaaaaaaaaattcaatcattcaataactttaagtattaccccaatatttcatgggacatatttataccaaaaaaaattcttgtttttctaaagttcaattttaactggatattctgtatttttttaactaaacctgacaaccctatcccctacttaaagttactgtaactagaatatgccaacaaaattttttcatgaaatttctgaacactctccttctacaggccaatgaaaaaagtcacagattttactagcgagataaatatattaaaaagatgatctaaataaaatttttgatctaaaatatactgatcaagatgcaaacttacagagcatttataactatgacattatatacactatgtgctaataattatcctgagaatgccatcaatgtatattcatgatcatgttttttattctagctaaaatattttaaaataatgtacatattagaaaattaaactttttatgtgctccattttcaagtcagcaataacgataaaacaaaataatcatttttaaattaaggaccatacattcagaaaaaaatatatataatatacaacaggtataaattctaactgcagaatacctgaaaggatcttgacccttgttaattacatgttatattgtgcttgtgctgccaccttgtgacactttgaggtattacccaatgtaaaagtccagcttgaccatttggtcaatgttaacatgattcctcatccttacatgattaatattttcactttacctaaattgctgtataatttaatacagagaaagtaacttcaagtatgtaatgcaaatattttctgagtctgtctgcaaattagtatatcattcttgagtcaatcactaaattataatttattcagtactgtctgaatttgttttatggataaatttagttgtgtctgtatgtgtgttcagtttacttgacctttcaatctgaatttcccatagcttcatgaacttaacatttccagaattgagctcattattttcctttgaccaagcctagttcgtgtcatctctctttatatatatcaagacaataaaatgtgttagtcaaaccagaacacttttaagagtcaaaggggatggcttactaatcatgataacaaaaaaggcataaacaaagaccatcccaaggaaactggtcacttacatataatttaaaaataattatagtaccaatcacccaaactagaaaatttgttgttctcaactacgggtccagggcagtgaactggaatctttatctcagattttcttcattcctcctacctattcattccctttcatcttcacttctttctttcttgtccatcatgcttgccagcgttctccatgtccttgttctgttgtttgcaaagggatccaaaaaacaaaatcttttttcatgatgaatctaactgcccccgtcctccacacttgctccaattttctgggaactgctaagaaaagtaaatatcaccctgcagaatgggacaactttagaactttatggtatttgatgtcagctgtatctttcatgctttatggcagttctaccatatttcttaaaagtccattgtttcttgagccctgtagcagatgtgcaagcctctctaattcacatggaaaatagaagccaccctctcactgtcttgcctaaaactagcctctggtctgtacccccaatgcattatctcttttttcctttttgtagaataatatttttttaaatctcctttacctcgaagagcccagtgtggatgttgcccccgagctctggatctcatttcctccagttttcttggataaatctctatttattagatctattctctcttgtattatcaacctctcccactctggttatttttctttttttttcttttttgagacggaatctctctctgtcgcccaggctggagtgccatggcgtgatcacagctcattgaaacctctgcctcgtgggctcgagcagttttcctgtctcaccctccagagtagctgggactacaggcgcctgccaccacacctggctaatttttgtatttttagtagagacggggttttgccatgttggtcaggctggtctcgaaatcctgaccttgggtcatccacccgcctctgcttcccaaaatgctgggattacagacatgaggcaccgccctcagcctatttttcttattggcatttcatcacagtcaaatcttctttatcttaaaaacataaaccttttctaatgtcacataccttctgtcaatctttctccttttcatgagagccacttttttttttcctgaactacctatgttcactgtctatcccctcacccccatcctctcctcaacttactgtaatgagctttctcccacagctactccattgaaatgctcctcagcaaggtcaacaattactttttttcagtgctttttttgtggcattttaatactggtgaccatgttcccttcacaacaatctctaccttgggctttgtggcgtcattctttcctagatttcaggcttctatggttaatctatctcagtctccatttcaggcttctaaagagaagtctaccggcctcttggctgtttgtatttcaatggcttctgcccaagatgcttgtccccaccctacatattctccctgtgcacttccatctacgtccatgcatcacactgcactcagctatgtgctggcgactcccacatctttagatctatccagtgagtgtctaaaccacctgcactagcacatctcacaaacctgtcaaattccacaagtccataatgaagtctttttctttcttctgaatttgaaccaccccaattttatctagtttagtaaatagcaccattttctctccactccgttttcaaaaacaggaacataggagtcatcctatggattctgtctcataaatatctctctccattagcataaatcctgaccttccttatcatcctctcttactgaattcctgcaaacctcacccatcagtctctatgtctcccatcttgttactttctaatttattccctcacactgaagctagagtcactgttctaaagtgtaaatatgaaaatatctccccacttaaagtgcttcaatgtcttttcattgctgtgacaattaggtccaaattattttaagtgatttgcaaggttcttagtgacctggcttgagctcttagctggaaagcagcctcatctaaacttacccaatacagtatgttcactctctgggtgatgggatcaatagaagcccaaacctcagcatcatgcagcatacccttgcaacaaaccagcacatgcactccctgaatctaaaataaaaatggaaattttgtaaaataaataaattaattaaataaaattacccaatatactagctgacaggattcaatgaccgaaaaagccaagatagtaaaacagaaaatagaaatagaccaataggagatgtaaatattaggcttttcagacataggctttatgtgattaatatgcttaagaaattagattatttttaggagagcattttgccttttatttactgtgtaaaaagaacatttgcccaatatgaaaataggcaatacagaaaaatacaagcacactacttacacatttagttagttgaattccagatatctctgtgagtttagagaaatacatggctagaaagataaactgggctgagcacggtggctcacgcctgtaatcccagcactttgggaggtctggagttcaagaccagcctgaccaacatggtgaaaacccgtctttgctaaaaatacaaaaaaaattatcagggcatggtggcacatgcctgtagtcccagctactcgggagactgaggcaggaaaacagcttgaaccttggagggaaggttgtagtgagctgagatcacgccgctgcactccagcctgggtgacagagactgtgtctcaaaaaaacagaaaaaaagaaaagaaaagaaaagacaaaagataaactgataatttttagatgttttatagaaatgttttcatactcctcctgctgtttcaaagtgtaaatatttttaatgtagcagaaggaagagtatctactatgtaagtaaaatacttattctaatttagaatccttttttttaacttttagtttagtggatacatgtaaaagtttgtgatataggtactggtgtcatgggggttagttgtacagattatttcatcatccacatactaagtctagtacctaatagttactttttctgctcttttccctcttcccaacctccaccctcaacagaccccattgtctattgttcccttcttatagttcatgagttctcatcatttagctcctacttataagtgagaacatatagtatttggttttcttttcctgtgttagtttgctaaggataatggcctccacctccatccatattcccacagaagacattatcttgttcttttttatggctgcatagtattccatggtgtatatgtatcccattttctttatttagtctgtcattaatgggcatttaggttgatttcatgtctttgctattgtcaatagagctgcaatgaatatacgtgtgcaggtatctttatggtagaatgatttatattcctctgagtatatccccagtactgggattgctgggtggaatggtagttctgctttagctctctgaggagtcaccatactgctttccgcaatgtttgaactaacttacattccctccaacaatgtataagtgttcgctttcctccacaaccacaccagcatctgttattttctgacttcttaattatagccattctgactgtgtgagatggtgtctcattgtagttttgatttgcatttctgtaatgaccagtgatattgagcttttataacatatgcttgttggctgcatgtatgccttcttcggaaaattctgttgacgtcctttgcccacttttaaatgggattggttgttattctcctttttctcctgtaaatttgcttaagttcttacagatgtatagtttgcaaacattttctcccattctgcaggttgtttactctgttcacagtttattttgctgtgcagaagctcttaagtttaattggatcccatttgtcaaattttgctcttgtcgtgattgcttttggtgtctttgtcatgatatctttgcctgttcctgtttccaggatggtattgcctcgattatcttccagggtttttacagtttttagttttacatttaagtttttaattaatcttgagttgatttttgtatatggcttaaggaagagatccagcttcaatcttctgcatatcgctagccaataatcccagcaccacttattgtatagggagtcttttccccattgcttgtttttatcagttttgtcaaagatcagacggtcataggtgagtggtcttgtttggggactttctattctgttccattgcactatgtgcctgtttttgtaccaatactatgctgttttggttactgtagccctgtagtatagtttgaaggtgggtaatgtgattcttccagctttcttccttttccttaggactgccttggctatttgggttcttttgtggttccatatgaattttaaaatagtgttttctagttctgtgaagactgtcactggtagtttgataggaatagcaatgaatctataaattgctttgggcagtatggtcattttaatgatatatggattcttcctatccataagcatgtgaaggatatttttccatttgtttgtgtattctctgatttcgttgagcagtgtcttgtaattctcaccataggaatctttcacctccctggttagccgtattcctaggtactttgttctttctgtggcaattgtgaatgggattgtgttcctgatttggctcttggcttggctcctggtggtgtataggaatgctagtgatttttgtatgtttactttgcatcctgaaactttgctgaagttatcagctgaaggagattttgagacagaactatagggttttctagacatagaatcatgtcatctgcaaacagagataatttgacttcctctcttcctatttggattccctgtatttctttctcttgcctgattgctgtggctaggacttccaatactatgttaaataaaagtggtgagagagggcatccttgttttgtgctggttttcaaagggaatgcttccagcttttgcccattcagtataatgttgactgtgggtttgttatagatggttcttactattttgaggtatgttccctcaatacctagtttattgagagtttttaacatgaagcgatgttgaaatttattgaaagccttttctgcatctattgagataatcatgtgggttttgtctttagttctgtttatgtgatgaatcacatttattgatttgtgtatgttgaaccagccttaaatcgtgggtataaagcctacttgaacatgatggattagctcttcatgtgctgctagattcagttttcaagtattttgttagggatttttgcatcaatgttcaccaaggatattggcttgaagttttttgatgttgttgttgtgtctgtcatattttggtatcaggatgatgctggcctcatagaatgagttggggaggagtccctccttcttgattttttggaatggtacaagctctttcttgtacaactggtggaatttcactgtgaattcatttggccctgggcttttgttttttttttttttcgattggtaggctatttattactgattcaattttagagcttatttttggtctttttcagggaatcagtttattccaggtttagttctaggagggtgcatgtttccagaaatttatccatcttttctaggttttctagtttgtgtgcatagaggtgttcatagtagtttctgatggttgtttttattaatatttctgtggggtcagtggtaacatcctctttgtcatttctaatcatgtttatttggatattctctcttttcttctttattaccctagttagcagtctttcgatcttattaattttttcaaaaaaccaactcctggatttgtttatcttttgagtgtttttctgtgtttcagtttccttccatttagctctgattttgattgttttttgtcttctgctagctttggggttgatttattcttgcttccctaattctttcagttgtgatgttagtcattaatttgaaatctttccaactttttgatgtgagaaattagtgctatgactttccctcttaacactgccttagctgtgtcccagaaattctggtatgttatgtctttgttgttattagtttcaaagaacttaatgatttctgccttatgcattatttacccaaaagtcattcatgagcacgttgtttaatttccatgtaattccgtggttttgagcaattttctttctttcttttttttttttttttttttttgtgacgtttcactcttgtcacccaggctggagtgtaatggtgcgatctcggctcactgaaatctccgcctcccaggttcaagtggttctcctgcctcagcctcctgagtagctgggattacaggtgcatgccaccatgcccagctaatttttgtatttttaacagagacagggttttgccatgctggccaggctggtcttaaactcctgacctcaggtaatccagctgcctcagcctcccaaagtgctgggattacagatgtgagccactgcgcctggccaagcaattttcttagtcttgacttctttatttattgcaatatcgtctgagagtgtgtttggtatgattttgcttcttttgcatttgctgagcattgttttatgtctaattattggctgagttttagaatgtgccatctgttgatgagaaaaaaatgtatattctgttgttttcggatggacagttctgtagaggtctatcagatccatttgctccaatgttgagttcaggtcctaaatatctttgttaattttctgccttgatgatctgtctaatactgtcagtggaatgttgaactgtcccactattactatgttggagtcttatgtctctttgcaggtctctaagaatttgctttatgaatctgggtgctcctatgttgggtgcatataaatttaggatagtcagatcttcttggtgaattgaacaccttattattatttaatgcccttcttcgttagtttctgatctttgttagtttaaagtctgttgttccaaaattaggattgcagctcctgcttttttctggtttccatttgctttgtagattttcttccatccctttattttgagcttatgggtgttgttatgtgtgaggtatctctcttgaaggcagcataccattgagtcttgctttttaatctagtttgtcactctgtgccttttaagtgagaaatttatcccatttacattcaaggtttgtattgatatatgtggatttgatcctgtcatgttgttagctggttattatcctgacttgtttgtgtggttgctttatagtgtcacttgcctgtatatttaagtgtgcttttgtattaactagtagcagtctttccttgccatacttagtgctcctttcaagatctcttgtaagacaggtctggtggtaacgaactccctaaacatttgcatatctgaaaaagatcttatttcttcttcacttaggaagcttagttcagctggacataaaattcttggttgaagattttttttttttttttgagactgttgcatataggccccccagtctcttttggcttgtaaggtttctgctgacaggtctgctgttagtttgatgggcttcccttttctaggtgacctgccctttctctctagttgcctttaacattctttttttttcattttaatcttcgaaaatctgatgatcatgtgtctttaggatgttctttttgtgtagaaacttgcaggggttctctgtatttcctgaagtcaactatggcctctctgggcctttcccaaaacttgccagagaggccaacagacaagttcaggaaatacagagaactcctgctagattctaggatgatatcctgaaatctgctttccaagttgttggctttctccccatccctttcaggaatgccagtgatttgtagatttagtttttttacataatctcatacttcttggaggttttgttcattcttcttcgttcttttttctttataagtcctcataagtctgactgtcttatttcagagagacagtattcaagttctgagattcttccctcagcttggtctatcatgctgataatacttatgaaaaatatggaacactttactaatttgtgtgtcatccttgcgcaggggccatgctaatcattccaattttagtgtgtgtgctactcaagcaagcacagaaattagatattaaagtagagaattttaaaaaagaactggaaactacaaaaaaacattcaaatggaaatcctagaactaaaaacaatgtaatgactaaaattaaaactcagtacatgagtttaggaaagtttagaaacattgaggagatgattagtaaactcgaaaataggtctgacaaaagtaaccaggctaaaattggagagaaaaatgaaacttccaggagcagggggcagtggtagtaaaagacatgtgagatatagaaataggcatctcagatggagttaacgcaaatggggcagaaaaaatattttagcaataatgtctgtggctgtccaacaagtcacagattcaggaagcactgcaatgccccaacaggataaacaccaaaaagtaaaacacccacacccaggcatggcataagaaaattgctggaggccagatatggtggttcacacctgcaatcccagcactttgaaaggctgaagcaggcatatctcttgaggtcaagagttcaagaccagcctggccaacatggcaaaaccccatctctactaaaaatgcaaaaattagtcaagtgtggtagtgcatgcctgtagtcccagctatttgggaggttgaggcggagtcttcagtgagttgaaattgctccgctgcactccagcctgggcaacagggcgagactgtctcaaaaaaaaaggaaaactgttgggggaaaaaaaaagagggcatattgaaagcttccagaaacaaaagacactagacagactaacgagtaagaaaatcagctagttggaaaatttccttttctttccactttaagaaatgccaaaaatcagtgggttggcttgactatgttctgagtaacccttatcttcatggccttatttctctgagagaccaaacccttcaagcctagagggattatcagtgtgcctagctccctgaagatgctgtgctgagataaattttagtggggactcagttcctgcgtcttttgtagatgctctacagtcttattgctaacaagacaaaattctggaagcagtttgagatgttcatatccatctttatcactatctaatgtaattttaagttataaaaagaaaaatgatgactgaaaagtttataatttataccggatatttgacaatgttatatctatttttttaagccatgaaaggcaggccaaagtaaaagccaaatttatcacaaagatttcaatcattaaaatctctcaggatatctaacttctcttcccaaacatttatgcagttctactcctctaattctgagcttacacacttctctcaagcaggaatcccttatcattttatccctcccacctgaaacatggctcatgcttgcatcattcatgtaacacttcctcccggtaaccttgcattgtgccactagctggaattagtcacttctttctcatttctctcttaatattttattcgtacctcgattacttcatatagattttgtgtgtgtgtgtgtgtgtgtgtgtgtgtgtttttgtcgaagtctcgctctgtcgcccaaggtggagagcagtggagcgatctcggctcaccgcaacctccgtctcccgggttcaagcaattctcctgcctcagcctcccaagcagctgggaccactgcatctggctaattttttgtacttttagtagagacggggtttcaccgtgttggccaggctggtcctgatctcctgacctcaggtgatccacccgcctcggcctcccaaagtgctgggattactggcgtgagtcaccgtgccccgcctcatatactttttcatgtgttgaatataatcaactgttaaaatgtcttttatttatttatagtgtctttgttaatgagttgttttatccatctttacatccttcaaaattctgagctgaaaggtcagatttgaaactgtagagatcaaaggaccaaatgtgttccaaacacccacctactctcaaatcccctgtgtaatacaataggcagatgtttgttgatctgcctaaacacctgcggtagcagaaagcactgtgtacttcacagggcaattcatttcacttttagatgacttattaggaaattcttcctgacagtgtgcaaaatttgatttcttgacttccacccacttggtccagttttgccttgtgaagctacacgaaataagtttaatagcttttccatatttgggacgtctatttctaaatgcaaagcattatgtttttcctgcaaaattttgttatttttgtcacatcgttccaaattttgcagatggttctattctagctctcaagtcacattgcaattagtctagtattagctttacaatccatatacaggctttgagccttggaactataagactaaaaggaaaactctcatttatattaacatcacttgaaagtaaacctcttgactgatagtgtaacagaattacagaaattaataagataatgtccttgtcactgggaaggtctccttttattaaactaatagctagtgcaccagagataaggaaaataaatgttaatgcagagttgaaaaactttattttgaaaatagaaggcattaatcatctgcactcttttactgtgtccttatttcattacatatggttactctttcaaattaattttcagagagcagaatgagaggagccttgtgccatcgttgactatctgcacccttaaactgatagatcatagcaaaaattgaaacctagcttagtctaatagtcattatgaatggtagtgcattagctgcctaaaagtaaaaaaaaaaaaaaaaagtttgaaaggagagtttgagacataaacatttaaaggaaaataccaatttactgtaattggtataaaacaaaatgtgaccttaatttatattactatgtattcttggcaattttttctcctcatttgcaaaattttctcctttctctattcctccttgcctgcaccagatgacagtgtccatggtgaggatgagaggtgaacagtatgtgacttctgcataataatattctaaattttgaatcatgatggatattgctataagccagtaactgtcacctcaaactgatgggtgggaaaagggtccttcaggcatgacacattggcaataattggaaatccattcttttctcttttaaaaagaaaagtctttatttgtatgcagtatcagagtagatacatgtaatttttgttgtggtggtggtggtggttgtcttttttttttttttttttttgagatggagtctcactctgtcacccaggctacagtgcagtggcgcaatctcagctcactgtaacctccgcctcctgggttaaagtgattctcctgcctcagcctcccaagtaactgggactacaggcatgagccaccatgcccagctaatttttgtatttttagtagagacgggttttcaccatgttggccaggatggtctccatctcttgacctcatgatccaaccaccttggcctcccacagtgctgagattacaggtgtgaaggtgtagtttttaaataaaacaattgtttcagtttaccagcaggaagcattttggtactctgcttttaatgttaaaatagaagtgttgtttgcttcatgctcctattgttatcaatagtataattggttgttaagcttattatcagaaactatggaacatgattgatttaatattcagtatatcagaaatcaggtatttatttgtttacacatttcatttatgtagcagaatgttcccgtgaatcacaaatctgaatttttggcatattggtgagcaggacaggaaaattagatctgaatgggtggtaaaaccttttttatcatctgggctctgatacacaattggaaaaacatgtaagcatacataaaatgccttatagtatattgactgtggagtttagatcttaacataattatattcatgctctggggaacatttataccttttgattaaagatctctcagtagcagagcagctttctaactagcccgcaagatttctgctagaagtaaaacagtagcatcctaggccgtggtgatttacaatctgaactgtacatttccttcttaaggacacctttgctggaaggcgtcattcagggtgagcagccactatgtacattgccctaacaaagtggagtcactatatagttttaacaaacattctggacacatttgagaaaaataatctccttcaatagttgtttgatggtaaagtacactgcatttaatattttatgtttgtctatttacattttcaaagcctcttccttttatgtactctttgaatgacaaagctcactttttactgccttagcacctttttttcaccagtggttaataatttatacacaacagtgaatttgatgttaaatatcttatatactaaatgggaattaaaaacatatttaacaagttttttaaaaatttaaaatagcatattctctgctaaaaatattatacttctacttaatcaagagatgctgctctttaaatagaattgagtatcatgtatacgataccgtattcgaaaaattttggagaaaccttctatatccatgctgatgaagttcaaattcatttcacttattttagagattatactatggggtcaagtaggcctgaatttaaattccaattaagatttttactgtgtatcagttctgcaccttgtgcaaattacttaagccctgagtttcattatccattataaaatagaatttttgacaatatttgcctcatagtgtttgtagccaagatactgccaagataatatatgtaaagcaccatagaaagtaatgaacaattggcagctatttatattattttcatgaactactactaggggaactataggtggatttcttataataataatggcagaagaattcattaaagaaaacactgatagatttagtttcataaattctcattaattctagacataaaaaccaaaaatcaaaatacagggaaattttttaacatatgtcacagaaaaagaagcagtatctttaatatgcaaagagtttttaaaaatcgatagcagatttttgacaagagtaccaagaaaattcagtgaggaaagtatactccttacaaagcaggaaaagaaaaagaaaaaaataacatacaatggagctccagtatgtctggcagcagacttctcagtggaaaactgagatgctgggagaagtagacagacacagacatagaatgaagttggactctacctcacatcataaacaaaaattctttcaaaatagatttgaagactaaatataagaactaaaactataaaacttttgaagacaacataggtgtaaatattaatgacctttgattaagcagtggtttcctagatgtgataccaaaagccacgcaaccaaagtgatattaataaatgaggcctcattagtacttcaaaggacaatatcaagaaaataaaaagacatcccaaaagattgggagaaaaatatttgcaaatcttatgctagtatatatccagaatatataaaaaattctaattcaacaattaaaaaataaacagcccaattaaaaaatggacaaaagatcggaatagacatttctcccaaagagatgtacaaatggccaattagcacatcaagagacagtcaacatcattagtcattaggaaaatacgagttatacccctaatgagatatcacttcatacccactaggatggctataatgaaaaaggcatacaataataagtgtcagtgaggatgtggagagtggagaaattggaaccctcatgcatggttgcatgaacataaaacagtgccgtgctttggaatacagtttggcagtttctcaaagagctcaacatatagttaccatattccatcgcttggtagataaggcccagaattcaaaaaatatgttcatacaaaaacttgtgcatgggtgttaatagcagcattattcattaaagcccaaaagtggaaataactcaattgtccatcaactgatgaacagataaataaaatgtggtatctatataggtggaatggaatagtattcacacataaaaagaatgaagtactgatacttgctacagaatgaacattgaaaacattacgctaagtgaaagaagccaggcataaaaggaccacaaattatatgattcaatttacatcagtcaatacatctgtctctatgaatttgcctattctagatgatttgttgaatcatctagaatagactcattgaatcatctagaatattcattgaatattcattgaatcattaaattcattgaagtcattgaattcattgaatcatttagaatcatttagaatggcatccatagagacagaaagtagattagtgtttgccaggaatcctggtgggggagggaatagggaataacagctcataggtacacagtttcttttacgggtgatggaaatgttctggaaacaggtagtggtaatggttgcacaacttgaggaatgtactaaaaaccactgcactgtatgcttaaagagtgcattttatgatatacaaattacattagttttttaatgtttcaaaactcagtaacaactaataggcaacagttaaaatatggcaattcacaaaaggagaaatgtaagtgactgatgagcatggacaaaatttttttatgtcatttgtaattagagcaaagaaaattaatacaaacataagcctaccaaatttttgtctatcaaatgtatatatttaaaattatacacaggcaagagtattttctttattcaatctattggtagaaataaaacttgagaacttttctgaagagcagtttggccatatgaatgaaattctttttaaaattttgtatctgatctttttgtataccacattgcaaataccatactctcttaattactataactttattataaatcttaaagtcaggtagcacaactctttgtgctttcaactttgttctttcttttgtaaattccttttctaaaacattttggctattccagggaatttacatttacatatgaatgttaaaattaccttgtacctttctaccaaatgtgggctaaaattttgatttgaatgcattgaatttatgggtcagcttgggaagactgaatctcttaataatattgagcctgttttatgaaaataccatatcttgccatttatttatgtctcatttaatttatctgaacatgttttttaactttcagagtacaatttgcatatttgttggctatttttccctaaatatttttatgctttggtatatggtattctttaaatttcaatttttgattattcattgccagtgtataaaaatataatgatgtttgcacatggatcatatatccagcaacttttaaacttagtttatatgttacagtagcttttttgtagactttttatgatttttctgtgtagactgtcatgttatctgtaaataaaaagttttaattcttcctttccaatctgtttgacttctatttctttttcttgccttaattccactctctgggaacctccactaggatgtttaaagtaaatggtaaaaacgtaaatgcttgccttttttctggttttaggaataaataatttagtcttttaccattaagtatgatgttagctgtgggttgaacatagatgccctttatcagattgaggaagttcctttttattcctttattaagagtttttagttggagtggatgttggattatgtgaaatacttttcctgtatctattgagatgtttatataaatacatatagatatatatttatctatatataaatatatttatctatatagatatatatctatagatatctatatagatatatatttatctctatatatatttatataaacatctcaatagatacaggaaaatagatacactaaatatgtatatatatataaatctatttagtgatctatctgttttatctgttgagcaatcgattgattgttgtgtctgtctttctatctcttaatgtaatgaattatggctgggtgtggtggctcacacctgtaatcccagcactttgggaggccgaggcaggtagatctcctgaggtcaggagttcgagaccagcctggccaacatggcgaaaccccatctctactaaaaatacaaaaattagctgggcgtggtggcatgtgcctgtaatcccagctactcgggaggctgaggcaggagaattgtttgaacccaggaggcagaagttgcagtgagccgagattgcgccactgcaccccagcctgggtgacaagagtgagactccatttcaaaaatatatgtataatgaattacattgattttctaatataaagaaaaccttaaatttctgggataaaccccattttgtattaatccattttatatctttttggattagatttgctaaaattttgttaaaatttttacgtttatgtttgtgaagggtaattgatttgtaatctacttttcttgaaatgtttttgtctgattttggtattgaaataatgctagcctcatagaataaattgggaaatattctctcctcttcaatttaatctaagagtttgtgtaaagttgatattatttcttctttaaatgtttggtgaaattccgtgaagtcacccaggcctggaattggttttgtttatttttttgttcatttttgttgttattcatgggaatttttaaactaaaaatttgatttttaaaaaatagatatagggcattcaggctatttgtttcttgtgtgagtggtggcaatttttatctttcaaagaatttcaccatttcatttaactcactgaatttattaaaacaaagtttcataatattttcttattgtttatttctatagaattgatagatattatctacttcattcattatattgataattcatatcttttatattttatcagattagcttgtatagagatttatgaattatattgatcttttcaaagaaccatcttttgtttttacttattttactctgatattattatttttttgttctgcttacattgggtttcatattctcttctttttctagtttcttaatgtggaatctgaagtcattgatttgaaacttttcttctctaatacgtgtttaggggaatactttctaaactaagtattgcttcactgcatcccagagattttgatatgctatgttttaatttttattcagtttaaaataattttaatagcccttttgattttttcactgacccttgggttatttaaaattttgtgctttagtttccaaatagatagaagtattccacatatctttttgtttttgatttctaccttaattctatacttagggaatatattttgcctcacgtaaatccttttacatttcttgagaattgtcttatgacccagaatatagtttatcttggtaagtggttggtatgcatttgaaaagaatgtgtacttgctcttgttgagtagaacattttataaatattaattaggtgaggttggtttacagtattcaagtcttctatatattttctgatttttctgcttacttgttccatcaattgttgataaagggatgctctaatattttacaattctatatcattttgcttcaggtatttttgaacctctgttattagaagcatacatttttaatgttgtaatgttctcctgataattggacactttatcattatgaaattgctctcttttcccctgctgatattttttatcctgaaatctattttgtctgattttaatatagtgtctctatctcccttttggttagtgttagcatattatgtattttcccatccttttacttgtcatatattcttgtctttcttatttagattatcttaaaaaacatatagtggttcttttaaatccaacctgacaatctctgcctttcaatggaggtttatagatgatttacccttaattaaaatattgatatgcttggctctgaatccactatcttgctaatttttctatttgcctcttctgttcttcattctcttccctcttctttttctatcttcttttgaaataatttgaatattttccaaaaattccattctgtctcctttgtcggtttattagttatgagtctttgttaacatttctactggctgctttaggttttatagtatataccttaacttttcacagtctattttcaggtgatattttactacagtagtcctgctcatatctgcaattttattttctttggcttcagttaccagcagtcaatgacagtcagaaaagaggtgagtatagtaaaacaaaatattttgagagagagaggccatactcatataacttttatgacagtatattgttataattgctccattttattattgttaatttcttactgtgcctaatttataaattaaattttatcataggtatgtgtgcagaggaaaaaacacaacatatgtaagatttggtactatccacagtttcaaacatccactgggtgtcttagaatgtatcccttgaagataagggggactactatacttcatgtaaagtattaatataagaaccttccaatgacatatttctattacccttagacatggtctttgtacaaatgttgttatgcagttgtcatgcattttgcttctaaatataaaaccccaccgtacattcatatcatttttaccttaaggtttcaattatctttgaaaaacatttacataatgagaaaaatgtgcttacttatagttagtatagtcagtgctcttcattctttgcataaatccagtttaccaactgttatcatttttcttctgcatgaagaagtttcttaaatatttatttctgtgtaggctattgatgaattattttagctttgtatgtctaacaaagtctttatttgcctttgtctatgagacatatttttgcagagtaaagaattctaggtggacagttttctttcagtactttaaagatctcattccacagtcttcttgcttgctttgtctcagacaagaaatcagccttcatctttacctttattcctctgtgaataatgggtctttttcttcctttctttcagattttctctttaccactggttttaagcagtttcattattgagggttttggtttaattttctgcatgtttcttgtgctagaatatttgctgaaattcttgggtctgtaagtttgtaatttttatcaaatttgaaagttttcagtcattacttcttcaaatttttttctgccccttctctcttttggagactccaattacgtatgttttggccacttaagttgtcccacagtttagtgatgctcttttcctttttagttttcagtcatttttcttctccctgcttcattttggacagttttgattattgcaacatcttcaacttcactcatcttttatcctgaattgtttaacctgccattaatcccattcaatttttttttatcttagacaatgtcattttcatctctaaatgttttatataggctggttgtaaatgtctttttcatgcctctatatgtaacatattcaataattcttctagcttcttgaacatttgaaatatagatataatagcattttaatgttcttatctactgtttctatcatccgtatctactatcatttttataatttctgggtctgcccattgactaagttttctctttattattattattactattattattggtatgccctgcttctttgtaagcccagtagctttctgttggattccgtatgttttaaattttaccttgtttaattaaggctggatactacttattcctacaaatattactatacgttgttcagagatatggttaaggtacttagaaacagtttgattctttcaggtcactcttttaaattttgttaggtggtcctagagctgtcttaagtttagtattacttttccctccactagcgagtaaagattcatcttaagattttaaaccttctccaagaattatgaggctttttagactgcctgttggaaacaggtgctattccagtgctgggtgaagactaatcctttaggatcattttttccttagacttggatagatttctcacacatatgcactggtcagtccttaactgaatattctaggagaaaactctaaacatcctaagttaactctgtgtcactctctcctttcctctcatttctattattctgccttgcaacctctaggaaccgtcaattttcagaactcttggctctcaacgcctcagctcaagtttttgaacaggctctaggtaggttccttcttcctgtactgtatgaaaactttctttcggcaataaattatatgactcacctcatttgttttctaataatcagaagttactgttctttgcctgatgtccaatatcttgagtgtctggttttttctgtattttgtccattatctttttagttgtttgagacagaagagtaaatactgctcatcttacttcatcttgatcagaaacagaagtcctaggtggttttattttcatagttttgcttttcttcatttttctagtttctctaaaataacacatgcattcatataaaactaataaaaatatgcgacttattttaataaaatactcaggatagtattaaaggactagatttggtaattgatcataataatatgcctgaatatataatcgccatataaatagttttcaatgtctttaacaatattgaaattatgtcagatatttttttccctaaggaagagaaaatcaggggtgcgcaaattcataaattagcagataaaaatggaaaggccttatctgaaaagaaaaatatgtgactctttaaatatataaaacccatttaataaaccatagcatgttacaatgaaatctgtgaaaatagaattaacatatctccacatataaattaccccaatcttacttattctagattccaacatatttctcaaagaattgttcataaaaccttttagttcccatttacagatgtttctcccgtgaccaaacagctaattctgtgccacttcaaataacatcttacactttcaacaatctcagaaatacatcacactactaaaaaacctgtttctacatctgtaactttggcttttatgatcgccttgggtggctcatttttcctggaattttcaaagcccagattataaaacaatctttctgaaaaaggtatcagaaattaactattttttgctttggttgtttgatggggggaaacagtctagggtattttcagaatttaacattgtcctttgcattatatccagcacaaacagatatgacagaggagtactgatgccaggaatgtgtcccacgtagccttcctatttaagtaaactgaagattgcctcctcaattagttgaaacttctgggtggtcttccagaaaatagctctttgaagaaagcagtgcactaataatactgtaaatgtaaaataacattagctctttagctttgaagctaagaaagaatgaatagcaatgagatattttgtttgttcatatacaatttcctatctctgacccttcagaaggaaaaattctatataaatccaatgaaaaaattttaagtttatatatttgggtttagaattagccattaatttggggcatgtgtgtgtaaactatctgatttgtttacttttataggtgcatgcacacacacacaaccttctatagtaaaatcactgtataataaattttaaataactgggggtatgtagtaaataaaaaaatctctccctttctgagaaaattggccattatttagcctattctgcacatttgatttcactgtcaagtctaaaatcaccccatatgtgcccttgatattatcattccactgcagcctgccccaggcaaaatagtgaagttattgaagttggttttgtgggcactctaattcccttccagagactcctttttcccttgtattcttcttgtctggggagtgaaaaaaaagttgtagttcagttataaggccttttattaatgaaaatgttcatttatgtagctgcctatatttccagggaaacataggacaagccagtaatattagtaatcttcattatgcaaatgttcataactctgattttcattaatacacgagctatgtgtatgtagcagtttggcaaggagaacagtcattatttaggtgctcagcatattcaactttggtcttagctaaatccaccgatccctaacgctcctcaccctacccttccaaataggaagaatagccaaaataattttatcatgaaaaatggaaatttcctacaaacaggagcctaatacttgggattgattggtcaatggactgagtaaatttaaataaggtagactatgcacctattgtaggctttgcaaatcctccaggcaagttcattctaaatggaattttgcctgtgcaaatacaatgcatgtactaagaattgtacttaagcctcaatacggagcattgaatttaagttcccaaggttctgctcagcctcatcaaatatggaccaaatgggcattgttgacaaatgcatattgacatggtcttcagtttagttttctttgtttatggctttattagaggaatttttagtagctctttctcactgtacatagcagagggtgatagaagagttcgttttctgtccaccgtttccctgaatgcatcattttctagagttattgtctcttctctcttcagtctgtattaatgtcttccatttaaataagctttcctcaaatactcattctcccaagtgaaaaaaaaaaaaaaaaaaaaaaaaaaaaagaatcaaaagctgcatttggcaaatactagcacaggaaattttccaaaatcgtgaatgcccacaaaagaggtcaacatccatttgcttttcatgtgcatttaattattggaaagaatttgatttggcaattacgctagtgttttgaagcaacttcattttacgactgagaatgaggacttcttaaagtggggactgtgccagtcagctcatgccagatctattgtgggtattgaaaagtttaacatgtgaagagaactaaatagagaatggcaggagctctgctgctacatcgggatatgtggagcctggtgcctcatgagaggcagccaaagtggatggtgtgtcagtgatcactgggatgactccttggacaaaatagttctcccatgcctaaaatgtacactatagaaaataaacctttaagtcaaaggcattagtggagaagcaagagagtatcagaagactaaaggcaaagaaaatgatggtttcaatgggagaggatcaggaaggagctaacacttgggtctgaccagaaatcctgaaagtgtagatgcatgcatagctagaatgtcctggataccagagtgttctaaaaagagaaaagacaaaaaggttgagacaaaggaaggaatgggcagatatgaaagcaaatttacctcatcccacatggcctattttgtgtcatagaaattcttgtctatccaatgcttatatcttaagaaaaccaagagagtcaaaacagccttttgatgtttcagtacaagaacaataactcagaatgttctatataaatgcatttccagaatttaaatatgctaacaccaaagagcaaaaacaatgggatattccatccttctgatactctcattttccccccaatatgtaaatgaaggaataggatatgttaaaatgttacaattaacagatataacttgcaaaacagttatgaagaaattttttcagcatatgtgctggagatacaaggattaataatacaatgtggacattactctcgtcaagtcagttgcattttaattagcaaagttgagtatctcatcacattagtgtgacaccaaatgctgagattcagatttaaagaggtcattccttgtttagatgctataatggtgagagatattcagggacacagattccattttatgtacttgctcctaaaacattgttgaatgaatgttttgaacatgatgccagcaagtagctatttatattgtttatgcatatgcctgaacagaaatttatgctcttgctgagaggcttattttgaaaagaccttcctaaactatcactagaaaatgcaaattgtggtcaagaggttcgtaactgaagactactgtattctcctccatgagaggaacggcagatgtttccttaggccattcactatatactgagagaaaatttgccattttttgcagtttttaaaaattgattttgactacaccagcactgaaattaaatgaatcattttcttttcctgatttcctgtggattttgaggagaggtttgctttataaataccacttgctcttccttatatcagttttgttttacatatttcgtaatttttgagtgcatttccttttgttttatattccaaaatacctgtcaccttcacttccaaacagccagttccacctattaacttctgttattgttgtttatttttagcaatggcatttttacagaataaaaattctttccttgaaattcaggaatggagaaacaacacacccttccagatgtagaggaaataaaccttatcctgctcttgaactccctgaaatttaagtgaccttcttttgttttctgtcactttgcaccccacctgctgtactgtctactcccacccattggcccagcagtgcagatttagagaacttttctaaattcacttgctgcctccaaaacggcaggtgggcggcaggtgctgggggctatacagtgaaggggatgagatatgtgtgtgtgtttgtgttgaatttgatgtattacaattttagtcagcattagcagaatgaaaaggtggcatggctgtctctgaattaattcatcactaaaacatactatctgaagtttagcgacattgatccttcttactttattgttgctatcactattgccaactaagataagaatgaacatatgtggatttcactaactttgtctctcagccaaaccaaaggaagtttccataagcctggcaagaaaggacaagcagaattcagaaagcctcactagaactgattctatttgacaggctggtcttgttccctcttctaccttttcacctctagcaacagctgtttcgttgttttacctgtcataattttctccttttaagacaggtaggttaattatgccaggagtggatcaacgggcacaattcttaggcaaattttaaattagcaagtaggaagaaatgagatcggtaatttgacctcaagtcttgacatttcctttttttttttttttttttttggctacattttatatctctaattgttgttttggctccgtcattggtgatagtacaatttcaaataatctccagtgtgccagggtagagaaatttagcaggaaatgacggtgaaaatcaaaagcacatatgctttatgttctcctacaaatggacttcgagaacttgtgtggaaatacttgcaagaaagtatagatagtcatatgctcttggccaaaaatggtccttttctatcagagtacgttattctcttcaaataagcagcacatatttggaagatttgcccttgacaagttcagattgaggcaccgacaagagagaaaaggtcacaccaatcaactccaataatggagtaactgagttcccttagtaactacttcagacaactccagttacctctagttcactctcatatacagctatgtttagaactacagaaacgccaatctccttattcattcattgaacactcacgaaaactcaagattagaaggaccaataaatccaggagtataaagactaataaaatatggtccttgtcctcaggaagtttacacttttgtaacattagcacggggtcaaaatgttttagatgcttcattaatagtttgagaatcaaatgatttttttacagttgtatgaaatgtgatgatttattcaatgagttgtgtgtgtgtgtgtgatgtctaatatctagaagtttgcagcatatagttttacaggttgtgtactgaacaatatctagaagtctgcagcatacggttgtgcaggttgtatactgtgcaattctggaggcttccatttatcctgcagtgtgcagtgcaaagccacagaggcatacatagcatccctgagcttctacagtgtgtcagaggacatagtagtaaacatagtttctaccctcctggagcttgcattctagtagttacacatgcagacaatgagctggattctgctatcaaatcccatgccatttttccagtaccattttaaagtatgtggcttgacaatcttttgatataaccaattatgaaaatgtattaatattaaatgtagaaatgattacactgatcactgaatttataacaatagctatgttaatctgcccttactaaagaatgagtgagaatccaatagctaaaggctaacccattgtattttgaaatctttatattttatctctataaaaaattggaagtctttaaaagtgtgttctacatgcatcttccctagtaaacagagtatgcatgtcagattgagaagatccctctttgtactgtgtactttgtacacagttatatcttcttatgaggtatgtaaagataaagtaagtaacctgcagtgatgtggcactggttggaatgcctgattgcactaggaaaagttctcattaattttatgttcaaggcctttttgtcttgcccctgactccctgtccaatctcacctccagccactctactatgatcaccccactctccaactacacgagctccatgtagtcacacaagcaggccaagctccctcacagttcatatgattaagcagcaatatcctttcccctcttctctatctcctgtttgtctttcagcccagctgaacgatcacctttctgaaaccgtttctatatcctgccagccaggctgggttaggtgcctgccaagcctgccactctgcacagttttagtgggcaccattccgactgcatgctggagtgcccctcttctttttccaatagtatcctgagtatgcctatatgcacttgccaccctgttcttttatattgcttcccagcctatcttgagggtacctgctttgggatctgaagctgagccttatttctacttgcctggtgtaaggtggattctcaatggataattgtttgaatgacagcttcatttggcacagtacataatttaggtgcccctgagatatgtaaggctggaatttctctctttggatatgctcagattgttcacttagcctatctggtgttgtttttccctattgtaatgcttatccttcaagtcattgctcccattctcaggggccatgctgctggtctcttcgcagatgttcattaccactaaagaacactactccttggcctcttttcagttgctatcttcctcctccttctgccccctcctcctccccgcagtctgcttctccctctttgttttgctcttgttcttttctgtttgcttctcagcagtaggggccctgttttttaaacaattgcctactgagaatgtacactgttagaagtccatctcagatctacattctatttcccatgacatttatatggtcagtattctctcagtatttgcagtactgtgctcactaagacttactttgaggtgtgcagttattactaacctctgagagtgatgactggcagctgtgtatgtgaggtttttctacaatttttagatagcagttcctttttgaagaagtgcacaatgtcaccacttcccttgctttccaggttctgtatttttaggattacacttcatcatccagatctaaatgtatctgtgtacctgctaaagttaacgaggtataagagattattcaaaggtcacattatcctcagctgtaggcacattatcctcaactgtcatttgcccaacactgatgagaattccagtcttttatgtaattgctcatggcactaccattgctttctgtgaaaattatggaagagagaagcttagtttttcgtagctgctcgtttcctcttaactttgttagtactcacccaggaactctgccacctctacactgccctcactaccataatacttcacaaaaacatgatcacatttgaaatggaaacaaccttggggaactttatactggtaactgtaatgatgggaatttggagaccaggttgaaagggaggatctgtgagagagacgtggagctggtaattttgtagtatttagaacaatgtaaaacctgagactttttatacccagcttccctcattcttaggacaatagtgcccatattgttatgtattttactcatgtatatttatttcattctgagtcaatggaaagctttgatacttatataaaagttttaaaatcttttgttcttcataaaagaaagctacaaattatgtagatatttttgaagtctacagcagtagtttctagctaagattccatgcctataaagaaagttgattaaatgattttatgtgttttcaggatgaacaaattcctgagccaaagaagttgtaaatgagaattatttagttttaaaagcttaaaaaacaccttcaaagatcattataatttaaaaacctattaggatgaattattgggctatatcctgcatcacaaaaccaatttggaaactcaatttaatgagcttagaggtcaatatttgctaaattaattggaagatattgtattttcccttttttgagctgtgtagacacagcccttttggctggaacacactttgttacttatataccaatgaactgaattctgatgaggtcatgttttgacgtaggatggggacaaatagtaaactttcgtaaggatcttggaagatacctgaaaagactcagccaacggagatgaggattgactgcatgaagtgcattggagagaacagaagtttctgctgctaaaaaccattaatatattatttttatttttattatgacttagtataactaggtaccacagtaaatcgatgatcataaaacttttcattgtatgtagtacaaaatcagaattgacacatatttaaaaatcttcctatgccttctcagagtctggtgactttttaaaatatgtgtgagttgcctgattcttgttgttcattaactactttagaatgacacatgggatgcagtggtgagcttagtgtttttgcaatatgtagaaaactttttacatatttgtgatggcaccaaagctgtcatgtagatgttttgcggttgtatttttagatccaacgttaatgaaatgtttaactgacagctgttgaaattttgaacttttaaagagatttaaaattttaatgaaatggaatcttaaaatattgttttgctggctcaattaaaaacaatttcaaatgcatttagttgaaactgacgtaatgatcaatttcctacccatataaaccctagtgctagaaatcttattttaaaaactcttgtttcaaattataaaacctgtaactaggaggtttgtattcatttagttgtgtgcatatgagcacaagagtctaaactcatttttatataacctacatttaaaagcagtcctaaaaattctaaattctaaatttcctccaccacgcctgaccaattctgaatttcctaaaaattcttaattttgtttgtacattataatatgaagaggagagttattctatatatttcaaatgatgtatagcgtgggcaaatagggagacctcctctctacaaaaagtcaaaaaattatcctggtttggtggcaggtggctgtggtcccagctacttggcgagccgaggtggaagaatcacttgagcccaggaggttgagggtgcagtgagacgtgatctcaccactgcactccagcctttgtgacagacagaccttgtctcaaaaaaaaaattcattaattaattaattaaaataaaatgatgtaaaaaagtaattttaaatgagagttgttttatttgtttgtgtccattttttatttgtgcttgataagaaacaatgagatagcaatctaagctgttgataattcccagaacattcctttagaatgtttcagacaaaattatacataattggttacaaggggccttctgatggctttaaaatgcctccgtttaggttccttctatttaaattccaattcactagggaataagtcatgtatacatttgtagagttcttaatttagtgccaaattccttgtcaagattcaaaattcatttactattactgatcataataatgagtcattcgattttatacattaagaaaatattttaaaggtctaattttatattatttaatacaatgctttgttattgatgttactcagatttttgatcacagaatcaagaatgagtgaatttataaaatgtctttcctatatgagtatgtctaacaagcatacccattaaagagtatttcttataaagccaatatatcatggcagcatttagcatattaaaccacaaagaaattatgagttagcctgagaagtggcagtactgcttatttatattctgacagatttaattatcttttaataattgttcatgaggtgattttatttttgatgatctttgtgtataatgatagaatatagatgttttcttcttcagcctatgaaggctgcatttttaatagcatcacaacataatattcatattggttgtctagtttttagtgttctagggtaaaattatgattttagggcataaaaaataggatcagttttccaaagataaacacaggggaagataagacgtttatttccttttaatgtcaccatcatcatcaaaatttattgcttaatatttatttattgacttcctcaactatctggtccggaaacagactattaattatggaacacatgcccataaaaacctatatgaaatctcatgtaactgaaaaattttttagtagatagtgagaatacctacagaaacatgctaaatactatctataggtattccagacttttagttactcagaggcaagaaatatgtggtccctgcatttattagtatatatatgtactgctttccccatataccctaaatatttgattaaaggctgtggacatgaacattataaacacaaaatatgacatgtgcttttgctcagataggccttttatatgtgttttagaaaatcaacaaataaacaaaactattgcagaatccacttaaaaagctggttttggagaagtctaacccccatctcaagcattacctaaagcaggttctaaggggccagtgagcagcctgagcaaatgcacttcgattaggtgaaaggttgctgagtttgtctcaaaccctgtcaatattgtctgagagagagagctagcaaagagcaacagccaaaaacagtaagtaaattgaattgctacttaaacaagcattattgatattatccctttaaaaatccatgaatttatctgctgatgaggacagtcctaaaatgcaacataagtagaagagacgatctgatatctccagtaagaaaacattaaatcataataataacaactaacatggagcttggacatttgacgtcaactcttttaattgacagataaaaaatacttgaccctaaagcagttgaatcacttcttcatgggtcacacagctaaaaagtggtagataaagaaatgaaactaaattctacctttcctccattgtacccattgccatatttccccatctatccaggatagctccaatttacatgttactgttttcctagtatagttgtaagtagttatcctgcttactctgtgcctggttcgatgataagtaatcctatgaccacgtcaaatatcatataatgtaataaatatgaaatatagggaaaagagaaaagaataaattatgtaagagcgggtcagaaagatttggaggtgatgaatggataaacaaaagcaagaaagtaaaacagagaaaggttagaaagagaatagaaaagttaggggaaaaacaggatagaaatagactgatttcaaaacatcgaggagaaaaaggaatataaatttttcgtaaatttaagaatgcaggttctgagacatgaggatcctaagttcagcctcccatgttttatacgcatggtacaaattcatgattgagatttctgagatctttaattagaaaagaagccacaagtaaattgtagaaacatctacagctaagtgatactccaaaaagcagtcattttaaatgatttgctctaaatctaagcagtttgtatgtaagtggctaaggtattcttagagattcctttagcagtaactgcaggcattggcaagcctaataaatattaaactgaaatatatgtccttatatcactcaaatatgttggtatatattgctcccataaaaaactgggaagtctatggctgacttgctcatttctgtttctgccactggatctttttctccacaccctgccaaatctttgcaagaaaaacttgatattaaactccataacaaatattgttcttagagaagccatgttaagaaattcttggatctgagaactatagttcagtatccattttgtggtgacattttatttctttaaacttagaagcagtatgccaaatattcaccatttattattcatttgctacttttttactgcccttcctcttatttttgagtggccttttcttcctctttatttcacctctcttacaatcccctcatatcttcttcctgttttctaatgcatttctacccactttccacccatcgataattgagcccataagggcagtcgtattggcttcagagaagagcagtggacccagagtgatgctttgagggacctgcactgccagtcctgctgaaatcatccaaagtccacagccagtgttagatatttcctagaccgtcagtaaaatgacaactatcgtaaccttacagaaaataaaccacggcaaatcatcttttataatgacaaaatatattgtttaaattgttaaccatttgtggatgagaatctttctgattatatatttttcgccttaattcttataaatgtagcaacaatataaagagtttgtaaaataaaaggaaaatacccatctgcctattatttttagaaaataactaatatgttatatgcattcatttccagtgttttaaagtaacatttttaattaaaacacacacacacacacacacacacacacacccaaactatagataaaaaggaaaatgaggaaaagtagagaggaaaaatgaacgtaagcatggtgttatttccaagaattgggaagtctcagaagctcaaacccacacccagaagaagaacgcccagtaatcttaaaaacttagcccagtgggtctcaaatttgagcatgcatcaggatcactgagggggaaggagactgctaaatactgatggctgggccccatcccccagagtttctgattcagtgtatcaggggcccaagaatttccattctctaacagtttccaagtgctgctgctgctgggaagtgactcctgaactcattccaaatagcagttttatgggaggatttatctgtctctgagatggagatgtccttgattcactatttttcttacatttatccataacgatcaatcaagtttgaggcagtccttcccaatttaataacaataccttagtgtttgtgatttgtatacttgttcaagaatactttcaaaccagggagacattgtcattatttctattttgtaggtgaagaaattgagacctgttgtactggttgtgagacctggaatagagctcacttttcttccttctggtctatgatttttctcagtttgtcaggttgccaaaggatcaggcccaggctaagggaacaataggctgcccatgtccagactgaaagctcaccacaatgaaaaggtcttggctggacatccagtccatggcatcagaaaagctttttagctgacttggtagcttgaactttcacagaactatgcaatatgacaaggaaaattccagcttgcatgaagcattaaaggagttgcaagactggctaagagagagccgacagcactcgtcaggggacccacgacaatggtaatggtagttgggaatgcgtctctggggtaacactgcccagactaccagcaccttgttgtacatgctgggtacctcaccaccctaagactccacttctagagctgtaaaatgtgtctaacaacatacttacctcaattgagttgttctgagaaatggcagttcaggaaatatgtagtgttagctctcaaggcacatgaagtagcacacatgcctttcacttggtttgatctccccattacctaatatgataatgataatgtagtagacacttaagaaatagcagttgaccatcttggtattagactgttgatattagtatatctgcatttctatcaaactattactctttcacattggataaggtatattgcttccaaatcatgcttcaattatcaacaaagcaggactgtaaaattacattcctattatctgtctttgactatgaacatagacatttcagtttggattcatcttgaagctggctgatcgagcattaagatttgtaaggctgtgaaaagagaccttcaatgtgtgaattgcaggtgaactgagagcactaattcaggagttgataatagctggttgtggaaaagtctccccgattgtctaaattttagctcatatcaaaaactgcaaatttttacctaacatacctagacattaagaggaggcatgattacaaaatgcaaacaagcaggactcagatttatttactcacatgaccacctactatgtctgaggtgtccttttctactgggaccagcacttagacccgtggcacagcccttgacctcaatgacctcagtctggtgtgcagcaccttgttttatatagcttattgctcagacacctgaagactgtgaccctaaagtatacttttctagtttcatgtctactggtgagatggttgttgtgcttaccagagtaacaaagataatttccattctcacctccctggattgtattgaatccagcacagggtactctaaagtattcactgatagaggcctctaatcacaagttactgcagatgtccaatatacttgaatttttcaaagatggtatgtatctatctttctgtgtgtgcgtatctctgtgtatgtgtgcgtatctctgtgtatgtgtgcgtatctctgtatatgtgtgcgtatctctgtgtatgtgtgcatatctctgtgtatgtgtgcacacatgtgaaccaccaagactttgttcatggtaccagagtgatataattaatgaggcagggcaaatcatgttaagaaaaataccacctgactgccttctcaatatgtaagtcttgggaaaaatgtttatattcatatataacacaagtcaaagtcttaagatcatagttgtaagttaaagagcttgaatttaaaaaggcaacaaaagacataacaaattaaatttgcttgaaggcaaatacagactttgccacttactagatgtgtaccttccagcaagattactgtctgtatcccaagaaatggaaatatttgtctcacattattgttctaaggaatccatgagccattgcagacaaaatgctgcttatagtgctggcgaacagtagacattccatgaaaggtgtttttatcattgtttattccccatactccctcacaagcactcaagatgtttacaattttaaattaggttgttggatagtcagtactttaacacattggaatgaacccttagtagtataattttaaatactatggtatggaattaaaggagatacatagatagatgtgtcatatatttttaagacgaatgaaattcaagatggctgcagtggaaggataaacaactctaacctagtgtgtgtatcatatacagctccctataaattacactatacatgaccacactaacgtgaacattaatttagcaaactctccacctttgctcatcttgactcctcatctagaatgtctcctgtgtttgattgttaaattatacaccttctttatactctctcctccacagcgccccttctctgattcctgtaaacaagcagagagcacatcacaactctggtactgtttgtctgttgtttcatatttgtgtttacagttatctcaattatattccaaattccaaaaggccacctttatatttgttcacccaaagcacaatcctgggctgaaaataggtaatattttaaactgtaattttgtggacaaaagttagtgactacaaacaaccaacaacaacaacaaaaataagcatttcaaaaaagttcttagaggaacaaggaagtgaacttctgaaaataagactagtaaatcaggtagaattttgaagctaacattcttggtttccttgacaaataaatttcacaatttgtttgcttatctaccatcttctttatgtgatataatgaagaaaaagaaaagatttaaagcaaacgtgaaagactaaagccatcagcatcacagtagtgcaaatcttcacaggggaaaatacagagacatgtttcagtctcagaagagacttggggaccttctgtgaataagtgaattaggttctggagtagaggctctcctacaaggacctccaggaacagactcagagctctttaataagtatcccagggagtcaggctttcttggaaaaaacaaattagtgtgagaagccagtactgtgcaatttcagttttaaaaatagccggtattgtcaaggctgctgtgtgcatgagagaaatagaaggtccttgttaattttcgtgtcagcttccacattaaaaccaagaagctccactgaaatccttgcctggcaaatactgcaaaggttataaggttcgtatcacttagaatcacttttggttcttccaatgacaaacttttgggagggaagaggttatgtccccttttatcacattggtctttcaataaaggacaggcaagtgatggctctgcctttttcacttaggaccagatctgtgcctccctgtctgtttcagcttttcatttgcctaattgccctgggaggctggcagggacgttccctgcagccgtggatccgctgactgcagagaccctacctggcactctaagttggtgcgtcagcattttaggttgaaatgaatgaaaaatcaatcaggatgactgcagtggtagcgtgcacaactctaacctagtttgttcataattttcaactattcaccgtagacccaagcagtatgtaagatggtaagtgaatctgtaacaaatgtgctgcttctgcttaatcgggcacttttttttggtcctcttttctatttggaacaagcaagtctaaccttcttaggaagccacatgtaaaatgaatgacgatgtcaagtttcatgcaaatattatttgccctggctttagattcactttctaattagaccaagtgatactcatatacagacataacacattgctgttttattaacttatgttgcaaattcagaggcttacatttttttaagagtgtttatgtttttgccacatctctttgttacttgctgtaattctctatccaaactacagtgttttaaatttctagatttacaattctgcaaagatagagttaaacactatttggactctggctacatgatggtagcaggaattgttcaaagctgccgtcttcggctcttaaaggcagctacagtaactttctgaacagattgggttaaatatttttacagacccattctatgatgataaggcggtaataagttgtgcagtgcaacactccaaagggttccaaatctcacaagcctctttgtatgtgatgctctcgcagtgaagaagattctttgggctataaagatgaagagtctacttcttctggtgctgatttcaatctgctgggctgatcatctttcagacaactatactctggatcatgacagagctattcacatccaaggtaaggaaacacagcttctcttatcaaagcctaattaattttaagttacttagagttgagatgctgggctagtgtttcttaattttagttctgctgcattgactttttctttccctttctgctaattggtgaacgtgttccctggcttttaaacactattgcattacagtagagttaagaattggggacaattaaagttgagtagcttaagaatgtccagctgcagtgagttggtataatcgttcaaggctgttaagtgcagttgctatcttcaagtaaaatggaggccataaagttcatttaaatgcaagtcagagagagaaaataggaagtaaaacttaggatataaggtcattctgttagagtaactgtttaatcattaagagaaacaatataaataaaatgaaaattagacaagctattgtccaggaaaaagtagtttaccctattataatctgcttcagttaagctttagctcctatagaccaatacattgcccctgcacatttctgttcagctcagctgattcctaagcctgagagctgtagcaggatttgaggctgcagtacaatgcagctatttcctcagtcccagcttcagatgagggacatcctgcattaagaaagctgagacttatgcaataagaggaacagttctctccttgcccttggatgctgaataattaaaaaaggaattatagaacttaacagtttaagcagatgatgataattttagataaactccattggggtaccagaggcatgataagtttgctaagagacataaaactctaagttacatcttcaaggtcaaaagcgtagcctcagtaaactgcattcactgtgaaaagtatgacttgtgaaggtcaaatgatagtgtaaatctgtctagaagtattttcctgtacgtattatgactaccaaaatagaattctgaatttgtctatgtctagctattttagacacatctcttttagttttgtttgcttccaacagctttatttttttctctgttgaactgagaaaagaaattgtaatcatacattttactctgcaagctgctgactcagctgtttctgtaatatatagtagaatcagagctgtttcccaaagaccatatgatatttacacatagagatttctaatgaggaataatacccttttaccttctagtgacagaattctagtgacagaattcaattcagccaaaatagtaatacctagtcgttattaataataccagttttatacccaatgcaatagaaacttaagccatggtttcaagttattagatgacagataccaaagttgtattatgaattgtgtacaaaccatttaatgaaaattgcactcagagtatgagaatagtgttttaaaaatgtactaacatttgaaaaattactcctataagtcagactcaagttatctcaggaaggaaaacttctgttactccagcctttccattcccatctcctctgttgaaacttagtgcaaggggatttctgacccagagtatcaggattatccagattatttgcatacactgtccacatttttaaaaaggcttgatagtccacttcattttaattgtaaattcatattcttagaaagtgcaggcttgcctcgaagagttgctaaagagctttcaagtaatagaactatatttggcttgtggaaatttaatgctgaaatgtgatttgggtcataggattatgatgttatgcccgtaaatgaaatacctgttctcattacttttttcccaacaatttttttgtgatagcattcagattgaattttcaaatcccatagttcttcagagaaactgcttccaagtgaccttccataattccagctgttttttataatgcaaaaataaatcaggtagcacaagaatcaacaaagcagattacttacttgcttcgttacttacttgaaatactgcatattttcttatatttaaaacttttatttatcaaacatagcccagaaggaattttagggagctgaaatcctcacaaattttttgaagaatttagtcagatgattaaattagctatctcaatctcagattcttgaatggtactgataagcagtatgagcttctgttagtgatggaaaatagttgaaaattcacgttgctgtaaaaatatcattactctctcctatttttgattagatttctatttttgtactccaagttcccaaggtctgaacaacattgggaaaattgtgcaaatcagcctcaactttttgttggctgccttgatgcagaagctcaacattttaatgatacatttttgagttccatgtgtatgggttagctaattgtttttctgaagcctcctcataattttgttgtgggaggttttatagagatatagacacacacaaaaaagtttaatctggatattaaaaaagaaagaaagaaagaaagccaggcatggtggctcatacctgtaatcccagcactttgggaggccgaggcgggtggatcacgaggtcaggggtttgagaccagcctgaccaacatggtgaaaccccgtctctactaaaaatacaaaaattagccgggcgtggtggcaggtgcctgtaatcccagctactcaggaggctgaggcaggagaattgcctgaacccgggaagcagaggttgcagtgagccgagatggtgccactgcactccagcctgggcaacagagcgagactccatcacacacacacacacacacacacacaaaacaaaggtaaaaaggcagatggccaggaaagaaaatagcaagtgtagacccctatgcaaggtatttctagtgaaaaacatttctctggtaatgagaaagaaatctctcccagcttcccatggaaaaagacttagctttagataaaaatttcacacacactaatccatttcctttaatttttcattgaaataatttgatcatacaggaaagcaaacttcatttgtccacaaagtctactaaaaatatgcaatcaagatattagcttgtatataacatactgtcctcaatgtaggcaatagttatgttctcaaatacctctacaggaagaggggccactgttaatatcctctctatacactaaactaatggattttgttcctcatgtcacaatgtggctactttactttacttttaaatcctttgaaacttgagaccattaggaagagttttacatggagtatcaaatcacacagaaagaataatatttataatatttgtatcaggtccaaaaacttttgtgtagcctttcaactaccatagaattttagagatgatgaatacactcttcaaaatacaactttttagaagacatttacagataacagagaaattttatgaccatttgcctattaaccaatatgcaaagcaaaatagatgaacatgtaactacttgaccttatcaaggtcagagtcagtgcttcctgcatttggtgttcaagcagaggtcttctgatgacaagtttcagtctttcctgtaatgccactaactagcttagaccttggaaaatttacttaatctctccaaatcccagttacccctctgtaaaatcagacctaatgcctgcttattcaatagagctttgtgagaattaaatgagataatatgtggaaagtgcttagtacagtgcctggttcccaagagccaatacttatccaggtggttgttatcattatgtttattgcttcctccctgttatggaaaattgatttttaaatagaaaacagactacaaatactggtcaaaaaaattcatgcttttcaaagtacatttgttaacagaacatatcatcaccttaattctaataaagtaaacattttataagttcttttctttgccttctttaatttcacaatttaaaatgtccccattcatattattactttaatttttatttatttatttatttttgagacggagtcttgctctctcgcccaggctggagtacaatggctcaatcttggctcactgcaacctctgcctcccaggttcaagagattctcctacctcagcctcctaagtagctgggattacaggtgcctgccacagtgccctgctactctttgtatttttagtagcagcggggttttgcaatgttggccaggctggtaattcctgacctcaggtgatcagcccacatcagcctcccaaagtgttagaattacaggtgtgagccaccacgcccagcctccccagtcacattaaatattatctgaccatttttactttcctggtagaaactaaagttctccaaacataagtaatattttcccttaatgtatttactatgtgagcacagatccgctactttaaatttttgtaaggcagaacaagaggaactcccagaaatgaaaactgtgtccttctatttaataagtaaaagtaattgtcacttttgtcaacaaataaaacaagtagatttacttaataaggaattgccagaagtttatgtctgtaagtagaaaaaaataaagtctatccataaccgctggcagaagtgcacactcctctctcagcttcactattcctcctcctgctgcgtgtcctgaacctgcctccccttcttcaaatctggttcagtcctcacacggacttcctgctaacatgcctccctccctcatcagattgtctctcagctttgtaactaactccaactatagagcagtgccaggcacatagtaggtgctcaatgtatgtttgttgaataagtgagtgaacaaatgaatgatgaaggtaatgagatacttctaaattgtcactaccataatgagcatttgttaaatgctgtgacatcgctggcatttagcagcatgtgacacattgtgtgcacttaatgaacattagctagatgactgctttcactccgtaatgttggcatcagctaaatcatagttcacacaatttaagaacttaaaaggactttggtagcgattgtctagaccaatcttccaattcgcgaatgaagaagtcaagactcagagctttgcattgcttgtcccaggctacctggctgataaaagtccgtttatctagttaaccccttcctttacttcaaatctgagcttatttctcacctttttaatgaagtcaccctgactattgcaatctgtccccctctggtatcctaatctctctcacccttcttttctttctctctgtagcactggctgtatactctacttatttttatgtaattgtttgtcatctgtctctaccacaagaatattgaacagcttcatgaaggcaggaatctttgtgtgatgcatcccagtcacataaacccaacaactggcacatagtaggtgatcaatacatgtttgctaaataaatccaggaccaaaatccagttgttttttctaatcaagttttggttcagcctttccaaatcccagggaaatattttcaattcatggaatgagaagcagcagatgaacaagagaattatgaatttgggttgcaaattttgtttggtcttgtgcatggctcccacataacatgcagcatctgatactccatgagagtccgccaaagacaagttgcagcaatcttcctcatgcatgtatgcatctttgaagagtattggatttacatttggtcactgaaatgctatcctgttccttatgtaataactgcagatttgggatttggtggtacagaatgtatcacaaggagtgggtgaatctaataatgtatgatcacaaaccatctatagagccaaagtttaatgggagaactggatacatgttactctgtcttaattttctctctcccacctaaaacttatttaaactatctgagtctgtttggaaaagctacatcaattcattttcgtctttttgaggcagaatatcttatttgcagccaccaaagcaaaatctacaaataccaggaaaaatatctacaaatattttataaatcacaggtggaaatatacttatatatatatagttaataattctgtctaaaaactaatagctataaaacatcagagaattccatcgtggaattataaaaattagcacatcatccatattagatgactaaatcttaaatttcttatcaatttacaagagggcatgaaaccaaaaatgaaaataagaacacacagcattaaacataggcttgccatttgatcaaacttggaatatcaccatattaatataataaatgagctcaaaagtaaagaacaaaagtatatatgtaggagtatacatacatatgtaaaaatgctcatatattgcacccatgcatatacacctatagacaacttatttattcaacaaatgtgttaggtgcttatgtagtggcattagggatatgatgacaaaacatacagtctctgcattcaacaatttatagtctagtgagagagacagtcattactaagaataaagagctattaatcatggtaacagaaatatatattttcttaccaactttgcttctgtcagtaggcataattgctagcccatgtccttgtcttctttgtatttgtgtgtccttttgagaaaacagaattcagccatttgctgaacattggccacctccatgcaaaacactgggttattctctgtggaaatataaaccatctcctcagtgtgtttactgacaatattatcaaggcaacaagcaagcaagaaaaaataaaataagtgttaaataaaggtggaaatgtagagaaaagagtaagtagttaccaaactaaaagagcttattatttagaactttgaactatatccattaaatttttaatcacttaatagagctgaactcataaaatacatcttaagaatatttctaaacttgatattgaaaaatctagaatgctgaattctatgctattctgtgaactattaaaacaatacagttctataatatttccaggtataaaagcttatattgaataatctttgcaggtagtaacaaatccatactaaacagacattgttttctctgttttatcctttgtgctgaaatcagcatagtatgtgtgaagccaatgattgtttggaaactctcccaaataccaagaaaatcctattaaatagtgacgcctttctttttggttgcagctctacaagaaccttgactcagctaaagcactatagcttaatggcttagtattacagtgatttcaacatgttgattctctgattttaccaaatatcaagaaataatagctttagatttctttattgattatgttctttaagtggaaagtggaaaattaccattttggaagagtcttttggaatacaaacaccaaaatgctaagaaattaaaatattcaatcaagaggttatcaaactaatagtatctagggagaaaatgaaatcgtttttaaagcaatattcttatttcaaaatgaaaacattaaaaacataggaaattatttgaaataaaattacttcaaaaatattttgtgtattttgtgttgccacaatacactagccctagacttgtctgccttcaagaatgattatcaagtagtcagtacaaatagtatcattttaatcttggtttaattcaacatgttggttacttgacttcactgttagtcagtgactagtcaccatgtctaaggtgtgtggagtaatatttacatgctcagggattgtgctgtggagtatactgaacaaaataagttaaataagaattctctctaccttttccaaacactgttgactcaaaagaaaaacagacattttggatttagaaaacccagaaaggccataatccatcatgtataaaatgaatgaagtatgttagaacaagaagcattttactacagtcaagtatggagattaggtaaaaaagtaggaacaaaggagagtcctatcttatttctaaagagggattgaaagtttaaaataaaaacgcctttgaaaacatacccttgaagggaggagatttccacttctagctgattctatttgaaatgctgcttccctccctgctttagcttgttcctggaaagcattggaaattatgttgtctttttggctcagagttactgaagggtagagaaagagcaggtgaaaggaaagacatgtaagtcaaagatatgtataatgtagccttatacattacaagatatatgacacgaatatattttctttctagatgactatatttgttcagaatgatttcacgattatctatgactaataatattgctggcaaaaaataatgaacacttttatacaaggctttttattctctttttttttctttttggtttcttcagcacagaaaggtaaattacaaatttttaaattttcaaattttcttctccagtattatatgggttatgaacaattcttactttctcttgaaaaatgttgtcaattatgctgtcaggttttaaatctccaaaaatctgcatatgattattttcatatcctcattttgatttgtcttttatcacagtcattaacaaagggtcttaattaagagcttaaagtaccaaagtactaaaaagctgattagatagataatgcttcctttaaatgtttccgtataaacagaataccttattctaaaagatgcatatggtaacagcattttatagacctcccacaatatattaaaatcaaagtgtgttctaaaataaagcttcctgaacttcggccttttttcttataactcattatttggcttatgtacataattgaataaataaatgaaagcaaaattacatataaataataaatataaaagttttttttggaagacacagtggctcacatctataatcccagcactttgggaggccgaggggagcagatcatttgaggtcaggagtttaagaccagcctggccaacatggtgaaaccctgtctctactaaaaatacaaaaattagccagacctggtgtctcatgcctgtagtcccagctgcttggaaggccgaagcaggaaaatcgcttgaacccgggaggaggagattgcagtgagctgatattgtgccactgcactccagcctgggtgatagagtgagactagggctcaaaaaaaaacaaatgtttttaagggaaaaaaaggttgtgagagagcactgagggggcagtgggcccaatggcgttcgtttgccattgaggacgagtttgggaggtgccctctaagcaaggacatcaagctgagatctgaataatgagtgggagacggtcacataaaaaaccagaggcagagcattccagggagaaaaagtagaaaatgcaaattctctgagattagaataggcttgatgctttcaaaccgaaagaagcccaagagactgcagcctgtcagaggggaggttgtgctttcagagagtaggcaggaggcagaccacagtactttataagtggtccagagttcagagttcagactttattccaaaatcatttgaaaatgtttaaaaggtttgtttgagcaaagggtgacataatgtgatttacatttataaaagaccatgtgaataatggattacggtgggccaagagtaaaggtgaggctaccttttaggaggatcttgaaagttcaggtgagaaatcatggtggcagggaccaggatggtagcagtaaaaagggatggagatgaaccaatttgaaaaaaaaaaaaaaaaaaaagtgaaggaagaaatggcagcaattactgatagattggatgtaggaattaagggaaacagacacctcaagctcagctgctagagtctggcatgaaccgaaggatggatgatggaggcataaactaaattgagaaagactgggagaacagatttgggcgagggaggagggactcaagttagttatttgtcattcaatataggaccaacaggaagatgggtttactagtttcatgctcaggaagaagtataatgcaagaatgttttggaatcatcagcacataagtggtatttataactatgggaccagatgagatcacctggggagggggaatatgcagataaagggaaggagatggacctagtatgagttttgaagaccctcaataccgacaggtgggataaaggaaaatgcagagggcacatattcacttcccagagtctgaaccttgatcactgatgtgtggaattacttttctcatatgattttttaaaattttaaattagttgcaagcatttggacataagagatttttgcattaaaaatgtatttctagcctctgttgaaaaatccaaaggcctgctatttttcagccttcatcctcttaagacagcatcactgggaacctgtatctgctgactgtttagaacggggcctgtgctccccacaataggtacagtcttttccactctttatcatcctcatcatgtccaggtgctctcttcactcccctcagccttgcccacctgggcatttgtgtttgacttgccttttgttttgtttcagcactaaacttattacctgacccattgtaggctgttgattcatgtttattagataaaaaaatcaaagttcctttttatcctctgttgcctctaggattgactcctgtgatgggattatttcgacgtcttctttactaagtgaagacattagccttatcagtatatacaaccaacagtgtcattctacaaattacaaattacttaacctcacactttaccacaaagtggaagtggtctgaatggagacaagtagagttgagctctatgcctttaccacatcaaggcacatttccaacaattaaggagtggtagataattacagcctaatgaagaagaatgactcatgctaatgttttcgtttccccatatcctttgaaacaaacctctaatatagttaaactcctagagagtatgtttatattaagaatgtcactcaacatattagtaaaatattctaattttatttcattttcttgtgttctttaatcactctataattatgataacctggtttgtgttttctaggtctaaaacataagcattaaatgctagttatttatccataaatctttgataacacagaaaaatttaaattctgaaaattattaaccagagcagacaactctaagttgacaaagatactaagattatttttacttctataacaagttacatcagaattaacaatgataacaacagtaataaattaatattaacatttaaaatcacttactatgtgtatttctcataaaaagttcattacctgggtcatctcatttagcactcaccataagatgatataaagatggttaaccagctgggcatggtggttcacgcctgtaatcccagcactttgggaggccgaggggggcagatcacctgaggccaggagtacaagaccagcctggccaacatggcaaaaccccatctctactaaaaatagaaaaattaaccggacacggtggcgggtgcctataatcccagctaaaagatggttaacttccgaaattgagaaaggttacatagcttgtcccaggtcacatggttgttaggtgctgaggatgagattaaattcaggcagattggctcttgtgctccaaacccatacatgaacacacagcaacatcaaagccttttcatggcatcttttgcatgatgcaataggtaaaaatggtccccattttattccattcaatttatataactacgtttaagaagaaataaaatcactaagagaaataaagtttggtcttgggctttagagaagcttttctgggccgggtgccgttgctcacgcctgtaatcccaacactttgggaggccgaggcgggcggatcacgaggtcagggatcgagaccatcccggctaacacggtgaaaccccgtctctactaaaaatacaaaaaattagccgggcggggtggcagacgcctgtagtcccagctacttgggaggctgaggcaggacaatggcgtgaacccgggaggcagagcttgcagtgagctgagatcgcgccactgcactccggccttcgcaacagagcaggactccgtctcaaaaaaaaaaaaaaaaaaaaaaaaaaaggaggcttttctcacagaccaccattgtgattcttaacaggggtaagaggaacaaggaatggatggcaactgcaaatatacacattccacatccaccccaaatacaaactgtctgaaacccccaaggaaatagaggaaggggcagacaggaattgaatactatagatacaggtagatataaatgtagatatagatggatagatataggcacaggtatagatatagatatagatatagatgacaaagacataggcataggtggaaagatagtgatgtttgtttaaaaaggcttctagaatagtagtcctgaaatgcactcctgtcttgctaagaaccactagattaggcgatcctcaagagttgatgagatgtgaatttctcaggaaccaacactttctaggaactgccttctggaagagcacggtaaagaagacagtgtagaagatagacgctgttttgtacaccaggcacattttagacatgtaaatatttgctagtaagagtctacaccagctgggcactcactataggccaagcaccaagctaagttttcaatgtgaattacttcctttaaccctcacaagaacccagggatgaagatgacttacttccatttactgatgaggaaactgaggtacagaaaggttaagtgacacaatgtaagagatatagtccatatgcttaactaatactctataactgctgagaaaagaaatgaaataatgaatgtggaaaggcagaagccacaaacaactttatcaacagaacagagttaaacttcctcctcacactttacttcttcctgctagaaaaaaaagattaagaaaagagaattaagaggagacagaatatttatcaggatattatcagagtttctggtgtacatctcagaacagtgatttttaaactatgttcagttgacttcctagagctccttggggcctcgtgatgcccatctcaagcagagaggctcacgtttataagattacatggaaaaggtttgtcttagatatcctttgcgggggcaaggaattccactgttcttgaaaaactttttttaaacattgccatagataaacctccaggctccaaaatagtgatagaatttatcttcatttttttactatgaaacatggatcataacatagtacccattcatgatcagcatcactcaaaacagtactatattttggtattgagcagtttcccatcacataatccatttagctctaaggaaagagaaaatgatggatttggtcaatacctaccaaatcatagcttcctggcatatcacatgtgataatgcagatctcaacaggaaggcaaaacatgccatttgagaaattataaaaacacaatttagctgtagattgatagcaaagagcagagcatgaagactacacagtgggtgcagagaaggtagcccctggcagggttgggaagtgggctggatgggaggagtacaatctcgtagcctgtgagaccaaaaggcaggtcacagatgatgaaaaacagcaccaatcactttatatcaaagatctccacttatcctattttcagcattagatttttttcctttatggttcaaaaccagacaacaattactatcttcagcaatagtatctttaaaaaatagggaaatgtgataccatgtatttcgtgttttaaatacatgtttaaagataacatttttagtaacacagcaataggtatactgagaaaatataatccttcaattataataatatagtataattatggctaccagcttcttgtgtagagagactctagataaaaggttcttgtctatttgttaaattccctcaacttctacatttatttttataagatttttatttagtttatgcatgggtggtacattcacatggtttaaaattttttaaatatggaagtgtacatgtgaaaatctcccaagccttcctctacacacttttccccacaacttctcatagtctaccaaggctgttagtttcttgtgaatactttcagatatactttatgtcaaactacactacacaaacttttgaattctcataaatggtaagaagcacacatactcctttgtatcttcaggtcaaagtttaaacttccaggtgaaagcaaagatgtgccagagaaaaattccagattttttttttttttaagatgaagtctcgctctgtcacccaggctggagtgcagtggtgcaatcttggctcactgcaacctccgcctcccagattcaagcgattctcctgcctcggcctcccaagtagctgggattacaggtgtgcaccaccatgcctggctaatttttgtatttttagtagagacggggtttcaccatgttggccaggctggtctcaaacacctgacctcaggtgatccacctacctctgcctcccaaagtgctgggattacaggcatgagccactgcacccagctccaggtttcaaattcaaataaagtaggtgagggcacaaggcaagaatgagatcatttttctactacctttcttaccgtcttcctttctagagactcaagatcctctgcattcaataatagctggggaagcaagctaaaacttggtctctgataaaagtaatgaactctttgaaagaacagtaaaggctggacgcgaagggagagggttagcatggatgggggtgggcacctggaaaggtttctgatgcgatctgattagacacattagaatcatgaccaaaagataggttcttctgactccaggtgagcagtttcaggagaaattagatttcttccagtcttaaggaaacaaaataatgataaagttaaaggttaataagtgaggcactctttattttctaaattttgtgtcctactcaaatgtaatgtgtaaagtacgagagacaaatgtttaaattacgtattctacttaaatatggtgtctttaatgtacataactgtttttataaagtgttttcattttagagaggtagtgtggtgtgaagcaagctcagatatccatgtttactgccatagccaggcccaagctgtatgcagcactagtatatttcagtcatagacacttattgcatcaagcactatgttgatgctggagaaacaacataaacaaggcagagtgattgtttgcaatagaccatggtaagcacagtgatggacacaaatccatcctggctgctcattctcctgcaggctttggctaccctaaggaaaataacagcttccaaagtgttagtattaaacatccaaatctgccaaagtgttaacaaatgtcacaaaataaagaactgtttttaaaaccttgtgcatttttttttcaaataattcattatggagctgacaattgagtctatgtctatcagtttggaatgtcagaaagaaattaactttctgtttgggatgatgaaaaagttttggaaaggggtagtggtgatggttgcgcaacaaggtgaaagtaattaatggcactgaattaaacatggttaaaatagcaattttttaaatatatattttaccacaatggacaaaattaaatgatggtggtagagtattttcttggagagattatttttaatgttcttatttagccatcttaaatacattccccagttgggttttttttttttttaattattattgatctaggaaatccaaaagtctcgagtctagttcatccatacaccagtggaaaaagtaaccaacatcaagcctggctagcttgcaccatcctcaattcattttaaaaagacaaacttgttttttaacattgaaattttgatttgtatcagggaggttcccaagggcttcactttcaaaatgagtggtgtaaggaccatgagaatggagggatgaaaaagtctttctaatgggaaaggctttctagagaggagcgaggaagcccctgacaaccgatcatccctgtctttctccaggagggctcccaatttcatgtaatgtcattgtttcccatgatgattcataaaatgtataactacaaatgacctaagtttaagatatgactttgtatggattaaaaacagaaactttgtggctcacgcctataatcccagcactttgggaggctgaggcaggtggatcacctgaggtcaggagttctagaccagcctggctaacatggtgaaaccccatctctactaaaaaatacaaaaaattagcagggtgtggtggcacgcacctgtaaacccagctactcgggaggctgaggcaggagaatggcttgaacccgggaggcagtggttgcagtgagccaagttggtgccattgcactccagcctgggcaacaagagtgaaactctgtcttaaaaaaaaaaaaaaagaaaaccaaaaacacacacaaactttgatccatagcaccctttccttttttctatcacctagatttctgcgggtataaaccgccaaataaatttttatgcttttaataggactaagaacaataggcagtggtccaatgtcatagttttaaattgtttttctccagttgtgcttgtcctattgtttaaaagtcttcatctaaatttcatagcaagtgtaaagatcagttgtttgctcatgccattgcttttattatttggtgaaactaaatgatgtcctctggatttcacagcagaatttgtaagataataacgaggccccagcggttcagtgagtccccattagtgttctcaccaggccctgcagtttcccctggagacaactctgagctttgaagggcatcagatctttcaagtcattgtcactaatggaaatggggaatttatttacttgtaaattgcactttaaaaaatttcagtcccccactggacatcttcaatttccccaatttcaacatacagcctcatttatggacaaaattaagctcttcaacactatgcaagtgtttatgtgcaccttttcacactgaaaggaaaaggggaaatggacacttgtatgctacatagttttatttattttgccatgttgttttttttttttttaaagcaatactcattctaatgatcaaggtttatttttatcttttgcatttcaattgctatgccacagcctgctaatcaaacagttcttttttttttttttttttttttttgagacgtagtctttctgtgttgcccaggctggggtacagcgacacaatctcagctcactgccacctccacttcccaggttcaggcaattctcctgcttcagcctcccgagtagctgggactataggcacacgccaccatgcctgtctaatttttgtacttttagttgagacggggtttcaccatgttgaccaggctgatctcgaactcctgacctcaagtgatctgcccacctcagcctcccaaagtgctgggattataggcgtgagccactgcacccagccccaatcaaacagttttgatttaaacattaatttcaaactgatccaggagtttaaatccaattatcagattcaagactttctctaggcaaaagtgtgcaaagtttgtaatcaacgcctgtggttccctttcctctgtcttcactcctttcatttccctgtctaattcagtgtgtttcctggctggtctctgtgacgacaacctgtgacatagcacctgatgagaactgcaagctcaagattctcatgaggtagacttagcagagtccaacagctaaggcatgggagagcctgcaatagaccacttctccaaaatgctcagagctgtgtaatctgaagtgtagatcttctaaaagcaaacaaacaaacaaaaacattattctcaaggccatgttggaggtttagcctaaggaaccttaatggccttagtcactaaatatgttacatacctttgctagggttctttgaatttcagccagagacttctggcatctattacttcaacacacacacacacacacacacacacaccccaaagtgaatgagaatggtagaattttatacatttcgataggcttgttaaaaaactattttgggtgagggtcagtggatgtttggtgcctgcttaattttcaacattataccacacaagtcatcctctattcacaatgctggagtagaaataaaacaaaaacaaaatcagaaacctacacttctaaaatactgcaagatggtttacagttaaccacagaaaaaaattagaagtctgagtcccttataccagagttttgatctttgccttaaccctttaatttataaaacatttagaccttgtgttcattctggaacagtttatgattaaactaaacctcccaaatttccaactctcctatttccaagtctcacaggtggcattttatgtatttactttttactccacatgattcaaaactttataaataagtgaaattatggaagactaatatatgacaaaattatgctctatattgggcagtatcttagttggaaaatactgtgtaaaatctatgcagtaggaacagtttagtagttagtgtacacctcgtattggtcagccattgtcctaagtgctttatgtgtattaggttaattgtatattgtaggtaatagtatctgtaattcacatataaggaaattagggcttagaggctgcacaacttgcccaaggctacagagctagtaaattgaggaagtgaggttagaccaaggtctatgtcacattagagcccttgttcacaactgctatgatatcctctatgccagtgcatttaggcattatttttgattttgaactaaacaactgaaagaataatgaaactgagacctattttagctatgtgtcatatctaaactatgtttcagtatgggaaggcccagctcctggagtgttcccacacaccacccttgccccccacaagatactggtgaggaaatgttccctatgaccctcaggcattactgagaaatcttagtcaacagcactttttcctcctcctagaaagaaggcactagagatgtttcagtagaagttggatgcaggcattgtggacattgtaaggaaaaacttatatgtagggtagaattacatagagttatgttttatatcttgagattctatggtcctaaataatgagatcaagaatggaatataaaggaaatgcttaatgagctggatttgtgattcctcttaactaagtaataaatgaagccattatcctcgcatttcattatctattcaaagtgaggggcattgatggctttgctaaacttttcagctttttgaggcttgggactcacttataaatgaaatgatatgctcattaaaaatattaattctgattgctatatgataaaaatagagatgctgtgtctattttttggatactttctattttaaaatccaaatcctatatttgccattcaataactgtgtgtctcaacatggctactcttcccagtgatttggacatcttaaatgattcatggcaaaggattattcaacacctatctgcccaaggcaggaggtctgcagagttgtgtgaagggcagctttggtagctattaaaagctgtgtatagacacaaagatatccgtatccaggagctcttatgtcactttctcattttcatatcttgcacatcctcaagagacactgtcaaggtcaaaagcacaatgtgctagccagggggaaaccccagagaaagccaaaatctgaaaataacagctggtatgtagaaaacggcagacctgctgacttggcaggctcaggatattgtggtgctctttggaaggcaatagagtccttggaggaaggacttggaggaaaacaaaaggacaaggaaaggaaaggtggaagtaataagataactgcaaaacaagacatagcagaaagcaaagagagagaatagaaggatatttaagggagtaaagaagcaaataagtatttggttaatcagaaaagaagtataactttggatacgtttttaacatccaaattttgaggaatacatttcaaaatcttctggaatttgtcgaaagcatttattaaaattacctttgtctaaacttcctgtgaaaacaaaatacatatttcctgaaatatttcagaagagcctaacacaggtgtatatttgactagaagccataaatgtgaggatattctgagttctttggccagaactgtacaatgaaagtgaatcatgttgcttcatattttgcctgtaagtacaatataaacttcttgtattagaaagcccagctgggtttaccttaccttgaaatgtttgggtttatattgacgaacccatcatgcaactctctcacttctcttggtcttgtttctatatttttgatatttaaatgtagaagaaaaaattgaaacaataataaatagaatttattatgaaatcattgaccttcagatgactatggagttttatatccaacatttcttactgacgataatgtaacttcctcccctttggtttaaaaatgactactttagagataccttctagttattagaggtccctttctatatggttcaaaagagattacgtagagaagctaaccactcaaagctatcctttgtcagatatcctatatatgtgatatatttcattttatgaaaatgtctgaaagtatattaatagttattttcttttttttttcctttttaattatagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtatgtatctataagtcatgttcaacgtataaatggtcattaatagttgctttttttttcatgaagagtaatgtctagtggttaacacagtaataaagtgaaaaaccaaagtccttgcctggcatcttattcttttgtattctacagtctgcctatgattccagctttcatgtttgaaatgcatacacaatgcttatgtgcaaaattgaagctatttgtaactaggagaaacgtgcagtggaactgaattaacagttttcagatactgccttatgttattcaaaatcatctaaattccattatatggttattgagaaattcagactgtgtactttttttattttgtttctaaaattatctcagtttcaaaataatggcatgttttgtaaaggacatctgctaactaaaatatatgtaattgtattctgtaaaatgactgcaaaaccttaattcaacaaaaaagtaatctctagctttctttaaatattcttctaaagaagtgattttgtaatggttcagagtcgcttagccatacggtcgaggcattttgtgggagaattctatttcttaaatatgtaggccattcaataggttcaataaccaacatgtgtacaaacctgtacaataaaaagtgtccttgccatccttgcctcccctctgcccaatgtccaccctctagagaccctcctctccttagtttctcatggatcacaggacaccttatttttcgtaaatttcagcattattttatactgaagggtggattttggcagcattgagagaatgctttccttccttatctacataaaactctaagtgtacgcttgctagaagctccttttacccctgaggacagatttgtgtcactatttgaccttttgaatcccatacaatcctatcacatatatggagatttatttgctttatacatctaataaattgcacaacatcgtaaagtacatttttgtgacctttcgttgtctctcataggtagttcttggcccctgagtacatgccacttttgctttaagtttttattgattcatattaatatccatgaacattggcattattcaggatggaaggagttgacttagagaagacagtaggtcatcaaatattaattgaaactatttatcaaaggggcatggaaggttggagagagccttgagctagtagtattaagaggcttaggttcgcctcagctctgccagtatcagttttgtaactggggcagatcacttatccttaaacaagtttgaattctattatctgttgttacattttcttctaaaaccctatgtttatatagcaaaatatttcctaaacttaagtaattcacatgcaatatttactgtctatgtttattttacaaaattaaactctaaataaaaagaaaccagtataacttaccagaaatacaaggaaataataaaaataaatacaataaaataaggtcactgttttaaaggagcttcaacctatgttacagtataacgcattatagggtcaaatcaaggctcctccaagacacaattagagatgctgaaaggggactaagaaaataatttttggcggatcacaaggtcagaagattgataccatcctggctaacatggtgaaaccccgtctctactaaaaatacaaaaaattagccgggcatggtggcaggcgcctgtagtcccagctactcgggaagctgaggcaggaaaatggcgtgaacccaggaggcagagcttgcagtgagccgagatcacaccactgcactccagcctgggcgacagagcaagactccatctcaaaaaaaaaaaaaaaaaaaagaaaagaatttttttctcctaggctctgcaccattgcaaatctccagactctccatgcttagggaacattccctgccatatagaatatatgcatatgagctaagtaaatgtggtccaagaaaccaatttaattgatacatatttttacaggtgctgttttggtgccatgagatggaaagaattccaatctttgctctttcattcaacaatcttatagtccattaaagattctcaaataatttaatgaaataaggcagaagtcagtaaaataagtaggcacaaacaaatttctataatcatatgttctatttattttgttcatgttcagtcaatcttctttatagatgaagcttaagacaaacaccttttctaagataacatggctagctctagtaagagctagagctggaatttgataccaaaggtattgcatgaagcctatgctctactccactgtgatttaagggtttgtaagaaggagaaattttcttttggtagaggagaggctttaaaaaaacaggagcattcagctgcttcaggctttagaaaattctgaaagtctcaaagttattggagcgataagctaggacctgtcctgtgctcgtggtagctgttaaatctgcctcctccatgatgttctcatagcaccttatgtagacttccattatagctctgatcacattttgttttgtaaatatttgtaaacttctttgtctgttaaacatgatctacttgaggacattcaagtgccaagaacagaattcatgctcagtaaatagtttacaagtaaaagaatgtttgatacaaagtgtttaaactttcaaatacaaaaaagggtgcatgcaatgtgggagtcatggaaaccattcttaagaaagagacacggccgggcatggtggttcacgcctgtaatcccagcactttgggaagccaaggcgggttgatcacttggagtcaggagtttgcgaccagcctggtcaacatggtgaaaccccatctctactaaaaatacaaaaattagcctggcatggtggtacgtgcctgtaatcccagctactctggaggctgaggcaggagaatcgcttgaatccaggaggcggagattgcagtgagccgagatcgcgccattgcactccagcctgggtgacagagcgagactccgtctcaaaaaaacaaacaaacaaacaaaaaaaaaccagatacttgatttggaccatgaatgtaagcctttcaaaaggtaatgagcatgaaaaagcaggagagagggcatcatagataagagagagaaattactcaaagcaaaaatgtgaacaacagataccaccgacagcattccagcttgcctgcattaagtctcacgttggtggcagggtgggataagaatgtttaacttttcattgtcgctaatttcaaacatttggaaaagtaaaaggaatagtgtaatgaatccatatatcatcatccagcttcaaaaagtatcatgatatagccaatcttattttattttgctttcttactcccactaccactgaataattttcaagaaaaactcagatgggatattattttgtctaaatatacttcagagtaagatgaggattgatatttcaaagtaaatttacaacaaattcagatagccacaagaataaaataaaagccataaaaataaaatttgagaaaacttgacataagctaaggacactctccatgtattctgggatagaaactcaagatgcagcagattatatgcataagagtttgaaatctgtgctgaaccacacacggcaaaagacataccttctggttatcacttattagctctcgttctcatttttaacctttttcattatcaatgacatccttacatgtgactatctaccaatcaggcagtggtactcaaactccctgtcagtcttctaacatgcaccaaagggccagggaagcatctcattttaaatgccttgactgagctgcttttccaactgtaattgcacattatctttaattgagttggtcctttaataccagcttaaatgctatttacactaaagaattttactaattagaaaaaaaaattcttcatgtagcctaaattatatagctcctatttgtattacaagcttttattctgccttggattcaagccatatatatatccaaactacatatatttattctgtctaggattcaaaccatatatatatatatatatatatatatatatatatatagtcaaatataggaagaggccacatccatacctatatcctagagtaccaagcacagtgccttgctgttagttgttaagaactgtccatataaccatactgacaaaaaaaaaaattgtaaatcctcaacaaagactgacctccatgtgagttggaattagatatggaaacacggcattttcatacagaatcttggacgagggcagagccctctgactgccaccaattacctacctagaaatagcaggcaacaagcaacaagctttatacagatgtaacaaaagagtgtcactaggaatttaggaagaagcttggactacagaatcagcaattcaattgagcacagcaatcaataaatacacaaataatgatatgaaaaacatgacatttatgcttccaaacttccattgtatttatcttccattggtgaaaatggggctaaatatacaaaattatagtctgagaactatcagaaatagaaacgcaatttcagatatgtgcatagcactgataagcactatgacaggcactaaggaaggtaatattatttatgctacatggtcgctgcctttttatgactagaaatatttactttatgtaattattaaagcttactttaacttttatgtgtcccttttgattatattttgacatataagtatggaggataaattagtcagatattccttggacaatcataccaccttctttcccatccataaaagtttaacttttttttatttttgcaacattggataaaagcaaccatttgctccagaattcagctgtaagaattgcacattttttctacagagccaagaaggtttctgcaattggatgttaaaatcttaactagccagaagtataataagtaaacaaataaaatactaacaataatgaagttccaaaaatggccctgcttgtaagatacatcttactgttgaaatgtgtatgtgaaatttgtagaatacaaggaaagttttaaaactttgagtaaagcatagagctttaccttgatttacttggaatatgttctttccagcacatcaaacagtaattcaaatttgttaagtaaatcttttgagctgatacaacacttagttgacaattcttacaattgaaaaatactaaaatattaacataagtttcactttgaccctaaaaaatgattgtatgaaattatgttgaatttgaaaacaactcaaaaatatatagcactggatgtggaactaaatcgtatttaagtaatgttcagtggttaatcaaggacaaattactagagaaaaacttgtcccgatgtttatgagagtccaccaaaatacactacagtgaatttaaacctgaaagattttccaggtctttaaaattagtataaattaaaatattctgcattctccaatgttaccatcttcagccattttggaaatggaagtcaaccccactggtttctttctctcctcaggttgagatactttgagattttctgtcacttaagatctagctaaaaggaatctctactgaataaatcaaatattttccttttcatcagcactcccagggttgctgaggaaagaggataaaagatatgagggaccagggcaccataatagttatttcccagcactcactgggttcccagctcagtgcctgggcagagccctccttagatagaaccatctccaggccttccctcacccctcaccacaggagttagtggcaaccaagagaggcttttactccttccttttggctctgattcagcttatagatccttcagccaagaacctgagaaggcagaatgagatcaggaagccttcttgggtctctgcctttcatggatggtgccagctggattgccctacagagacaaacgtgtcctaccgaggccttcagtggatgtgacttgatttaaggccattgaaatttcttcttgtagagtcttctaggacaatttattaaagaaatatttctgtgtactggttatgctattagtgagtttgtacatcatcttgaatagcgtctgcagtctcataaaatagcacatgtgctataactcaccaaattactgtgtcagtgggacaaatgtttgcattccagatgccaaaatactagttatttctaattatattaaaaaattcaaggcaagcccttgaataatgattcaaaattacttatcttttaataaccatgggagaaatactttgacacattagtccttttcaaagtccagcaagtgatgcaactttgctttcttatgtggtaatccttagcctttaaagaaaatgggcagagtgttgtgagacagcttggtcacctcccataattatttgaccaaaagaaatgttttggaaagccatacaccttcctaggcaaaatcaaatacgaagtcacactgtttacatttgctaaggaacttttgtcctcaaaatatttaacttaattatttggcattagtcaatcaatggatgtctattctgtacctaccttttacaggacaagcttagggaagtttttttttcctgtttataataaaaatgtttcaaaccccttactttcagtttgcaatatatacatgtggaagttgaaaaatagtaatggaaatacttttaaatgaaagcccttgttttagtcctgctatttaagggcagggaaaaaaaataagattaagggctacattaaaagtaaacatgcaagagtaccatgatgctttctatggaggcgtgcctcactgtacagatctgtcttattaatctgaaataaagttgtttaattattttcttgttaaatatgcaaaggagtccactttagcaggggtatccaatattttggctttcctcggccacattggaagaagaactgtcttgggccacacataaaatatactaacactaatgatagctgatgagctaaaaaaaaaaaaaaaaaaaaaaaaaaaagaaagaaaaagaaaaaagaaaatcacaaaaaatctcacaatgttttaagagagtttacagatttttgttgggctgcatttagagctgttctgggccacatgtggctcatgggccatgggttggacaagcttgttttcacatttctccaaataagagtcccccctaagtgaaggttacttatctgcaagttattagaagaacatgtaaaaagttatatatctacatttgaataatttgttaatatgcttgtttatacatttaaaagactacataaaactaattactaattatataggaaaaacactaagaaaaacattgtgaattttgataagtacctctcttggagcactacatcccctccgctcttagtattcaacaatgactatttctatatttgccaccaactcttagtattcaatattgactttttccctaggtgacagagctcagtagtaacccattatagtgttagtaactggcagcaaatggtaagttcctggggagggctatttggaaactgtaaactgtagacagatctcttcagaaaggagaattttaagacttgagttgaactcttagctaaagcagtaaatcactgaagttataaaattaaaaagctgatcatgagatgctcagaactgagaggctgcttgaaggggaaagggatcatgagaaacagttgctagttgacgaaaaactactgtctcatctgatggagggtctgttaggtttttcaccaactaggtggcatttgctcagagttgttagttttggggcttctaacaactccttgctttctcctttggacaggtgtggtattcccttactttccacgactggggcgctacaatctcaattttcacgaggcgcagcaggcgtgtctggaccaggatgctgtgatcgcctccttcgaccagctgtacgacgcctggcggggcgggctggactggtgcaatgccggctggctcagtgatggctctgtgcaatatcccatcacaaagcccagagagccctgtggggggcagaacacagtgcccggagtcaggaactacggattttgggataaagataaaagcagatatgatgttttctgttttacatccaatttcaatggtaagataataactgtactgccttctttcctatctcacagactattccatactataacactacacttggcttttaatcttatcttcttagaaaaacaaacaaaaacaagctttgaagttttgctgtagtttaaaaagatataaaaagttcttgagtgtcataatttttaaatatccacacaagtcaagcaaaagtacatattcccagtactcctacgttttatttcatcccatttttatatgaaataattgaaactgttatgtggcttgaggtctgttacctattgtcaaagatgatgctgccagtgtgtgccctccgtaggatatggttctgtcaatcaaagtaagcgtgccttcattattacccatgctctccctctctcaatcacaatcacatatacacttattcataggtgatcaacagagctcaggacaaagtggggagtaagcaagaaaaagaaaatagaactaactctcaaggtgaaagcagaaggaaaggttgcagcagtgttgatgactgattcattttattcatacacctctcagcccttctcttgctgtcttcagaaccagccacatcatttgtgcagcccggtgtaaaatgaaaatgtgggctgggtgctgtggctcacgcctataatcccagcactttgggaggcctaggcaggggcactgcttgggcccaggagtttgagaccagacatggcatcatagtgagaccccatctctaaaagaaaaaataaataaataaaaagaaaaaaaaaggaaagaaaatgtggagctccttgttcaaaactgttaaaaattttaagatggtgacagcggaacattaaactaaatgcagagcccttctccgtgtggggccctgtgtggtggcacaggtcacacacccatgaagcaagccctggctccattatttatatttgaggtccctggtgacatgctttgggaaaaatagaaagagattatgggtcaggggtcaataatcttttttttttttttttttttttaagacagggtatcaccctgtctgtcacccaggctggagtacagtagcatgacctgggctcactgcaacctccacctccctggttcccaaatgactctccctcctcagcctcctgagtagctgggaccatggtgcatgccaccacgcctacttaatttttgttttttggttttgtgagttttcttctttttaatgtagacatggggtttcactatgttggccaggctggtctccaactcctgacctcacatgatcagcctgcctcagcctcctaaagtgctgggattacagacgtgagccgctgtgcctggccgacaatctttttctgtaaagggccatatagtaaatatttttggctttgctggccatatggtgtctgctgcaaaggctcattgtaaatgtgtatgttgtagcacaaaaacagccatcaaaatactaaacccagagggagatggcagcattccaataaaacttcatttacaaaaacaggtaggaggccaattttgacccatgagctatagtttgctgaactctggtgtagatgattgtacttaacctctagttaatattccagtggccactaccctttctccaaatcacatcatctcagtctagaaagaactggcaagcattaatttatacttcagtaacctatatctaatgagggtcaggggaacatcatattacatgtctaatcaggcaagagagtctgattagattcgacctaaaactaagatgtataagaaaatcttcagtccatgtgtatttatcactttcagtcagttgaagtcatattttatacattttacacatacttaatacatattgaaggaatctcagtaattaacactattcaataagtgatcgggactaatttgtcttcctagtgaaattgagaaatagttaggtgtcagggtttcaacaaatggaagttgaaaaaaataaacaaatttgtcttctttgctagtgaaccaacacagactaggtttacattctaagtacgtattatctgtggcaagtgacttcctgtattttacgcattttcatacgtagtctttgaatgagaataatgtctaattgatacctgtaatgaaaaggacttgagggcttttgatttttttttaaatggacttttatgtcaggaatgtgttttgatcctttcacattcaaattttgcctctccagaaacttgtgctggggttcagtcttgtacagctagaatttaaatagcccttgcttttaacatggaattctgtcttctctagtgccacagaagggctcttttagtcactaattagctaacagaaactgcatctgccatttcccttttctttttaaagctataaaaggggcatgtctggacacatattaaggggcaagggaaaaaactaatttaatggaagtgacgtagggacactatatttaattgacatttctatgttcccaaaattttacaaacattgctctatatcccccttcattgagaaacacttccgtttttggctctttctatctctgtgtggctcaattgaagaccagcccattgactctgtctccttttctctacaggccgtttttactatctgatccaccccaccaaactgacctatgatgaagcggtgcaagcttgtctcaatgatggtgctcagattgcaaaagtgggccagatatttgctgcctggaaaattctcggatatgaccgctgtgatgcgggctggttggcggatggcagcgtccgctaccccatctctaggccaagaaggcgctgcagtcctactgaggctgcagtgcgcttcgtgggtttcccagataaaaagcataagctgtatggtgtctactgcttcagagcatacaactgaatgtgcccttagagcgcatcagttttaaagtcattaagaacatgtgaaaggtgttttttttttccaatatgaactcatgcaagttaccaaaactgtgataacccttttttacttactgtaaagagtcattttcataaagatcaattcattgatttgttttttgtaaagctatcattcaatatatattataaattaatataaatttaagggaagctctatgtaaggagacttagagccaaactgtttaagctgtatcatcccaacaaagtatcctttcatgaacggggcatgcaatagcttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctgaccaaaaaaaaaaaaaaaaattcatatggattccaatccatagtaacaagcacagttaaaactcctcaataatcccatttatatgaagcatgacacataaataagcagataatatttaaccaatgaaaaagacttctaccttcttataattaaaattacacatgtctaagaggaattgttttatcttttgagtagctttaccgagttgtatttaaattctaagggccatttgctaagcagcatttagcatctactcagggcagttatatagataaactgctggacagaaaaattgtaaaatttagcagcttgattttctgttagcctatgaaatgttattgtcctataaaaataactttaaactgatttaatatttcatatttacattatatgaaaatcaattacattataaaaggaatccctaatgcagaaacaaagatgcaactttcaaaattcttattattcctatttgtatatacacgagagaacccaaccagtgcctgtgtttggggggaaaagtcaacagtgtagttctaaaccttatcccaaacagaaaatgtggttaatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatgggatttactataataatccaagtatgacatagccggtatgctttcatgaatgtttttatgtagattttcctcccatgaacatgagtaaataaatctgtttcctgaatggattgtggttgcatttaaagctctgtaataattctaataaatttactctatagagttctgtgtgtggaaggtatagaacaattggaagtccatgaaaccataactataatcatatattattcagacaaaatattgtaataaaagtaggtcctttctttcatcaaaaacatatctgaaaattttcagatgctttaatattaaaagatgacaatgttatgtatgcacatttttaagttaggttggatatgcaaactgtacaaaactataaatccaaagagtttgtaaagtttaaactcaaacactggtggtataaatagaacttgcacttctaaattaaggaagatacctaaatggtctaggatgagatgatatattatttaaagaggggactatctcccaaataacaactttaacacctcaaatatgggggctagctcattgaaagaagtccatacttgaactattattatgtatgttccgataattttgttgaaaatacaagtgggaacaaatttctattgaagcaaacatctaattttcagttatgtccagaactctactttataatgttaaatgtagtagtatttcttaacttttaaatacttactactataggaattggtgctgatcaaaatctctggagtgactgttagctgattaaaatctataccacttacacatcatttttccattcgtgtaaaaaacaaaaaatcttaacacagtgaatactgctgagcagaattttttcttctcattttgctcaaaggaccagaatttccatgccctttatactcatacttgaatgagtctttttaatgttctcattttgctgtttttccaccaaatgtctattttcctacttcattccccaagatgtctcactgagcaggtctgaaaaagaaaggttattctaatacaattcctaacagaaagttggtacaacactggctaattcagaaatcgctcctcagacttagattccaagagtatcaaagagattagatgggaggctgggccaggaacccttgttttaatgtatttgtccataattaacactggtgaccatataag

SEQ ID NO: 16357 - DNA, 14395 bp, Human; identical to SEQ ID NO: 12247

SEQ ID NO: 16358 - DNA, 13377 bp, Human
tcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagcccgggaggccgatcgccgctcgcggaacccgccgggacccgggccctccccggcgcggggcgcccccgtgtgacccagcgcgcggccgcggcgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctgtgagcgcgggactccgggcaccccacggctgggaggccggcgggccccacggggctcccccacccgggcctcaaccttcctttccttccttggcgtcccagggcaccctcccgccccgcttccgtccccaggcaccactgccccgaggcccagcagcatccctgcacccgccgaggccgaggcctggagcccccggaagttgccatcctcagcctccaccttcctctccccaggtaagagggcccggttgttaggctcggtggacccaaagaagagcccaccttgaccacggccacggctgtagaccctgctgctggtctctgcctgcctctcactggtgtctttatgaagcttttccaggctcccagacccattcagggcctgagctcggcctggtcccaagccctgcttccctgtggcctccaccgccatctccagccccttcttctaccaaggtaggtgtcccctgccccccagggaagattcgagacaaggaggaaggaattcagcctttgatgtagcgcagagccccagtcagccaagctgggtcagctgggaggcagctgtggtggggagagcctggagccttgggcagaagggaagagacagggaccccacctgatccaggctctcttcccacagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggaggtgagtgtcgcaccctggcagggaccctggaaggccatcagataaccctcaccacttctccagcctttccccctcgcttccccacacaactccttcagccctcattctggcgtagggtccctggccccttggtggttctgggcctcgggtaggtggcactggtggcccgaaggccttcgcttcgagagcctcacgctgcccgtcttccctgccccttcccccaccgcaccctgggggctgcagaacgctgacctggagtggactgcagtgaagcagagcttcctgaccgaggtggagcagctgtccaggtgaggccagagggggagccacaccaggtcccgtggggcttcagaccgcacaccacaggacctggctcccttgggcacctgaggcctggcaggcccgggcgagctgaggccccagccagggctgcccacccagtctggcctgatggaaagtgctcccctttttcaaacaggtttcgtcacccaaacattgtggactttgctggctactgtgctcagaacggcttctactgcctggtgtacggcttcctgcccaacggctccctggaggaccgtctccactgccaggtaggctcacctggcccggcacgcttcccaggacccaaagcactcctgacacctggctggagccgggcgcggggcctagggctttcagcctgtgtgagtgggtcctgccagcaggccaggcctgcacttccagctccccagcagcacccggctcaggatttggcccacggtggggtcaatttttttttttttttttttttttttttttttgaggtggagtcttgctctgtcatccaggctggagtgcagtggtgtgatctcagctcaccacaacctccacctcccgggttcaggcgatcctcctgccgcagcctcccgagtagctgggactacaggcatgcaccaccacacctgcctaatttttgtatttttagtagagatgaggttttgccacattggccaggctagtctcgaactcctgaccccaggtggtctgcgcgcctcagcctcccaaagtgctgggattacaggcgtgagccaccacgcctggcccgacccaatgttttctatagagctctttcccaggcctctcccctttgcaagcagcgtagctggagggtctcatcagcaagccccggaggcgagggggtctggggctaccagctggaccacctacagctgagggagggcccccttgcctcctcctgcatgctgcgtttggggagagcgggaagaatgccttcaaggacttcccgaccaccagggacaaagggatgagccctgggagccgaagcccagcagattctattgaacgtgtccccagccattgcttaagaagtgcaggtcacggagactttgctcctcgttttccagaagggggaaactgaggcctagagagtgaagtggctgttccaggctgcacggtgacaggtagaaggatggttgggatcaaggaacggccatccagcaacctcccctgtccccctttgccaccccagacccaggcctgcccacctctctcctggcctcagcgactggacatccttctgggtacagcccgggcaattcagtttctacatcaggacagccccagcctcatccatggagacatcaagaggtgaggaggggcccttgagaactgccggggcagggcctgcagcaaggggggccccgcgtcctatcaatgtggggatcaggcatggcctgggacctcaacaccccggcatcgcacaggtgtgggaacgggccaaggatgggccctactgatgagcagaggcccccaggcagctggagcgctcagggcagtgccagcgctttctgtgggcaaggcaccgggctggcagcctcgagtccagccttatctaagccgggcaggtgtaggagctaggaccgggctgacgccactgtcttctctccccaagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtgagccactgacccctctgctggctcagaggaggagaagccacaggcaggcagaggtgggggctgcagagtgcactgcgggccaggggccatctgccaagaccccaggaggctgcagctccagggtccccctccctccgaggccctcctcctcaccctgcacctaactgtgtgtttgtaatttgtcttcaagtgggctctccgagttgcccgagcttcagtcccataacatctggctctgcctttgtccacacccttgtcaggcccaatccatgtccacaccagaggcctcttccctgccaaggccactgccatgctctccctcttccctctctccaggtagtgctagagaccttggctggtcagagggctgtgaagacgcacggtgccaggaccaagtatctggtgagccccttgaggcagggccaggagggacacacagctgctggcagccagcaggcacagccccagtggcggggataactggggcgcagtgcccatggatgcctctgctgccacagtggcctcatttttgaaagtaggcagggctccaaacaacttcgtttaccttgccgaggacaaacctgtctgtcctgcagacactatgggccttgtacagaccccacctgggctgggggcagggggaagggcggtcccagggcactgagacccaagctgcagtggaactcagaggactctggccggagaaaggcggtggtagagaagaagcaggccccgaggaacctcctgggccccagcaggctgcagctgagctctccgcaccgtgcagggcagcctgagctgcctcacggtcttactccactcagtctgcctcaccgtggactgtggtggggccaggagactagagacctgggttttagccccagcctgacagtggccttccagcaaattcctgctcccctgtgggcctgttttcccatatgcaaaacagacttcacagaatgtgctcagccagtaattgcttcactgcttctcctcttgtttggggcggttcctgtgtgctgtggggtctccgtcaggattcagccccgctgagaacccaggagccgggcttgagccctccttcctttcccttccccgtccgtccatccatgcatcctgctgaagaagcgcaccaggctccttgggggtccttggacttccccacttgctccccaccctgcagccaaagtgctcttttcaaaggcccctttgccttttctctgctcttggggtgaaggcccagtcccttatgtggttgaccccccaacgccccaggtccctgggactcggggcgctccctgctgcctgcttcacagccttagtatgtgccgttcgctctgcgagaaaagccaccgcccacccaggtggttcctcctggtctgtctgatttcagaactggagatggcctccggtcctgtttccaccctgggggcgcctctctgcggggcgcctctctctctggggtacctctttgtctgtggggcacctctctgtggggcgctttccttctcggctctgccctctcaggctacttcctgccttcagaccccagctccatggggctctcccccaccaggaagtcagctctgtcaaaccgggtcccagggttctgtttgttcctgtatccctagggcccagagcaccactggcccacagtaggtgtttaataaatctctagaagctactcgggaatctgaggcaggaggatcgcttgagcctgggagttggagaccagcctgggcaacatagcaagataggcatggtggtacacacctgtaatcccagctgctcgggaggccgaggtgggaggatcacgagcctgggaggttgaggctgcactgagccatgattgcaccactgcactccagcctgggtgacagaatgagtccctgtctcagaaaaaaagtaagttgtagaaagaccaagagctgtggcacagtgtctcacacctgtaacaccagcactttgggaggctgaggcgggaggatcacttgagcctacttggagaccagccaggccaacaaagcgagaccccatctcttttttttttttttttttttttatcaaaacccatacgattgagtgacaaggacctgaggactgcagctgcaggtgtggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtagccagctgcgcactgggacggggtggccagatagaaagcccgcattccaggccttgctctgtagtgaccccatctcagcacctgctaggtctctctggagtctccacacatttcttgcttgccctttggttctgtttggggcagcgcccctctgaactgaggggccccgggcagtcctgctttgcggagcccagctccgacccccttcacatagagagaaggaaagagctgctgccgcgccccctgctgggcgcactgcactactgcatctgcctttttctgtcccctccctagtaccccacctcttctcctctggtgacagttgaaaatggagaggccccgtttgagggcagcggggcagtgagattcattttgtagaaaagaacgaggccattctcagtccttgcttttggcagccgcgcttctcagcactccctgtgatgggaacagaggggcgaggggcagagcgttcccagctgcagggtatgtcattttagagccctggggcaggtcacggacggcctggagcagccctgtggtttgcccacggggtgaccggccagggctgccatctcaccctgagagtccctcttttccacttgcaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggtagctggggagacgggttcccaggagagggaccaaggcctctttgggccaaagcccctgtaagtccccaccccagccttctagaagagaaccagggccaaatgttcagctcactgtgaccttagcaaccctggtttcccctccccaggccacatccttcccaggtggagcttgctctccagccctccccccaccccattcctgaaggctgggaacaaggagggctctgtctggtagcctgagagctgggccctgcccttggacttctctgaggaattcaggcctgaggccagggaggcagggtgctaggctgcgggctggggagccacagcatgaggctaagggagtgccatctccaccccaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggtgctgccgcccaggctggcctctggggtgctcaggcgcatccgtgtcagccccaaagagcagagtgtctgtcccgactgcgctgagggcatggggcagccgggcaggccactggctctggcgacctctagaagcccagccggccccacatgcctcccttagcaagaccctggcccactccttccctcgcctcctgacagtagcacctcctttagcccgagggtgcctgccccactctgtgctttcaggaaataggaagccccagcaggaattttccatcccaggtactatttgaagaaccactgcttaggaaccctcagctgggcgaggtggctcatgcctataataccagcacttttggaggccaagatgggaggatcacttgagcccaggaggtggaggctacagtgagctgtgatcaagccactgcactccagcctgggagacagttagaccctgtctcaaaaacaaatgaacaaacaaacaaaaaccctcaattcccacgaacgccccaggagataagggagcatggcccaggccttgagccagggcttctggcagtaggggagcctcccccatttgctaagcggactttcctcttccttctgtaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcgggctctacttgtggactttgttgcaccgaaagccttgagctttcctgatgccttacacttcagggttcttgagcgtccagggtcttgttactactctgggctggccacacccagcacttcccgtgtcaggtttttcctgatgtagtccatgttttttatgctattctaaatggtatctttgattttctagttcatcatgatattatacagaaatgcaattgatgctgggcacggtggctcacgcctgtgattccagcgctttgggaagctaaggcgggcagatcacttgaggccaggagtttgagaccagcctgggcaacatggcgaaaccccgtctctacaaaaagtacaaaaattagccaggcatggtggtgcatgcctgtagtttgagctactcaggaggctgacccaggaggatagtttgagcccaggacgttgaggctgcagtgagccatgattccaccactgcactccagcccgggcaacagagggagaccttgcctcaaaaaaaaaaaaaaaaaaaaaaaaagcggttgagttttgcatatgaaccgtatattctgtgaccttgtttaaattcttttttttttttctttttttgagatggagttttgctcttgttgcccaggctgcagtgcaatggcgctatctcagctcactgcaacctctgcctcctaggttcaagtgattctcctgcctcagcctcccgagtagctgggattacaggtgcccaccaccacacccggctaatttttttgtatttttaatagagacagggtttccacatgttgaccaggctggtctcgaactcctgacctccagtgatccgcccgcctcggcctcccaaagtgctagattacaggtgtgagccactgcacctgtccctggctgtctgtatatttacttttttttttgagatggagtttcgctcttgtcacccaggctgcagtgcaatggtgcgatctcggctcattgtaacctctgcctcccaggttcaggtgattctcctgcctcagtctcccgagtagctgggattacaggcgtccgctaccacgcccgactgatttttctatttttagtagagacggggtttcaacatgttggccagtctgatctcgaactcctgacctcaggtgattcacccacctcagcctcccaaagtgctgggattacaggtatgaggcactgtgcccggctttttttttttttttttttttcttcagacaagagtcttactctgtcacccaggctgaagtgcagtggtgcaatcttggctcactgcaacctccgcctcccaggttcaagcgattcttctgcctcagcctccatagtagctgggactacaggtgtgtgccaccacgcccagctaatttttatatttttatttagtagagacaaggtttcaccatgttggccaagctggtctcgaactcctgacctcaagtgatctgcccgcctcagcctcccaaagtgctgggattacaggtgtgagccgtggcacccagcccagccttattcttttaaacaatctgacaatctctgcctttagttggtctgtttaatccatttccatttaatggttggagttaagtctatcatcttgttatttgttttctattaccccatctgttttgacttttggattaattacatatttctgggattctgttttttctctgctattggcttggtcgctctagtaattcagtgagactgctggttccgctcaggcccctttgctgaaccatggtgtgaaagtgcctccaggcagaaactcagggtacttgtaaggctcaccttctttgttttctctctggtcacagccctgcacagcctattgtccgatatctaaaaatagttgcccagtgttttaggtgtttacaactggcatcagttattccactgtggccagaattgcaagtttctcctcttttctgaggacttcttcactcataatgtcacccgacatgatcaatttcttccttgcttctggatc

SEQ ID NO: 16359 - DNA, 12787 bp, Human
caggggcgagggtggcattcttcaatccaaatgtttctccgccagcctctcagccctgagtcactaaagcacaggatggtggcggaggggaggatgttaacaaaccttgctagaagctcctccgagtcagctcacccaccaagcctttgccgggggtcagctgggcacccaggccatgggcacagctgtcgtacgtccttcccaaacaggaggtgccctcagtggagggggagtgtgaaaggcagtcccctgtttgtagggcacagcttctatggaatattgatttcttaggaaaggttccgtaacttcagcacgtctagcagtacgggcaccagtggcagctgcatgtgctcgcctgcgtggcatagccttgggtaggtgcaagctcaagtcctgggcagcctgactccccaaggctgtaggggagagccccagtgcagtcccatgaggcccagcgtccagagcaggaagacagttgcagggccagaggcctgctcccaggaggggctgtgctgccgccaaggctgaaaaggtgcagaggagcagtcggggcccagagcagggtgggcaggcctggctggcgacagcaggaccctcccagctcacgcaccatggcttgaaactgcagcacagctaggagggtccttggagatcacatggtcccacctctctccccaaacgtacataccaggaaatggagacccagatgggacagggacctgggctccagaggcaaagctgctgccctcgcctcttccaggggtaatgactcaggggaattcagcgctgcggcagacacagccaagcggccagcggagctgctggcatcccagccctgcctggccgcaccttatcctgcgctccctgggcggagaagacggcccttgatgctcacagcctcctgccgggtctcaggcaatcccccactgcaggcacgaggccgggctcatacactgctggtctgggagccccagaaaggccaggtgcacatctccacgggctgtcctctgcctcccctccccacgcaatcttccgcactcacactcgctcaggctctaggcttctgaactcagccagcccaagccacatcctactctgccactacactattgtgccaccaccagggagccacggactcagtttccctggctgtagcatggggacaatcccctcagacttccggaactgctgtaaggataaaatgaggtccttgatggcaatgcgtgtgacctttggcacaaaggagaaagctaacgggacctagtgacaacagccgctccctactcgcttccagcccctcccccacccaaacgtcctggctccaccccttccaggcactgaggctcaaatgctattactattagccagaatctgacacatgagaatgagaggagacactgcagggggacctggggtgggggatggaattggcagcgctgtcagccagactttataccctcttcactgtgggagcaggaggtggctctggggcaccaagttgcgcccagtcctcaatgggccccttcgctggggtgccagtgcagattctgcgcgtaaccgtccacctagcccaggcccagcctagttcagggcccccaaccccactcccgcgccccaagcgccggagcccccactcattggcgccactggggaccggggagcgcagggcgcgtcgggcaggactggcctagagaacagaggcttgcaggtgggaggaaggcggcggggggtggggggggcgtgggaggtggagggagacgccgggcaggccgcggcccctccccgctccctccccgcgagccgccagctacagtgcccctcctgggcagggggcggagaagacggcgactggaggggaggaggcggcggcagaggcggaggaggcagcggcggcggaggcgggatttggagtttccctccgcagcggcggcggcggctgcccctcggctccaggagaggccgccacccggggttccggtggcgttaggctgcagcagtggcgcttcccgccgcccgagcttcggaaacttcccggccgcgacgcagggaaccggcgcggagaaccgagcagagcggaggtgagtggagcaagcggcgccccggggacccccaccccccacccggcctggctgcccccgccccgacgtgcgctcctccaccctgcacccccaaagtcctgacaacgcacaccccacgaagccggcgcacgcgcccctacgacacccattcggtgctgctccgcacacccccgcacgccgcccgtgcacctcccgtgtctcctgccacttgcaccggctgcacactcgcgcgcatacaaaccacgcaccacagacccgggtgcctgtagtgcacacactagctgcccctgccccaccactcaccactgtccccaactcatgccaacccaccgagaccctgccacgccccagtacacacccaggcgcacacgcacgcttccaacacgtctctgccatacctgcaccaacatagctccccctaccatgcccccaccacctcgaactccccatctgcccattacagacaccccacccacgttgccagcccagagacactgcagtccacccatcctggagcgaggtcccgtcagaaacccacatcccagtggctgacgctccccacgtcccaggcacacacctccagcatctccaacgcgcactctcatccaccccagcacgcgcgcacacctgctggattcacgctctccagcatcctgccccgcccccatcacaaatagccttcgacaccccccagcacatctctgagtccctccctccctcacccccaacacctggcacgcgggctctagaggctgcagcatttggtggcatccctgccaggcacctctggctccccttcggcagaggctcagcagccttgggccccccaggtgcctccctaaacagaccttgagactccccagcgactagcttggcctcttccctaagaaataaagaaggcactttggggtccaaggtagggtacttagatgtggaagcaaggggccccggggaggggcggggaggcggcggagagagcccggcgctgaaatggaggcggcccaggtgggaccaaaggggcgccagctgcccggcaagcacgtagtaggtgggttccatgggggctggcgtccgcgcgcgctgtctgggtgcctgcctgcgtgtgtgttacggggagggctgtgtgtgcacgtgtgcttgtgcgtgtcggggtgggggaggagtgtgtgatcggcagaaggaaaagcaggagcagctccctcaggcaacaattggtttcattcattcatgccttctttgttaacgagcatttcttccgcgagcgccgggcgcgtgccaggccctgcactgggggctggggccagcctggggccgggcacacacccgttcctgccttggaggaactcccagtcccgcgaggagaccgaccaggaaaagcagaaagccatccccagcagaaagtggatttggtggaaaagacactggatttggcaggcacgctgtcgccgggacttgtgctcttggccatgtgacccggccgcgacagccgaaatcctgtcactcggcccggcgggaacggtgcatctcgtgggggaaggcggcgcggcgccgctctcgggaggctcccgggaccagagggcgcacgcggcgcgcgcgaggcctgcaggcggcggcgtccccgcggcctccagggggcgctggcccggcccggcggaggcccggggcgcccggcgggggcgggtgcgggggcgggggcgggggcggcaggcgcagcgcccaccctgcggcgggcagcgagcgcgcggcctggctcagcccgccggagggggccagacgaggcccgggcgcgcggcgcggcctcccccagcacagcgcacccgggagcggctgccggcggggcggcgcccagagccggcgctacagggggcctgagtgggggcggcccggcgagggtcgcgggtgagagggggattagggggttggctgcgctcagccctgcagtgcggaggtggcaacaggttcccatttgtcctgttgctggcgctgcgggcgctgtgggccccgagcactgagctctgactttggaaattgagcccctcatggcctcctcccaaatgctttctcccggtgcgaggacttggcagcagggctccgcagttaggtgcaggggagcccctcgccaagcgtcgggagacgtggacccttggatcctaggcttcccctcccttccccattgcggaggttgcctctccccgtcctcattccagcccagctcctctcacctccagggaaccctctccagagagcgccactgagcagctcaggagctccctctctagccgaactgagcccccacggcagggcgggccggggaagtggctgtccagctccctgctggtcacagccctgcgccacccccactctccacaacaagactggcacatggcagaacctccgtggtgccttcaacccctgcccactctgagctcccacccacagctgcagtgggcctggaggcagcccccaggctgggtgccggtgtccacctccaccactgtggagctaggctgtggacagaaaacagaagacaaagtccctgccccaggaacacactgagaaagggggaaagtgaccacactagggagcacagaggagggagactactggctccgagttgggaaggctgcctggaggagggggcctgaagaatgagcagaatctcagaatctgggcagggggcataggagggaggcctgggctggggcccttgcccactgggtgagagaaggaagggcacagtccagctgcccaaagcccttggatgcaggaattaggactcttgttagacgcagggacatggggggtgtggccggaaagcagcccagtgccagggtcctgggagtccccggctagcagcccactgcccgaaagggagggagagaggcaaactggaagccccttagaggtgacccacctagctttccgtcacctgccctcttacctaaccatgacctgagacattttctcctctaactccatggctcctgagaggagtctttagactcgtagtttgctttgcattttccacttgttagaaaaatgctttgtggtgcccatcctcgtgtgcataactttgctttcttttactttagttccttagattcccaaaagtggtcaaagggttgggattttttcctagctcttgatattgccagattaatttccaaaggggccgtaccaatatataaccctgcaacagttgaacagcacgctgatttcacagcaatcttgccagcactgcgtgttctcaaaaatgagaacatttctaatgcagtaggtgggaagtgttacctcgttggtcattgttacttgtttattggagtggctttccttccacgcctgaagttgaaccttcccccaaatatttgttaggccaccgcattccctccttcctgcagtatgcagtgttttcaggttctttgcccatttatctacaggggtcttaaccttttagttgggtatgagctttatcttatctggcgtacattttccttcaacactgttatttgcttttgttgagctttaagcagagaagggacttttagccagatcagcattgtggacacctccccctgaccctggtctcctgcctcagtgctcaccacacctgagaccttgtccagtgctcttgctgcctgtggatctgtcccgcctgttgtgcccatggaggaaaggatggaggccaccagccttggttgagtggatggcattctgacgttgggcagggctgggcagggcagggtggagggcaggtcgttgcaggcccggaggcagggagactgttgtgcaagacgtgacagtgacctggcctaaagctgatgaatttgagccctcggctagggcaagggacaggggagagaggcgtggatgtgagagatatttaggtagaaactagttctttccactttgattagccgaaggggggttaagggaaggaggcagaggggggagccacgggtgactcttaggatcagtaatgtgataagagcagagtgccccagtttagggctgggagctcagggttcctgggtgcttttggccagtcctgtgcgagtgaagcgggctggtattggtaggtatccaggagctacccctgcctgcctagccctgcagcagacctctgggccaaagctgcactaagtttctggtcctgcctcctcctcccctccgtgatttcggtggcatcccaagtttgcccaagctgctagctctgagcccattacagagatggggccactgagatccaggcaggggagaagatgctccagtatcaccctgtgagttgggctggaggcagcttctgcggcagaggggctgggctctggtcctcacccctccccctgcctcccgaggccaggctggcgccggccaggggagccgcagctggtcccctgctgggcccctgacctgcccttggcctctgccccgaccccgtcccgcctcggtggaagccccagctcagccgactcgcaggtcccacccgactgcttcggctagcacccgttggctcaccggcccgccgggcccgcccccggagccccgccccggcccgcccctcggagttgtaactccacgtccgaaggcagtttccaaggtggaagctgggtccggctgccaggaagcggccggtgcgcgggctgcgcgggctgcgcggggctcggcttccacgtgcgagcctgcaccgccgccccgccctctcctggcggccaggcctggggactctctgccgcgggacggcgcctcgcgttccgccgtggcagtggccgtggccagaacgtccacgcgcggtcgtccaccgccggatctcgctccaggtctctttccttttgttctctcctaggggtagggggagatgggggaccgggggccagaccacctctgagaggactcgctgaggcccagcacctcggcgcctcctctgttcccctggcccacctggccctgggggagatctaggcctcgaacggcactcctcgcacgcacacccccagccagagtcggaagctcgaacttggggagcgttcgcgagaagaccgagacaggagcagaaagggggtatggagggaggcggctgcgacctcagggtaccccaagatgagcctcgaaggggcggttagccgctcagccctcttctcgaggacccttccccgggccgagctgctgcctggggggtttcttggggcgccttgttgggagtcctcatggtgggggaccctgggctcccgccttcaggacgcggggccggcttcaagtctgagccccctcggccctccggtagctcacaccgcgccttctctctcttcgcagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggtaggtgccgcggggccctccttccagggggttcgggattcatttgaccttaggccagccccacttctttttttctaaagcgagttgaggcccccctcccctgatgacctgccaggctgctttgagaggagggaagcctgagtgtgaccgtggggaagttcttcaccctcggcagcccagtctctgagcctggaaaatggggagaattagcctgacctgagctagttctcaggatgctcaagaacgaattacaaagtgcgggctccccagggtctcggcaagggtatccccacctccccaacctgctcaggaatgagcaagggaggcaggggtcagacagcactggtgcaatcacggctcactgaagcctcctgggctcaagcgatcctcctgccttagcctcccgaacagcatataaagtgtcaggtgtccagcccggggaaatagtatctgtaaatagagatgctggcttcttgagccatattctcccccaagttcccccacatcttggggtcccacttcatccctgagagtcaggagatgcccaggcagagagctgacatctgagttcctccttttctttagctgatggccgcagtcctccctaaggctggcagtgcatctcggctctgttgagccctcacacctgcctcagcttgaccctaggggtgtaagatcctttccggtggctcagcgtgagcccagcttcttgcagcccgagctgactgagggtggctagggccccacgtgggtaccaggacacaccaagctgctgggttttgtgttccctttgggaacatttgcaaaccctccaagttgtccagggtcatctccccagccccagacagaggcacttggctgcccagaaggccaggtcagcaggccccatgccctctccccaacaggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattggtgagtccaccccacccacccttccctcctgtcctccccaaggcctgctctggcctcccccttgtgagtactcctcccaagccccgctgccattcccagagccaaaagcctaggtgacagttctaggggacaggcagagctagggcggcccccagaggccactagagaaacctgcaggtcgtggccatctggcccagggggcagggcggggcctttgagggcccttcggaaggcctcggcctcacacacgcctgccctccgggtctcccgggccctttcctgccccatctagatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccatgtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagaggtgcagtggccgcccacatccatggcctaggagctactgggcaggttcccggccacacatctggtgggctgttttgttttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactgagtagagagagaagctacctcctgagcgccttggagggtttgggggaaggtggggaaggaggccctcttggtctctctggactgcccatggtggaaaggggcatgtgccaggctggccagggactcaagtgccaccccactccctgccccatgttatcatttcccatcttgtgcttacactgcccgctggcccacgctctgagtcgcccattcattcacctccatttgaacccctagtctgtgccacacactgtcctggggactaggttgcagcagtgagctccgcctgctcacagcagactttctagtgggggaagaaacgacaaatgcaacagtcacagcactgcggttgtgccgtagacgttcattgccatggacagagcagaaaagtgaggggccagcactcacaactgatccctgagacaccggccaagtcagccccgagccctgcctggagcctcctgagggctgccccggctgggtggcatcctgagagtgacagggaggggtgtgggcagactggcacatgtgagtgttgtggttgtctggctgtggaatttgggctgcaaaggcccaggctggggactagaagagccccatggagaacatggagaccaacgggccacctaaagggacagaggtgaactgcacctctcctcatattgggacactgcaagtgccttctccacaccataactggtggggtctataaggctgtgactctccaccatggacatgtagtagaggggaagggcagctggagggtggcggggagcgagtgcagccagagaaagctgtggaggctttggagcaatgtggcccagaacccacaatccaaaggcatatgcgtgaatggctgagctggtaggaaaggaagagcaaggtgatgaactgagaaatgaggtgaatcctctgggccagcggagtaagccactctggggttagcccaggagccaggaccctccactggaacgcagccccaccaacaccttgatttctgtccagtgaaatctattttgaatggctgatctactgaaatggaagatgtgaaatctgtgttgctgtaagccactaactctgtggtaatttattacagcagccacagaaatctactagaacaggtgacctaggaagatatatcccaaataaagaagagggtgtgtgctgatcttgaccttggatctggggggaagtggaataaaaggaaaatgttccccctcccctgagagcttatagccacaagctgaactgttcttttagagtggtctaggcatagagtagtggacactccagaatctctctcagaggtacttagaaacagtgattcagccgggcacggtggcttacacctgtaatcccagtactttgggaggctcacctgaggtcaggagttcaagaccagcccggccaacatggggaaaccctgtctctactaaaaatacaaaaaaaaaaaaaaaaaaaaaaaaactgagctgggcatggtggcacgtgcctgtaatcccagctacttgggaggttgaggcacaagaagcacttgaacccaggaggcggaggttgcagtaagctgggattgcgccactgcactccagcctgcatgacagagtgacagagtgatgagagagtgagagtgaggccctgtctcaaaacaaacaaacaaaacaaaacaaaacaaaacaagaaacagtgatctggctgctggagaaggctcctggatttgtcttgaagctgcattcgactatcttacctacagggtttactgagattgtgacagcccaataaaaatagcagtttaaaacataaataaaatacatttttaaagtttcttattttagaaacaaggtctcaatatagaacttaaataggccaggtgcagtgcctcagcctcccaaagtgctgagattacaggcatgagccaccgcacctggcctatttaagttttaaatgaagtggttcagaggtcatattgctccagagtgaccagcagaagcaagcac

SEQ ID NO: 16360 - DNA, 7861 bp, Human
cagatggcaacatcaccaccagggctgagctgaacctctctgccacccggtccctgtgccaggtgttcctttgggctttggcaaaagacccagagagcgctccagatggacttccctgaccttactgtacagatgcaggcaccttccttcaggaggtcgcaaaggctctgccttgtgccctgacttccctgtgaagccaccaatcaaaggagccaagtgtgaggcaggatgcaatatgtacacgcctcccgctctcccatcaccctttcatggttccatggaaagaaagaacatccacaccccacatcttatgcctgctgaggcttctgtctttggcatatttctgttggaccatgtgtcaatggtggctgcatgttttcctatggcgtccaaatcagtgggattcaagacctggggttcctctgtaagggttctcacacccaggacggtcagtctcagggcaaggcactgcccagctacccaccgttcactgtcccctactcccaccccaacgcacacacaggcacacacacaggggaggtcagggaggaggcacacatgtcttcaccaagagcctacaggagcccagttgctggagccatcagagcctctggaaagccactatatactgccgtcctttcagcagcaaggtgggagaagtcagcatcgtcaagagaatttcattaggcacaagcagtctcccccagaggtcagaaggagaaaacatggcaagtagagatgtccctggggagtggccgcaaagtcacggagttctggaaggtcagagttgacaggatcctttgagaacatgaagtctcctcccctctgggttccaaaggggaaactagaacccagagagaggaggaaatggcctaaggccacgcagtggctcagtgtgggagcatggcctagaggtcaaacctcttacccatcagggccaggtgctggctggcagctgcttcagatggtttccagcccacctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcggccaatcaaccccggcgcgaagccctttccccgcccctggtggggcccctagccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcggtgcgcgattggctgccgctgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcaggtagcggcccagccggggcttctttcttgcgagcctctgacccacggcaggtggtgttgggggcaggagggatgcgggggtccggcctttcagggtccgtcgctgcgggccgggccttcccccgagaggcaggcggccttgggacggggggaccaaagcacctcgcgcacgtttaccggcagccaggcttttccttgtctgcccatacgaagaggagtccccgagcctccatggtgcgcccggcccccaagctgcagcacggaacgtgacacatgtcccggctcccgctccctgcggggtcggaccggagcgaagctctgtagcgctgagcgatcgcggccaaaaacggggctggaggagccacataagctaggaagggacctcagtgaggagagggagcaagagcggggcgagttagatggggagccaaaggtgcgcagggccttgagtgccaggccgaagactggcttttccggagggccctgccttacccttaccagagttttcggcagagccgaccaggggtcccgtcgatttgcattcgtgaggggctgaggtctgaactccagagtgtgtttaggaggtggctgcagcagccagccccgggcccgggggccaggactggacaggggcggctttctccacattcccttttctgccgtccttcaggccagtagccttgctgcctgcaacgttttggcagcctaactggcctccctttccgcacactcctcatctgcccctcaggaattccctgaactatagtcagggacgtatccagaggacaagcctggccataaaacccttcgggggctcccctgcgccacaggaagcaggcccaacttaggcaggacacagaagggctggcgggatctagcccctgagaactgcctccacgctgttcctagggatctgcctcctgtggtccagacccagagccttctctgacgtcctctgctgaagccatcgttctgccagggcaccacatttggacagcgggtggctgagaacattcccactttggggagcctttgtttcacaccctctgatgtaggcggcagccttcctttcctttgggcctctggttatggagaaggctaaggcaaggtcctttctctcacagctaacaagttgtgcttctggaaccagagtctctcccgtttacttcttcaggaaacgctggggccagtcttcaccttctgtcaactggccgggggcagagaccctttctctcatcttgaaagccccagtgcattgcctgcctgcagcccccacccccgatgtctctgctgaggatgccttcagtaactcgtccaggccgtttgtggctctgaattgaggctggcgtggcccccgggcctccgtgtcataggtccaagtgttggcatgtattgtccagtgaatccagcccccacctgtccccagttcgctcttcctgcacacctccagaaagccggccttgcccctccccagccttccttcacagccatcccgcctacgttgccattgcatttgtgaccgagcacttggatctgtctcgcatatcccacctggaaggggcaggaagagcgcatgggtccccagctgatccgtgctatgaggcagggccgggccatcctgccctcagaccgggatactcgagctggccttacccaggcatctctccctcttccccgcagccgaggcctgcctggagccccagatcaccccttcctactacaccacttctgacgctgtcatttccactgagaccgtcttcattgtggagatctccctgacatgcaagaacagggtccaggtgagacagtggggtttcagacaggagggcgggtggggggtgctcctcactgctagttgatgggggacctgtgtcgatagagggagaatcaagattccaactcttggggtgccggagagatcagggcacggtgatgccagatcctagccagtgttgacaggtcaccttcctcacctgctttgtgtgctgtgcctacacgaggtaaccctgggctcaccacccgctgtttcctgaatgagtatctggaccgggagaaagggccaggagtcagcccaccccggttgccattggccagtttgtctgtgtgggtgttttgtttttgtttttgttttttgtttgtttttttgagatagggtctcactctgttgcctcagctggagtgcattggcacgatcttggctcactgcagcctccacctcccgggttcaagcgattctcctctcagtctcctaagtagctgggatgacaggtgctcgccaccatgcccagctaagttcccataagtccaaagaaggaaatggggccttttttgggtatggccctcttagggtaaagcaccccttgggcagcccactgggcacccctgaccccagcacctcccttgtagactcaggaaatcactcagcccttttgatcatcccgcccctgctcacagtcaacagggttcctatgcgtccagttaggcccggccatggggatctggccttgtgcccccgtagggaagaccaatgcagagggccagtcacgggattggtgagtgttacctggtacctcctgccagggacactgcagcccccaactgggcctagcctgcccacctgcaggccgtgtgagcagcgcacagggctcctctgcccacacccagagggggcagaaggtgaccctgcctttgttccctcacccagaacatggctctctatgctgacgtcggtggaaaacaattccctgtcactcgaggccaggatgtggggcgttatcaggtgaggggccaatggttcccttgctagggggctccctgctcccgggtgtgacctgaagccccaggggtggccggtcaaccagggccaggggccgtgggctctggctgccggagtgctgcagtgtcggcactggtggtcagggtggcccctccgtgtccactctgcccacactctgctcaacacccaacccaggtgtcctggagcctggaccacaagagcgcccacgcaggcacctatgaggttagattcttcgacgaggagtcctacagcctcctcaggaaggtgaggactcctgtagcccactgtgctcccctgtccctggggagcaggatgggctgggttgggaggtgctggcagcaagtcctgagctgggtggcctttctgtgatcctgtcccttcctcagtgtctcttgcccatttctctcctttccttttctggggcttgggccggtgttcctacctgtctttcccctcccctccccacccccacacgccaggcacccctgaccccagcacctcccttgcacctcccttgcaggctcagaggaataacgaggacatttccatcatcccgcctctgtttacagtcagcgtggaccatcgggtgagtggcctggtccctcctcctttttggggttgttgggctgagtgaaggttatcctctccacagccccagctctgctgctgggccgtgattggccagcatgtcttggttcccctggcggaaggtgaccagggctggctggtctgctcacctgtactcccctgagctggcttgtgatctcctttttttcagggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggggctgctggcttgcgttattgtgccttcccccgactgggagagctgggggcccagcgtcctcttgtctgcctggccagcagaggcaccaggcaggaaaggggtgggctttggtctagaactcccgtccctcctcccaatgaagccccccgtctggtccccacaaaaccctgtatccaccttcccagtgactctctcctggttctggtgagggcagtgggcttggccacctcctccccaggtggccccacaggctccatggggaaacagccagcctggtcttcatcacagctcctgtgttggaagccccgggcccattccgcacgcagaggggtttccctgcactgctttcgggcacagcaagtgcccccaccctgcccatgcggcgtgcagctgtctgggcttggcccctccatactccacaccctgaccatgccacctggcttcccgtgtgctgtgccttcatgggatattgagaaaatacacacccatggccaggtgtggtggcacacacctgtaatccccacgctttgggaggccgaggttagaggatcacctgaagtcaggagtctgagaccaacctgggcaacatggtgagaccctgtctctacagaaaaaatagaaaaattagctgggtgtggtggcatgcgcctgtagttcagctacttgacctggagaggtcaaggatacagtgagtcgtgatcacagcagtgtgctccagcccgggtgacagagtgtgagaccttgtctcaagaaaaaaacaaaaccccacctgtgaggggtacatcacttcctcctagagacacctctcccaagagcacccgcgccctcaggacaccaggcaggcatcccggcctggcaccacgcctggagttcatcctgcacctctcccatcagcctgattttcagcttggcacatgctggctcctgaccagctaatggtattccttagtggcactgagggcccatgaggcagtgagggtcttggagtccaaagggactgggtggaaatcccaggtgagcccttcccagccatgggacccaagtcggtttgctcagctgcgaggcagtgacagtgcctactccaaggtgtcagggagtccactgggaccagccaccaaagtcctgacatctgggtcacccattggctgttactggagagaaatggaattctccagagaggctgcctttttcttgtttgtttgtttttgagacagagtttcgctcttgttgcccaggctggagtgcaatggcgcaatctcagctcactgcaacctccacctcccaggttcaaacaattctcctgcctcagcctcccgagtagctgggattacaggcacctgccaccacacccggctaatgttttgtattgttggtagagacggggtttcactatgttggccaggctggtctcgaactcctgacctcaggtgatccatccatctcggcctcccaaagttctgggattataggcatgagccaccgcgctcagccaaggctgaaaaggagggaaggcccaaaacttgcctgggaggtaggggctcctcagtacttcagctcggtggctagagagagcagcactgaggggccgggggtgtcaggagcaggtgaggactgcctgtgacctgggtctgtcagagtctcggggagggggtcatctatataagcagggagccctcttcccacccccaggccttgggaggggggttgggaggggccggctgccaagaataggtgggcttctaggaagagctgggcgctcaccccaggacagtgcagcaggagcgttggggctgaggggccacaccagctttgccagcagatgcagtttctagattccagaggagactcagcagcctgtgcagggcgggtggctggggcaggccgggtgcagcaggcaccggggcgactgtcgggcgcccggttgctctttttagttctggctccaccacgaagcctgatggccgtgggacccagacgtgaagttgctattccag

SEQ ID NO: 16361 - DNA, 19085 bp, Human
agaccaggggctgccatagccacgcctcttatctgctcagaaagcgtagaaggtgcatatgcaggccatatacacacatatttatgaaaatggtgctgcctgtggatggatttattttcttttttctttctttcttttcttttttttttaaagacagagtcttgcactgtcacccaggctagagtgcaatggcaccatcacggctcactgcaggcaccaactcccaggctcaggcgatcctcccacttcagcctcccaagtagctgggactacaggctcgcaccaccatgcctggctaatttttaaatttttttatagagatgggggtctcactatgttgcccatgctggtctagaactcctgggcccaagtgatcctgctgccttaggctcccaaagtgctgggattacaggcgggagccacgacgcccagcctgatttattttcttctgtggaaaggaaggagaaacccattccccatgccagattgcaggcgtctgtctcatccggggccagcaaggacatgtgtgtgtgtgttggggtaggcatggggggaaggacagggagagggagagaggccagctggctcccccaagcctcccctcctggagcttctaaatccctccctggctccttcaaggctgcctggccttcctgttggggagagacccctcgccggctgctcactcgctttttggtggtccttcccacgggcctgcctggtctgcctccacatcctcagcggctgcaggtgagaagctgtggatctggggcccagtggtccagagcgtggcccgtgccagaatgcccaggttcaaatcccatctctgtggaatgcactctgaagaaacgacgtcaggtcatggccctgggcaagttacccacctctgtgccccatttctctccatgcaggttggaaagaatgacacagctgctcagggaagcacccataccccgagtctgctgggcctttgagctccagggccaacacctggccctataccctggccgcccccagggctccagccacctgagccaagcttctcacccccaggcctccccagccccatcaccatttcctcctccctcatgggcccctcagtcttaccgtcctcccacttccgccagcccctctgtggatggccctgccacagggggaacagtgccccagcagaaaagccccagggtcgcctggattctcctgccttcgcctcctgccctgggtccaacgcacagtcttcagaatgctgcctccccagagcgcctctagaacgcgcccgcctctctccatgcccatgaccaccactggaccaggcctccccacattctctgccccagtgccaccagcttgcagttgcccatggcgagacaagttcaagttctcaagcctggccacaaagaccccacctgatttgctgacctccgccacaccctgggagacggcccttgaccaaccttgtgttccagtcggtgggaaacactggtttttcctcaacgccacgtgggcatgtcacgtccaggcctggcctggggtaggcctcagctccatctcctgcccaacgcctgccaaggttcatggttcaaggtcatgtagcctgacggttaagtgaaggggccctgtgattgactcagccttgccacatactagctgtgtgactttattcaagtttcctaacctcctgtgcctcagtttcccaacctgtgtttgtttctggatggtgccagtgccaagcccaagcctggcatccagtaggtgcttcgtgccaggttatggaatgcccacccaataggagggcgctgccgtctctcacctgccaggtgcccacggtcagtactccatcatgcccgctgcggccagcagagggcagcaacatcctgccctgtgccattgggcaaaggggcgggcggagagaggctgggctgcctggccgggcttgttgggatgagtcggactgggcacgattgcattgtggggagggaggctggggctctgtgagacgtgctcctggcaccgccagctgctacttggccctcgccggtggcccaccaggtaggcaagagctggggcaggcttgggcttgggcttggggtgcaggggctaccagcctcagggcaaggcatcagggtctcagggccaactggctggggtcaggcaagagcgctcgggtgtcggcccagcctgacgacggcactaggtgtctgggagcacggtgtcccccaagtggtagccctggggttaggaggtggggaaccatgtttcttccccgaaatgggaaagccaacgccagcctcgggcagggtacagggtagagaggctgcccgcctggctccccacccccacagccacccaactggcccagccaggtgacagcagcccactgccaccttgccctggagcctactgctgccgtgctgtgggggaggcagagaccccatccccagtgcacctgctcctgtgccactggccagggtggcctgtgagggtgacagggggtctagctgctaggtgcccctcccttccccatcccctgcatggatggcatctaggccagcaggacggtgcttcagagggtggggtggacagccccggcctgtggaccctctgcctcagcccatctcaagcagcctcctcccgtggtcctgctcgctgccaccatgctgtacctggcaccacttcaccagtccccaggggcagggctgggctgggggtgtggaggaagatcttttggacaaaggcaggcattgagggccaggactggcacttcacccaggccccaaggctaccagccggcatttgcaggggctccaaggtccaccccgtgcccttcacagggacccggggagccagggaggggcatgcttagtgacacaggggttgcagggccagagggggagggctggctggaggaaaccccggccctttgtccccggatcccgggggtggctccctgagggtgggaagtggcaaggagccccctgtccagaacagcccagtgggggtgacagcactagcgagtggggccctggcctggcctctggacagagggaacattgttgtggtggaggcagggctgccttggcctggccactattgacaaagctgccagctgtgagggagcccggtcgctaggccctgggcgccacccccaccgccgcccctccttccccaggccagctcgaatggggctgagcctcgactgtctccctcccactcaggacaatgcccccccgcagccatctcatgcccatcgccactgccctggggcagctgaactgagcgtatgtgccacgccgcccaggagacccctctgctgcaccacttcatggtaagtgcccaggcccggtgtccccagaaatgttcctgggaggggcagggtagggcaggatggctgtggccaggcccaggacatacaggctgcagcctccctcatggcagacactgccccagatagcccggggtccgcaggaagtgtccgtgctcttcctgcctgtgttcctgagataagcggctcctgggccttcctccaggcgctgctctgccctgagtcgcagcggccccactcctggtcggcatgtgaccacacacccagggcagcatctctctgtggagggcaggaggggccagagaaggggctgctcccacctctcaccctcgggggctcaccccggggtcccaccaggcacacccaggaaccatctccagtctggcacccctccctgccccttccctgacccctcccccagccagctctcctggtctgctcttctcctgggacactcctacactgaggccccctgtgccaggccctgagagacccaaactgctggggcccatggggcaggagcaggcctccccgcacccctgaagcctgtgttgtctcttgacacccctggcttctcccagcacccccgctgccttgccccagtgcttcctcgccctggagctgggcgccagcatggagctcacccctgcctcttcgctgacttgctccttgctcagcccgcggctgcctggctctttcccccagctgcggagggttcctccttgcagccggccctggctgcccaaggcaggttttctctccctgtctggtcccttggggcacacggtggcctcactcctctcacctgacttagatctctcttgtctgggtggtgggcgcaggggcgcgctgtgacacagcttccgccagccttccagctcccgcggcctccctccctcccctgccctctctccatccctgccccctctgtgactcacagtccctctgttagcgctcttgcggctttccaggacctgccccccttcaacaatctacatgcatataaagtaggagatgaaagaattctgtccttgtgtgcttgtgcgtgcgtgcatgcacccctccctgcctcttgctccagctcttggacactgtctttgtccctccttatgtccccctctctctgtgccccctctgtctccttgtctccgctcactctctctcattctccatctctctgcctccctccctccctggccctgagcaccctggcctctgtccaccccaccttccaccttcctctggtcctctatctgccttgcgctcccactgccctgacctgtgccctctcacaggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgtgagtggcatgcccttccatcccccctctctgtggatggctggcatctttcagcactggacaggggtgcctgcccatgggaagtgccagccaacctctcagccaggggtcagctgagtctccaggtctcctgcctgctctccacccatttctttccacctttctccctctggatgctatgagcttgccaggtgccctggcccttcggccctgattgctgggccttggggtcatcccagggtgcctggctctcctcccgctggcagcctgggtaccccccctgactgcctctctgctctcttccgggggctgattctccacttcctgccacgtaggattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtgagggcccggccttgctgtccggctgggtgtgcccctggccacggaggctcaggaaagcccccagcaacttccacctcttagcccgcatcccacggttgggtcaggggactttgccacacagtgactgctggctgagcactgccccctgcagcccggccttcaccagctggtggtgggtcacggtgaaggtggctggggtggctgggtgaggtgggcagggtgtggtgcctcctggtgaccttcctgtctccccatagctgccctcccacctggcagaactgtccctggtacacggggcctcacccagggtgccgctgctgccccggtgtcatggttccctggagagtgtcctaggcctgagggtgctgagtgggggaagtgatgtgtcctccctcgatggcccggcaggaaggggaactggctctaaaaaggagcccccactaggaggagggcgtgtccctggaacaggcaacctttggccatctggcccagcctcgtccttgtccccccactcaggtctttctccacggctcccagggccaggtttaccactcccagcaagtggggcctccaggctcagccatcagcccagacctgctgctggacagcagtggcagtcacctctatgtcctgactgcccaccaggtgagggccatcctggggctgaaggggccagcacacgcggcccaagtctcgtgcccattgcctctctgctctgctgcccctccaggtggaccggatacctgtggcagcctgcccccagttccctgactgtgccagctgcctccaggcccaggacccgctgtgtggctggtgtgtcctccagggcaggtgagcacggggcctgtgcctaggctagggccaatgggtggtgtgtgccacgaggctgcccctggaagtagccctaggcgtgccgggaggccaaccctgcctgttggagagactcagggccaccacggaggtcacccatcctgccccatctcactgagccgtcaatctggttggcaccccccttttccgacaccacccggcctgtggactcctcatcccagcagccccagccagggtccagaaccccacacagctgtcctccagccggtgctccacacggcagcccctggaatcctttaaggcagccctgagtcactgtgcgtccctcagcccagccgcacctgcctctcagggctggagcccacgccttggccatgaggccctgcctgcttggcccctttctctctggacacagtccccttcacgcctcctgctcattgcaccccactgcactccagctgggccggcctccccaggcccctgttgccggtcatccttggagtctaggacccccacggtgacctgatggacccctgcctggcaggtgtacccggaagggccagtgcgggcgggcaggccagctgaaccagtggctgtggagttatgaggaggacagccactgcctgcacatccagagcctgctgccgggccaccacccccgccaggagcagggccaggtaagccgcccaccaccactgggccctctgggcagcatgaccactgcctggagcatgaaccccgcctgcctcccgtcctccttcctctcccatggcctctgctgccccctctctctggctacatctcccggtttctccccgctgcatcccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacaggtgagtggcccatggggtagggggctgggatggaggctggaggggtaatgagccacctgacctgtcctgcccccactgtcccctcccagaccacatcactgtgcccctggccctgatgttcgaggacgtgactgtggctgccaccaacttctccttttatgactgcagtgccgtccaggccttggaggcggctgccccgtgagtccctgggcctgcctcctggggtaggggtggcgaccccagagggcactcagttgagcagccaccctgcccctctaggtgtcgcgcttgcgtgggcagcatctggcggtgtcactggtgcccgcagagtagccactgcgtgtacggagagcactgcccagagggcgagaggaccatctacagcgcccaggaggtgggtgggcccgaacttcgggcagagacagggctgtcccttctccacccttcccagacccgcccagcagtaggccctttgagttctgaagggctgagggctcttgttttcccaggtggacatccaggtgcgtggcccaggggcttgcccacaggtcgaaggcctggcaggtccccacctggtgcctgtgggctgggagagccatttggccctacgcgtgcggaaccttcaacatttccgagtgagccatcaggagggaaggggacagggcagtgaggtctgccaacagcgtgtccacactcctgacagcgtccttccccagggcctgcctgcctccttccactgctggctggagctgcctggagaacttcggggactgccggccaccctggaggagacagcaggggattcaggcctcatccactgccaggcccaccaggtgagtggctgccttccaaaccctcttgcccccaagcttccgtagaccctcaggggtctgccatctttgtggagagcctgcttggggcccataacctctgtctgtgggccccagtcttgggggagaggcagggaacaatcacattcattctggggggtggcccagaggagacaagagtcagaggtgccctgagtgggcacccagcctgaccccacactctgcccacagttttatccctccatgtcccagcgggagctcccagtgcccatctacgtcacccagggtgaagcccagaggctggacaacacccatgctctttatggtgagcctgagggcagccaggcaggcggggcagggtgggtggcagacaggaggcgctcagcacactgcctgaccctccctagtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtgagtctcctgccgggcccccacagcccagtggcccacttctcctgccccgcactgtcctgtcctccgtgatcagaccagccctgccccaggcccccaaaccccagcagctcggcctggctgggctggttggctggccgggcacccagcactgcagagtggagtgtgggtgcgggggaccccatctgccatcatttgcctgctgcaggtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggtgaggcacttggagggtgaagatgggtggggaggccctcagagatggccacccagagataaggaaggcctgtggccaagaaacctggggcactcgggtcaggggaggggtgggctgtcccctgcgtccctgagccctgagcagctcccaggcctcggctttccaggattgtgtgtgtgacatctcctgcccccaatggcaccactgggcccgtccgggtggccattaagagccagccaccaggcatctcaagccagcacttcacctaccaggtcagtggcctcccaggtgtgccctacgcaggggagggtaggagggagggccaggaaggacaggcacctagtaaggatgtcaagctgggtctgcggggagcaggaagcaccgctgcatgtctaggagggaagccatggcatgtgagtggaggtgggcagccaggccagtctgaggcacgaagctctcaggatctgttgccctgggcacttggtggcaccgtttcctgggtgggaagcctgggacaggagcagtgagcgcaggggtgggttctgcccaaagaggcaactggatttgagagtttagagctccaggtctgggggctgtaagctgtggtggggaggaggctgtcccaagggggacagagtggcagtgaggatgaaagagccccacttctactccccatgcggcaggggtgggtgggaggaagctggccagtgtgcagtggcctcgggaaggagggcgtggtccactttggccccaggaggtgaagtccagagatgacctgcgcttcagaaccggagggccttgggcatggcccaggggggtgaaagggccaggctgggctgccgtgcctacccagcctgcgctgttcgccaggaccctgtcctgctgagcctgagtcctcgctggggcccccaggcagggggcacccagctcaccatccgaggtcagcacctccagacaggtggcaacaccagtgccttcgtgggtggccaaccctgtcccatgtgagtcccggcctggctgccgtcgggtggtgggcactcccataggcctcagtgggggtggtacatttagagaagtggttgctgtggccacccccagtggtccctgcccttgtcaaggcaggcaaagcagggcttctcctacgggggttgggccagggctggggtagaggggtggtagagccgagatgacagaccccactacccatcctgcagcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggtgagggtcagcccgcaggccagcctgtgcaccacgcaggagggaaggtgggatgcgggctgggctatgttgcccaccgcccgcccacacccgactgccatcctggtacaggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcaggtgagcccctcaccagcaggcgacaaggctgtccccgaccatgcccatgcccagtggggaggaggagggtaggccgccatgcccctagcagcgcacagcagagcccagctcactccacctgtggtcggccctgaatgccccacagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggaggtgagggccaccttcaaccctgccccgccacggtgctcaggccgcctctgtgggggccagcggcttaggctcccatgtgtgtcccagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgagtccgtgccctgggtgggcaggtggaccgggtgccgccagcatgcactcaggaaccctgcccgccccccaggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggtgagacccgcccacccccagcacacttccctcctcgccattggcaagggcgccctggcaggcggctggcctggccccggccctggctgatgctggccccggccctggctgatgaagctggccccgggctgcaggcacaagagcaagcaggccctgcgggactaccagaaggtgctagtgcagctggagagcctggagaccggcgtgggagaccagtgccgcaaggagttcacaggtgggtgcggaggcggggggacagggtacccacgaggcctgaactcacacctcggcgcctcctggccccgcagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacggtgagggccgtgtggcgggagtgcccagtgggcaaggaggtggggctggggaactactggcctgagacaaaggtgggggaggagtggggcttcccaggatgagcctccgacccctgctcagctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggttggccttgacctggacccggtggcgggggtgagggcttgccacagacctgcccccatcgcaccctgggcgggctctgtccaggggcgggtggggccaggaagccccagcaggtggggggaaggaaagtgagatgtcctcagcagggacacaggcacaaaggcctgaccctgtggccggctccccgcaggacagagaccatggtggagaaactgctcaccaactggctgtccatctgcctgtacgccttcctgagggtgaggggcactgtcccgcctgctcccagccctgagtggcagactcctcccctcttgccatgagggggctactgcctgcgccctacgtgacgaaggcccggcaaggggggctttggaaagggaaggactttgaaccctctccggggctggagacgaggcagaggcgagaagggctatcatcaatcctccctcgcttggctgatgccggctcatcttggcagtgcaggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttggtgagagagccagccctgcccacccaccccagggacccttccctacccctccggcacctggagcccctcaactgtgtcttactatgagtgtggggcgtggagagcaggctgtagactatctgcttccctgactccctccagagtggcgctcaggcctggctggtcacctgaccctatcggacgaagacttgacctccgtgacccaaaaccactggaagagactcaacaccttgcaacactacaaggtgtgagcagggacggggcgaggcagggcggggctggggcggggcagggcgaggcagggcagggcggggctggggcggggcgaggcagggcggggctggggcgaggcgaggcagggcggggctggggcgaggcggggcagggcggggctggggtggggaggggcgaggcagagcagggcagggctggggcggggcgaggcacggcagggcgaggatggggcggggcgaggcagggcggggctggggcggggatggggggcggggcggggcgaggcaaggcagggaagggcagggatggggtggggcagggtgaggcgaggcagggcagggcgggtctggggcggggaagggcgaggcagggcaggatgtgggcggtgtaggcgcctggctaggggtcagcacagcctccgctccccatctctgccaggtcccagatggagcaacagtggggctcgtccctcagctgcaccgtggcagcaccatctcccagagcctggcccagaggtgccccttgggagagagtgagtccctcggccctgacctggggccactggagtccaggctgggcaggcagaactcctggccatgcatctgcctcaacttcatcccccaccccaccgagatcttctgcccatctccttcctttcttccagtccccacactgccccaccttgtcgggggagtggactgggcatcccaggccaggggcagggggtatagccctgaagccaggctcctgtgccctcagacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaaggttggtgcggcctgggtggctgggcctgagaggaggctcagccagggaccccgaccgagccagggtgtgggaggggcaggggcagcctcagccgtggatggcccccacaccctgccctccacacagcccttatcccctgcctcgcagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacaggtgcctttcctgctgccccacccctgctgtgcatatggtccactgagtcccagagagaccaggacattcccagggtggatgcgcccacctggggtttctggaacttacaggaagatctagggcccaggtcacctaggccaccaggccagcttccagcggcccctggctccgagtgtgttgccagtaggctggagtacatggggcggagatcacgatggcaggccagggcctcacgcccacgcctgccctgcgcccccagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggtgagagcagtgccagcagcagcagctggcaggggcttgaggaggaaaggcttatgggggaagcctagagggctgtgcacagagctctgggtgggcagtggcagcatcatgggggcaccttcacctccgagctcatgcctagcgcctcccctccctccggagcaggattccccagtgaacaaactgctctacgcccgggagatcccacgctacaagcagatggtggagaggtgggtgtcagaggcatcggggctgcggggaagggggctgccccacccctaacgaagtctgctcctccaggtactatgcggacattcgccagagctctccggcgagctaccaggagatgaactctgctttggctgagctctccggggtgaggcatggcccggggggtgcgcctgtccacacgtgggtggaaagactagcagagcagaggggggagacttggggcttgaggaccaggctgggacctcactgcccccctccacgtggtgcccccagaactacacttctgctccccactgtctggaggctctgcaagaactctacaaccacatccacaggtactatgatcaggtgaggcccagggcactccggaggggaggcacagtggagcgggaggcccgtggaccctcccgggggagcaggggtgccagcccatgctggcggggcccaggctggggaagggactcggctttcattctgattccccagggagacgccaggcagcccctgctggatccccaggctcctgcggtgatggaagcagggtgggtggccctgggccagcaggcagaggggcaggctcagacaggcaccctcctctgcccgggcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttattttgagacggagtctcgctctctctcccaggctggagtgcagtggcgcaatctcggctcactgcaacctctttttcccggagttcaagcaattctcctgcctcagcctcccgagtagctgggactacaggcgtgtgccaccacacccgactaattttggtatttttagtaaagacagggtttccccatgtcggacaggctggtctcaaaactcctgacttcaggtgatctgcccgcctcagcctcccaaagtgctgggatcacaggcatgagccaccgcgcctggccagaaatgtcttttgacaaagggcccaatccccagcccctgctgttccctgcaggagctgactcagtgctctcctgactgagagtccctcagccccatgcctataacctgctacccacggacaaagagaggccatcaggtacccgggcttcactttccctcccactctctgacctcgctggcccctccagcaatgcctggcccacccctaccagttcacggaccctggtacagggacactgcaccaatatcttgggacaaacaccctctctgccgagccccctccctttcattgggactcctctgtcaggccccagctggcctcccggctccaccctcgcctctccattcccttgtccttgaagtggccagagtgatcttttgctgagcagaagctcagtgaccaccccccaaccccatatcacccaagctccacattaagcctacagacaccaggcctctagtcctcgccctcgaaccatgcggcagccgtggccagcacgtgaagggctggaacgcgtcttggccgcaggccttgccccactgtgccctgtgctgccctggatgcttctggggacccaatttctcctggtctctcatgatgcagcccctgggtcacaggcccctcagtcaccaccgcactcatggggaagtggctatgggcttgcttgtccccagcagtgagcagcttcctgctgcctccctcatgtctggctatggagcagcccacgacaggcaccttgcaaatggtggagaggaagagcaggcgctgggagccagagcgccaggcagcgtcgcaggagcaggttctgggctggcaagctcccaggcctcccctcagcaggcctgttgcctctggtaggggaaatgaggggtccccagtgacgccacattcagagggcactggactcccagttgtcctaggggctgatgaaacatagaagaagcaggaagtggctgggagcagccagggacagggttcccatgggaatgagaagggcacctccaggaggatgcccacaggggcacaggtggtgggggcttggcctaaggaccaggttgccaagtggagcacatccccacagtccgcaccggagaacgggagcccgacctggggtacgggctgcttcacccccgcgtggacctccccctcagctggggtgcggaggctcagcctgggggcccagttgccccggtccccaagcagcagccccctctgcctccagggtgggcctggagcaggaggggggcctctgcccgggggccgggctctctggggccgccgtcgcgccgccccctccccgcaccgcataccttgcccacagccgagcagctgggaggctatttataaaggcgggtgagatcagcggccggccaaggctataaattcgcaggccgcggccgggccccacaggagcagccgcccggggcaccggagctgcgggctgcgtggccgggatgagcgccagcacgggcggtggtggggacagcggcggcagcggcggcagtagcagcaggtagggctcggctggggcacccggagcccctggcgtctctcatgcccactgccactcaccccacccgcagctcacaggcctcctgcgggcccgagtcctcgggctccgaactagccctggccacaccggtgcctcagatgctgcagggccttctgggctccgacgacgaggaacaggaagaccccaaagactactg

SEQ ID NO: 16362 - DNA, 27630 bp, Human
aaggtcttccagcaggacgcataacttcagtaacttcaaagtaataattctgcccgccggtagatctggtagatcttgtaatttaactgaacttctagacgtttacaacaaaagccacaggctctgacaggaccggtctgtccatttctactggcgactgccgctcccgggcagcagcttgggtccccgcgctgcggcctgcgcgtggcagggcggatgccgccgccgccgccgccgccgccgcgcccgggcggcctcctagaggaggcgaaacgtgggggcgaggccgggacccacctcccagggctgcggtgagcacttacagtattggcgcgaaaaggccagctatcaccatacgggtatttcgcctcactcgcctcgctgggggaaattcaaatctccgaaaagggaggatccgagcagcgccggtgcgcctgcgcgcagggcgggactcgaagcctgggaagcgggcggggcgaggtgacgcgagatgacgcggacgcctcccgcggtcgcccgcccggctcgtgcgccaccggcccgactgcgggcctctcggcagtgggggcggccgagcgcgcggcggtctggggcgcgcggcccggctcattttgctgcggcgcgggcggaggcggtggcgcccgagggcgggccccgcagcctgggagcctgggagcgggcggaggctccacccccgggcgccggcgctcggctgcgtcgcctcccactgtcgccccgcccccggctcccccgcggcgcgcctcgggccgcctcctgcggctgctgggtgtgcagggcgcgaaaatgctcgcttcccggccgcaggcgcggctgcagtggctgttcgccaaccccggccacctgcgtgccgctgtccccagtgctggttaaaggcagttcttcgggcgtgcgtcccttatcaacccgagagaccgttcccaagggggcggggccgagcgcgtcggaggggttagcagtctcatccgggcatttccgaggatgccgccgccgccatctttgttttgtgctgaaagtcgctattgacgcccgcggacggccgggcgaggggaagtggcaagatggcggctcccagggcggaggcgtggaggctcgcccggtgggggggccgtggggcggggcgcgcctgcgcctgcacctgatctgagcgcgactcgagctttagcccagcgcgcggcagcgccgacccccacccccgccgcgaggcagcgcaggggtcctttaagaggcttgggcccaggggcgaagcggtgcgagggcgagtggggggaagcggtgacgtcacccggctccgcctcctcgcccgaccgccggcgccgctgccgccatgtttagttgttacttcttcacacaagatggcggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacgggtgagtgcaaagcccgctgggtcttcggctctttccctccctccatctcctccctctccctcctctttcctccctccctccatctgctccctccctctcctccctccctccatctcctccctcaccctctacccttccctctctctctcccctcctcccttacccgtccttctcccctctccccgtccccctcccccttctcccctcctccccctccctccccactgatcggcttgcccctcccctttgctgtgccgggcttcagtgcttttctctgatcttctccccgttcccttgtctctcccgtgtttgaggattggttttcgttagttaaaagaaagcccctagtccgactggtgagggagaggggctgtcgccagcggtggtgacttcagacccacaccgttacccagcgggctggggctggggctggggcgggcggatgtgtccccttggcgcaggcagagctcccctccctccctccctcccttctcctgcgcctgctcagctctccctcatctcgagtgcccattctggagaaatgaccatttctagattacagattcgttctctgtctctcgaaaaagggagggaagggaagcgctcttaggacgcagagtttaacatccgccgacccgggtaatgccggagccttggggacccctaggacgggccggcggcagggccgcctctccctttccacgtttacttctgcagcatttctttccaagtcgccccttctcctaatctggtgccttctggtttacaagctgaattccagttacccctcagcggcctgcgtagtcgtgtgtctccccgcttctgcggatccagggggttaccccacccgctcttctgcctccctgcaaaacccaaagcccgttagttgggaaggggaggaacctctctcttcaggtatggctgatgcaccacggccttcgtgggggccgtttgttgttgcctctgcctagtagccttgcttagtctctagggcagaaagcctgctgctgtccacgacagctttgtggcatcctttttcttggtggctacttggcccgttttgtgcccctagcacaagggtcagttcccaagttgcctactgactgcccgttggcccacaggaccctggccttgcccagaaggcagggtcagggtgagttcggtcccaggcaagagctggaagagtctgggtgagggaaaagccccctgcaggcggctgggggagggccttgggatgccctagtcctgagtggcaggcacggctcccagcactaaccccttgctccgcggccgttctctcctgggggctctagcgatcccctggcctcggtggtggccctgcagacaaaccctcgctgagtgggctttgtgtcctgagcggtgagaggctgctgttctttggctgagctccagtgcctcgatgctctgggggtgggaagctggagctgcctggagggagaaagttggtttagggagttgggaaggctggagctgggctcttgggtgccgcttccttccccaccccccaaggcagaaagtgctggtttctccacatctcggagattatcgccacctaccacgttgactttgaaaggctggtgggttgtctgtgaccgtttttcgttccaggtctctcagcacctgttgcctccagggagcagggcctttctcagcagcccccgggcgggggcgcttggtggttggtggtgccccgcgccagcccaggcagctgcagtagcaggaattagctcagtaagctaaggcttctccagtggtggggctgtttatagaggcaccgtcaccatgagcagcaccttctccactctgtggaccgactttcttctcataaggcctggagcaggctccctggcagggaaatgcaattttagaaagtagggcaggggcctaattacagtcggctccagagtccaccaccactgctgccttggcttcctggggcctctgcatattcattagtttattaaaatgaattgaccactttggcatgaattcattaccagtctgcaaagacaggttgtgcattagaggggtagcctgccttccaaagggctgcttaaaatgaagctctgggatcctccagggtagcagtttggaaactgtcatcggcaattcctcagacgagagagcagctggcagacctgaagccctcttcctcaccggggtttctgccccctcccgccagcccggcctcgtcacctttgtcttgtcttcttttgttgtgtttgggatgagatcagggcatattctcacgcctgtgccccttgcagttctgcgggatcagtcctcaaaaagccttgtacctttggagagagctgatctggaaggggttcccgttgctaggataagaaagcttcagggggtgtgtgctttgagagctcttagggtagctactgtgcttgtccttagggaattttagttccatgtggcaagccaaaggattcagagtgctgccaggtgtggggggtgggggagcgagagctttggctacggtggctctgtaatgtccataggttcttggagctggagggagccttggaaaatacctagtggaactacttccttgtttctgcagatgaggaaattggggtccaagaggggaagtgacaggtccagggtcgccctcccagctggtggcggagttgggcgggagtgcaaaccttcatagaggccgttctgccacctgtctttggggcccatcacctttgaaatgcctccattctctcctctgtccctgtatctaattgttcattgcgttgggcaggcatcaaatgtgtccccttccacaccaagccctcctctcctcttactagactcttgcagtcacttcctgattggccctgctagtttcatttgtcgggaaatcctgttcacccttcaaggcccggctgaaacgtcacctcttctgagaagccctttccactcctgtcctcccctctccagcagtcgcactgctctgtgctcccaagggcccggcttggtcagagctcttctagggtgtttgtctcatcgtgggaggggggcatgcagccttcctaccccattgggagtatgagcacaagatcggtgtcctctgtgcctcccagcacgtcgtatgccacacaggaaatgctctaatgtgacaggtagaacagagaggaaggcagctcgttgaacttgaccggccacctcactgcatgggcaccagtctctaggtggtgatgggacagtggcaaccagggatggagcttgcagagcatgaagtggttgggggagctgatgaaacacagagaggccggggcacagccttgctcaggagaggggagctggagtggtcttcatctagtgcagggtcctttccccaccttcccctcccagctgagagccagcatttccaggatgaggggcccaaggattgggttacatgacaccccccagatgattcaggggtgactgagagcagctgtcacattgaaaagctgggagaagggaggagagcttgctcgtgtgctttcagggggcggaaccaggactcgtgggtgagatgaggagccgcaggtttgtcgtcacaccaggagctgtgctccctgacagacctctcttgacgggggtggggagggcccctgccctgcctggagtgttctagaatgagatcagcacctcttgggtcctgtagaaggatctggtgagcgggatccccaaagatatcacagggcgcttctggcctggcccaccggctcactgatcagcgtgtgataggaaagctgcccactgaccccacgtgccatttagctttgtcccaaactctgacccgcagccccatagctgtgggctttgaccacgagggtgctcaggggagtgagggtggctgcctggacatgggaccctagggaaggcacagatcggttgcttcaagtcagtgatggggctgttgtctctgtctctgttttacgctgtgacctcaggtgtcgcttgccctcctgggctctgcccctttacctaccgagagcagttggcccaggcagccttaggtctcgttatgcgtttaccctggtagcttgcatggagctccctccagggattggtcaggacggctctccagtgcgcaaggctgttggccttggcagctcttgcttttctggggtggtttttgcactgggaatgagaaagaggcagagggccaggatccgagcttgcacatgcgggcggcacaggtgttgtccctctgctttagggaaatggcaggggagctctagtgctcggcatgtccgaggcccagtgactcagctgaatggctgcagaggctgtcagcctgctcgaagcctacccgcagagtgggtgctggagagcggggtgggggtgctctcgcctcaggaggagcggtggtggtacagttgtgctgtgtggggttttctgttttttttgtttgtttgtttgttttgaggttaggtcttgctctgttgcccaggccgggatgcagtggtgcggtctcagctcactgcagcctcaaactctgagggtcaggcagtcctcccgcctcagcctcctgagtagctaggaccacaagtgtatgccaccacactgagccagtgttttaaaattatttgtagagacggggtctccctgtgctacccaggctgggagttgtgctttggataagggctagccttgcacacggttccgcattgagccctgggggtgacagtgtgagactgggtgggaccagagtgcagtggggcatgcattcccaaccatggtcagccgcctggccctgggtgcacacctgaatatggaaaaaaaacactgtttttcctcttctatggtctcacaacacttttggccaccaaactgaatagtctgtattatatcacaatatcacagcatccctgtgtggaagccttcccaccccacaggaatccccccatgccctgtcacgtcctgggggacccatcttgcgtcttgagtcatgtggaggggcctcagttccttctgccgtctgcttgctgagatctcacccaggccagctcagaggcacagagtcggggttgcacctggcccccagtttggggtttctggaaagagtgtggtgaatcctctgagggacccctcataggaggaggttttcggggaagccctggcctgccaggtgtgaggggagtcgagtttgaggacatgagggaggggcctggtcccagctgaaggctggctgtgccatcctgtggaagcaaagcagtgcctaaggtctgatttccctctttcttggtggtcgcctcaccctcatgagcttttgagaagcttctgtcacagctctgctgagactgctgcctctggcttgcaagaatgttctggagtaccataggtgtggcagcaggggcagggagggatgctggtggaccatcacctaggagaccagaggaagtccgggaggtcagagcagaggccgggtctcatccccatggctcttcgtagcctgcagcggtcactgttttggccacttgaaagtgctgctctgggctctggctgtcctgaccctgtgatgaagggacaaaaatgtgggctccagggaggaggagcacaggcccaccaagagggtattttggggagaaattcatgtctgatcactgagtgctagggaaggaaggcagtggctagattcccagtagctgatgagggatcttgcacagtaacttcccgctcattaagatgaccttggcgagaagcagggtggtcacaggctcttttgcactggcctgaagtcgaggggtttggaagatggcccaggtagcgcagctggagttgctagagcgcccgcagggatggtgctggctcagcccctctcaccaagcttgacggctggcacatttggggaatgagaggaatgggggctcccgggtgttctgacttctgcctccttctgttccccagcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggtaaagcagccccaggttctcactctgcctccttggccccatgtgacctgacggtagtggcttcagggttgaggcaagcgggaggtggaagggacgcttgagagtctgccaaggctgctctgaacttggcccacctcagaagaaggcagcaaggaccaacacccaggaccttcttgctccagcaaggcacctcgctcacccccggccatttcctcctccaccacaagttgccccgggtccctagtggtggccttctcatcccacggttcagtctccaggtcttgattttgcaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtgaggcttggtccttttctctggaaccccccgggtgggtgtgctctcacatgcacagggctccatggtgtcctaaagaatgtgcgcagcagagccccgtggccgggtccctttctcgtgctgggttgtaaatgagagagcggcaccggatgccctctcaggagctttcgggctccaaaatcgctactgaccctgagcaggcctcgtgggaggagggccaagctggaggtggaagccactttgccttgggctggcccagctctcggagtcggcttagagctgctcgcgttccttctcagcctccgctgcctacaagtttcctgatgggtattttccaaggcccgtggccaaggactctctgtctggaggtagtcccaagccagcgccccctcttgctctgcggagccctcatataatacccagctttgtgtgcatggcgggggcctgctgctgggtctggactcggggctgctgtgcagcctcacccaccctgtgtcccctgttccagttggactcatcctagggagcttctggcagccccttcctcaagagctagggtagaagaacttcagagctcccacagccctagcccctttgtgttctggggaggctgccactcactgatagccatccagcgaagcctctggcgtgaggagtcgagacttgccgtaactgatctttcctcgtcaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattggtgagcagggtggtagcaccccagcagccatgggacaaagcgggtctgcctcttggctggccccgtgggtggcgctgttgtatggtgaggtggggctcttagggagctggagcataccacttcgtgctttcctcttgtcatggtgggccagggtggggaaccctggatcgtccctaggtttggggctgttatctctgccctgtgctggctgagtgggctgaattggtctgcgggcttataagagaataagtcattaaggctttctagaatggaattctctggatccgggtagcattagtccctcttgactcgtcagtggtcagactgtgtggagtgctgcatcctggtctgactgctgtggtaccattggatgccggtaaaccgtgaggccttcggggactgcttgggccggtcaccaggtggtggtatcaggagtggctgggaaagattactaactgtggatctccggaggcctcttcagctgggagagaggagatggcgatgttgtcctatagatcagagtcggcactccaaagaagcagtttcccgtgagagaattttccaacagtttgccaaaatgtctgtagcctaaggtggttatggcggtgaacgtatttcatggagagttcggggtgtgcccaccactcctcccccagcacagagtgcagtcctggctcagggcaggtgctcaggatgtacctgaaggagcgctattgctagcctggtcgaaaccgcctgggtaacacaggaatctagctaccatgacaacagtcagagggcctgccgtaggctatagggaagccagggatggaattctctcactgagacagatcctaccttcctgagctagcttgaatccagggaacgacctgtgtgcagtctaccttgtgtaaccctttcccctccgtctctctgcagacaccctgacgtggaataagcccagtctcagcggggtggcgcctcttcctcgcagtctccactcggcaaccaccatcggaaataagtaagtggctgctcacctgcgtctctcttctctagactggcgtggcccctcccccgaagggctctcactcagttttgtcctgtcagaccctaaggcctgaggatgcctctttctggctgggctggcatttggcagccctgtttttccattacgaccctgggggaccaaggaaagacagattcaggggggagagggccacacacaagctgagtctgagaccctccccgggcctgtgaggctccgccctatcaggtacagagtgttctaggtcctctgtgcaagcacctgggtgtctttgtggatgtccaggtcctaaagggaacctagaaactgtggacatgaaggtgagctttagatgagctgaacggcacttttatgtggtagaggtgacacagttctcctgagggctgagccaccaggcaggagagggccacgtcaggaggcttcacgcatccttggggactctcctggggagagccagaggactgagctctagaactggggtagcagaggtggcctctagcttggcaccaactctacaatcctttcccactcttccctcctcactcccagaatgtacgtgtttggtggctgggtgcctctcgtcatggatgacgtcaaagtggccacacacgagaaggagtggaagtgtaccaacacgctggcttgtctcaacctgggtatggcctcctcgggctccgagtggcctgtgggaggctgcaggaggctggcccttctcagcctaagagctgtgtggggtgtgcggggagcaagctgggcccccggctccctttggaatccactggaaggatccagtgggcagagctctctgaagcaatgttccgcctctgagttttttgaatgagctctccatccaaatggcccaacatccaaaagtgcaaaagcctctacggtgcagggcctccttccctcctcccggttctccggttctgcttctcagaggcagccatgtgggtggtttcctgtccaccctgcaggggctcttcatatctgagcattagccataggtccctttaaaaacaaacagtggcagcctggcgcacgcagtgccacacctggcctttctcatccgccgtatcttggagatcactccacgtccctgccccgcagcagcctccttcgagttgcggttgtgctgctgtaacttgtacaggcgccgctccgtgagtatccttgcaccatctccacccgtgtgcaagtgtatcctaggggtgaaaacctagaagtagggttgctgtccgatgcggctgaactgccctgcacagaggctgtgcccacgtaggcgcctccagtggtgccctcacggaatggtcaggccactctttgccaagcctgatgggtggccgaagctccccctccggctcaccttgagccccagctgctgcgggcctgaaaataaaaatgccaggcgccgatggttgaagtttagatttcttttgcgtgagagtgtgtgttttttcttaagatctttctatcacgttttccctaaaccactttcccattgccgtctctttctgtgagttgtagtgttctttaacgggcaaggaggtaaacctctgactgtgtttctcatggttttcttagttggccgttggtggtttgtaattttattttttgtgttgctttttgccacaaagggtttctttgttttgttgtttttaatgtaataatccaataacttcttgattttaattcccatccttgacaacaaaagaaccaagggcaaccaggggtggcgggtttcctccatcctccttgctgacctcccttgtctgccctcccccagataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacaggtaggcccggcccagccgactcccctcctcccatagcctcccgccccttctcaccaactgcgttctcccacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgagccaggggaccagggacgtttgaaagtagggggctagcctccggggagaggcagcggccaagtaggggctgcgagacggcagcctagacagcaggccagcagccgggagctttgggcttgtctccaagggttgtagggggatgctaaagcctggccccacctgtggaaatggtcactctcagggcacagagaagagccagactcccacacaagcaggccaacagaagtggctcagggctgcctgcaaaggggctggggacatcgtgcagaaggtgatggctgacggctggccccttctctcatcaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgaggagtggtcactggggcgggtgggatttcctgttgatccagtggattaagttgcaagtgtactgaggggttcacatccctctcgggctctggtaccacgcaccccacacctttccctcctgggacgtgcagatggggaaacgctcctgcgaggtcatggtgggaattaataggttaatgcctagaaggcctaacctgctgcctgatcctaagagcatttgccacgtggactttcttgtcctgcagcctgagaggaggatctagccagctgggcttgccacaggcccatgagaatcaacgggacctgactctggtctttagaaaggatccagagctcccagctgcctcttgccacgggggttgccgtgcatggtgggtggtgggagccctctgtgtctggggccaggagagcggggtctggcagtagagaaagctgagccatgctggcgggatgaggctcccaagagcagggcagcccctgggcaggttccggtgaggtccaccaagcagggaggtgggtggcacctgtgacctggcctcacatgcccgtgcctgctgcaggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcgtcttccggggcttgtcactgtggtcaaacaagcatagtcattccctccgggctttagagttagccgttggaccgtgggctgcagaataagctgtctccattaggggcgtcatggcctcaggtgagagctgcaggctcagcctcctcccttgcctgttaaaggaagggggaaccaagctgttcttgggcttgggagcaggaggaggaggaaggtgagtgttgaggcaggagctatgggcccaccgtggacatcttgggtggtttccccatcgctttctttgcctggcctgtcactcgtctctgcctcctccaggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctggtgagtgatgggtgctgccaggctacggccactgccagtggtgaatggccgccctgggccagctccaggagagtctcagccaggccatgcccttgtttggtttccagatcactccttgctccatcccttcctttttagatttccaatctgggcaaagtgatgtcggtggtccagaccaaaccagttcagacttcagcagtcacaggccaggcgtccacgggtcctgtgactcagatcatccaggtgagctctcagtctttgcacatacgcaagagtgggggcctgggtgccaggccacaggaagaactcatgtccctgcccatggaagatcccatgagcacacatggctcagcaagttctgctgctcactcccctcgcccacagcctccagaacattccctgagccgccaaggctgccggcggagagtagccagaccacacttcccttcctggcagtgatgccggctcatgcacctgcttccccctttcagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtaggggcctcccccgacatatgagtgtctgcaagtcctcactggaggggaaatggagtccgggttataaggcgtgctgtgtttctgtttagtttacccttttctatcttctccttgctgccttttgtgtctaagggtagtgaggagatgggcagggctatggctgtgacttgtggatgttcattatagtctaggggcagcaggggcagccctcacagagcctgtctcccctgggccccactctcccatccaggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtgaggcactcccagccgtctctcagcccagtgtcctagtgcagtccaccccagcacgccacgcaggtcctcccgacaggcctgggaggggcagcatcggtggcatctaccagcctggtggtgacgttggtggcactttcctctggtgttccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtgtacccataggccaggtcccctgccacccctagattataacgaagcagggctggccttcaatccccatggcacagctgggtggcacagcagctcctctctcccgagccttctatgcaagcagctccagagtgccccagcctgtgcaggaggagctgctgggaaggagacagcagcagccttggcccaactcttgcctcctttccttcaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcaggtagggcagggcctgaggccacgtgtgggcgagggaccccacacaagtggaagcacgtgaggctcacgccgtccgtccacaggcctttccttcctggtgttgcgctgctgccgggtgcagccatggcaggcctttcctcacctggggcattttccctggtgtcacatggtccctgtgtcatagtccgtggtttggctgtcatggtttggccatgcctggtgtttgaacaccgggttcttcctctcgcagtgttctacaggacgccgcagctcgtctgcatgtgtgtgcagtgttctgttcatacatattaaggaaaacggtgaaacgtttgttgttggcctttgagcattgagggggatttccattctctgacaaaggacttgacttcagccagcctcctgccttccccttgccctgtcctcacagcctcttcctcatcccagttgcctttgaggcaaagtggtgcctcttccctggcctctgagcaagtcagtgtcttgggggcaggggtgagtgggtcttacgtctgccagggccgttgagaagtggtcagtggtcccagcctgtgtggtgacagtgcaggacagtgggagggacaggcagacagccagctgcagcactaactctcctcctcgtgtgtctccccagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaaggtaagtgaaggtggccagcctggctttcatggtctcccagccccccaggctgaaaggccaagacaacgatggcgggggtccgtccagagtccaccagtcaggctccttggcacccaatttaccagtggggagagctggggcgtcctggctgtacctgaagcagacagaggtctccaggagcctgtcctgccttatctggccctccccttggtggtagaggaagcctgtggtggtcaagccaagtacaggccgggggggctcctgctgagcagccgcctgcctgtcgcccccacagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccggtaagagcccagggggccgtgttcttccccgccttcccggcctacgcccgtgcagttccacactcagacgccagatgtcgctcttgtaccaggcatggggccgctcctggtcccttttccggaccataaaagggcagcctcggtgcctgctgcggcaggaggcaggagcctcaccgtcccccgcatctctggggcgcttttatttctgggactggttctcatcgcgtgtcacttcaccgcagcctgtataagacatggcgggggtctgagtgcccatttgtccaggccagggtgactgaggacgggttaaacctgaccgggggtctcaagggcctttctcctcatgctggtcagagaaccactgtcccctccctatttaacatgggctggagctggcccatcaagaatgaaaacttaggcccacaaggaaaggtgagggctggcttgcttctcagccctgctgcctggctctggcccctctcctcccctctgacaggggcttctctccctttctagaagatctcatcaatgactgagactgccccaagggctctgactactgaagtccccatcccggccaaaataacagtgaccatagccaacacagaaacttctgacatgcccttctctgctgttgacatcctgcagcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggtgagtgccggtgcaaccctggggaagccgggccgctcgggggagcaataggccgcggagacagcctgggaagaggagcccatttccctcgagggtggcatgagccagatgtgatggggaggacgagcacaggggaccccaggcaggccaagtagtagagactgccgtgtagaacaggctggctggggttagcgcctgggaaacaggcagggcccctcggccagggcttagcctacagtggagcacggtaggaggtggacggggtctctaggacaggctttgggggcctccgcccgggctgcccgcttctggccagccttcctagtaagtagtgtttctctcgaccctggagcaggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagtaagcgactgagggcgaattggtgctggggtggtgggggcacccagggaggtgagggcaggacgggaggctcggtctcacttgggagccaggtttcccgagtctttcccgctgacaccttctttcttcctaggcctggctccatccaacacatttgtggccccccagccggttgtggtggccagcccagccaagctgcaggctgcagctaccctgaccgaagtggccaatggcatcgagtccctgggtgtggtgagtcgggtgtgttggggctcctgagtccgtggcctggggggcagcactgcctctaggtgctgagggcctgatctcgtcgcaccgattctgtcttgcagaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgtaagtgtccccaggtgctgatgtcctcaggtgggtgggtcttggctccaccaccctgagcggggcttacaggaaactcctccatctttgggccaagctgagtagccaggaagcctgaggaaggtgggcagagaccatcccccctgaagcagtagaaaaggagagctttggttccttcccgccagtaccgggccacagtcagcctcgccacgtccctccttgccgtgaggggccagccaccgctgacctcttttccctctggcccatagttaccatggacctgcagtgttcctggggtggcccagagctgccttctccacagtggcgttcatgccactcctcttttcctaggatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaagtgagtcttgctgtggggtggccgtctgtccctggttggtttctgcctgcctcagcacatgaggtggccgggggggggcataggagagctaggttttgagtcccagtttgtcttagtccttccacttgggggaagatctctttgaagctccttgaactaccacatggaatatctctactgtgttagaaaatggcttatgggaaccatgattagtcagttctggaagcctctagcctgttctgttgaccttctgaccccctggcttctagagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgtgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcagggtgagtgtccttcgtggagctcttcaggcacagggaaggcccaggaagccgggtgcagcaggaggaactgtcaccatctgagattttttcccatgtgcggcgtctccctgcttcctttggcgcgcacacagccccccacgggggtggccatcaagtagagcaggggacccagctccgggcctgggggtgcaggggacgccaccccaggatgtttgaggggacaagcagtgagagggctggcgggaaagtgtaggtttccaggcccgaaaacagcacgtcccaggtccctggagtgcagcaggtgagggatggaggccagcctgcctcctgtcaggtcatgctcctgctccagctcccctggggctctgggacctgggagggcagtgagaggtgggagctgagctgagtgggtttctaacctacgtccagaggggagtgagtggtgtcgtgttctggtcccaaggagtggcgtaaaaggtgaccacccatagggcaggcgccccacccttgccagctgcgggtcatgccatgtggcaccaagagactctgcaggcgggcagggcgcatgtgttccttgctctcgttctgtcacaatgctgctcacgcatctctcccgttccttccagaaaccagtaaagacagctctggcaccaagccagccaacaagcggcccatgtcctctccagaaatgtaagcaggaagcccctctcgggaaccttctgagactaggggtggaaatagctgggttcagcctcttgtcaaatgactgggggcccctaaccggccctgcaccagcagggcctccagtggtgcagggcccacactaactttctctttcctttttctgccttccaaggaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccactaggtgtctcactgtgtcccggcatcctctcaggaagcctgagcgggaaggctgagacctgcccgaggctcacgggagccccctggagggagacctgagctctggtgaaagcgtagaaggccccagagtgaggcctctgctgtggcctccggtctttggaccaagtcggaccagggtccagcaggttgcttggtagctgccttgcagggcaagggccaaagagccccttgggcagctgctgctgacttcctgtgtctggggcccagatctccctccctcccctcctgcactagaggataggatggggcaagggcctggcaggtcaccagcggcagcctccttgggtgggttggggggaggtgggctgagtcaagtacaccacgggtactgcagaggtggatcccttcctctggcttcctcttaaatgtgagccatgcccccaagggaagaagcaagagcttgtgatccagactgaccacctagcagctgggtcggtaggacagctgggatcccgtgggctgaatttgtaccaggaggcccagaaagctccggggcaaggtggccggagcagcacaggcctaggcgggtctgaggggagtgacaccctgcttctggggcctggtgctcctggcgcacctgcattccccgccccctccaagcccctgccgcctgcctttgtttcccctacacacctctactgcccagccttcctctcagagcacccaggcactccgctaccagaagctcctggagtaaccaaagcctccgtgtctccacctgtggcatgggtgtgtgtgcaaggccctgtcgaatgcgacctcttctgggaagcctctgtcctgtggggtctgctgtgtcatgtgggggtggggggaagcagactggccagggcttgacaccaggagccatggctctgtcttacccaccgcaccaactgtgacctgccttggagcctagcctcgcagaggcccaaggagaggggtgggaaagtgtccttcagagcagagcggtaggagtcatggctggggctggtggaggccaggggccacatggggctggccccagaaccgaggggccttgcggatttgccatacctttggcaaatggcgttgtgggcgcttcgcctggtgggggtggtacaaggcttcttcctaccccacttctgtagctggcacctgtggggctacccaccctccgcattccttcagctcacttgtctcaccgcggctgcatcacactccacaaggcaagggccacatcagtcatgcctctggtgtttatctgaaaataccgcgtttccgtctgagggcaccactcagtctggggaggcaggagggaggctggacatgaatgtgaacatgacaggcctgtgagcagggcaggtagatacagcccggctgggcacaaagctcatcccctgagcatgagccgaggccgagggtgggtgggagcacacagaggatgcctccccagctgccaggggcatcagcctcattaccaagcaccccaaaggggaactgtttggggttgggtgggtcagcctgcagcagggactgagacagccactgtggcatcaaagaccagcagtgcagtaccacgcccagaggctggaaccattttgtgcactgttggcctggaaggtaggaaccacctcagcccagctgccttgtagcatcatcgggtcagtcatagagctacagacagatctgggcagctggaaaacaggcccagagaaggggggtgtgggctgttacctgcagttactgtctggccttagagctgtgtcacttgtgtaaagaagtcagtgccaaggccgagcgcggtggctcacacctgtaataccaacactttgggaggccgaggcaggtggatcacgaggtcaagaatttgagaccagcctggccaacatggtgaaaaaccgtctactaaaaaaaaaaaaaaaaaaaaaaaaaaaattagctaggcatggtggcaggcacctgtaatcccagctactc

SEQ ID NO: 16363 - DNA, 22875 bp, Human
cggccgcgccccggcaccggtggaagggaggtgtcccaggctcccacggcgcccacggcgccctccttccgccccggccaggcccatgggacccggcccgccctctgccgtccgtccccggcgggcccgatgcctgtcggccgctgagcctccgtccccatgcgggcaggtccgcgccttctgcgggctgcctggcttttggatgctttgaaggggaacaatggagcgaaggatagacggagcagcagggggcagttgcgttcagggccttaaatgccaaacaagtgccctaaaagccagggcccaacactcaggccctaaagtacgggctgaatggggcatcctaggaatagctctggagtgaaaaaaggagtgaagagagcgtttgaaggcaccggctgaggcctttcctgcctgcctgagccctgtggctggctctgctgggtggagggacctttggggaccagtcagggctcggatggaggggcaagatgtgttggggccagctagtgagaggcggggctccctggttccccttggcctgaggcagcggtgggacgtgtgagtctcccgaccaggagcaggttggagtgtgggtgcggctgtacgcgctgtgggcaggggcgcaggctctctagtctcgctggaggactcgaacatcggtacttccgagaccagctgctggaagtccaggtcctgggtctggctagctcccaggccttgaagccccaggtcctgcagacacacacgacgacgtgttcgagaagggccttggtactgggagaagggggcggggagctgagggagtgtttttttccttctgggcaagagaattaattgctcacagttgaaaggcaggaagtacccgcacagcctcccctccccagatctgcaggtcaaggtcatgtgtgcccgcatttgcacagagcctgactctgacatccgtgcacacacacgcctagtacccctgcactagtgcccccacgcccgccttcggaacacacgcctggtgcccaagtgccttgcctctctccccacatctataccccagggatttccctcccaccaaattgaagccagttgtctgcttggcttgtcaaccgcctcccgcctcccgccttcccgatttcccggagaaaagctgctgccctgtggtagagggtggaggaaagccccaccacccctggatgaggggggccccaagacttgcccccagggtagctaagacctcactccgagggggctgcccccctcaggcctatgacgggcaggtgcagctgcaggggaagggaggcagagcagtctcttccggcagcaggaagtggtaaccgcctatggggaaattgtggggctgagcagaaggggaaccggagctgaactctcctcccctaccaagggggcctggagggaacggcagccagctgctgaggttctgctctctggtgctgaccttccttccccctcccctctgaacttcccaccccagctctcaaggctccctggggctccctgggcctctctgggggctgacttgggaagggaggaccccatcggatgtctgggggaaggaggcaacccagggggagtccagagcctggggcagcaatggtgttcatggccactggtacagtgggccagcggccccgctgtgaatggtacagtctggcagtggtgaccagggacagccttctggaggtggtgggatggcagcctgggatgccagcttacgttggggctctcacacctgctccggctgcttggcagcggggctttgggcacaaggcagcctaggtgcaggcccaatgggaggggacggcaaggccggggcacagtggggctggaaggggcgccctgcccccccaggagcccctcgcgggcagtgccagccctgggccgccccgccccaccgggagccgcgctgggggcggggctgggcggagcccgcgcagggtgctggccgcagcgcccccaagtcccggcgccgggcccgctcacggccgcgtgggagcagtggggttcgacggcgcggccgcgaggccgccatggccgctcacgggaagctgcggcgggagcgggggctgcaggctgagtatgagacgcaagtcaaaggtgagagggcgccgggcgctcccggcccgtttcctgcggagaacccaaggtcgtgagggagctccaagcgtccccgcgctggcccagggcccgatgctctccccagcgacctctggagcgggggtggaggagggagcctgagccccttgcctgcctcccgacgcccatttggcctcaaccgcctgccattttcccttccttctttcctgtcttccttcctttggtctctgtcctccttgggtctaccgcttctcacccaaggttcagtggagacactggtggccgctggtaaaagagagccagatgcaccaacgtgcccctcagaaggcagtattttagctacagtgaagtcaaccagcttgattgggctggggggtgagtaagggagtccgggtgagtggattggtggagatcacctggccgtaaccccactgcagtccctggagcttcagcaccttttgcctccctttagcactgagggggagcagaggcgagggccactgtctctgggtcaagctggcgcagtgagtcttggttgagagatttaacagggctggcttctcagccttctgaaattgaacctctgggttctgataaacacccatgtgcaaatcacatgcaaatcagctttgcaaattcttagccaatagcttgtgcccatcttattcagggcatggtaactcttgcaaaggaaagaggcagcagctcagtgccagcagctcgtccatatcactctcaatcactccattttaccaattacggaaacaagctcagagaggtgcagtgacttgcccgtggtcatacagcactgcaacttctaggacgtagaatgcaatgacccttgaagtgcctttgaacccagagatgtaggttctaacatcattattcagtgcaagcaatttataccaaagtatgctccagtcctcctttggaaaaggcagcctgtgtccagagccagcttgaggtgactacacagggtgagccagctttccaagcctcgccatcatcttgctcagatggaggtaatgatctccatcctgcttccccaaaatgccatgaagctgaaagacttggaaaacttcagtcagcaaatatgggtcagtgatttcacactgaaaagttggggtttcgagcacgactgtctaagggttcctcacttgctctgggtctgcatcccacaccctggaaaagcttcctaccattctacaaagtggggtcactgtcttgacaccctaaattctcaaaggtcagcatagcggtggttttggagaccatcttttcttctgttttgcttgtcagcagaagtgagaccaaatgccttgctcacaggaagtgctggtggggcccggggcccagctctgtaattcaggcagacatggattccagctctccttttgccagatgtttcctatacatctgtgctgtcccaggccctgggagtatactgctgtaccagagagaaccccgactccagcccctccagccctggctttttacccagagtaaaagcaatgattcaatgaggactcccctgatttcaaatggcgtcagtggccaccccgccctcacatggctcacgggtctagtgggggagacatagactttgcattatgataataagcactacaaagggaaggaaagtgcacggtgccaagaaggggtcggaagagggccagccctagtttagggggaggtcaggacagggtgtgctgacgagtttgtctgaactgagatccgaaagctctgccaggaaagccaccaatgcaatcgacttgcaattcacaagttgcctgctcaacaccagccggtgtgcatgcccggatctggactaggacatggcttccagtcagcttttgctgccggcagtgatgaagaaaggcagcggttccctctgctggttccttctgcactgttcagttgtcataagtccccagggattgtattcctctgggggaagcagggcagggcaggctccagagggccagtgaggcgagcagttgtctaacacctttcttggaatgaaatgaaatttacttttatcaaaaaatgttaaactgggccaggcgtggtggctcacgtctgtaatcccagcactttgggaggccgaggcgggcggatcacctgaggtcaggagttcaagacccagtctggccaacatgatgaaaccctgtctctactaaaaatacaaaaattagctgggtgtggtggtgcgcccctgtagtcccagctactcgggaggctgaggcgggagaatcgcttgaacccgggaggcggaggttgcagtgagccgagatcgcaccactgtactccagcctgggcaacatcctccgtctcaaaacaaaaaatcaaaacaaaacgttaaactgattcagtgaggactctcctgatttcaaatggcattagcgcccaccccacctggccttggagctgacgagttaaccacaggaggccagcctcggataggatgaagacactctccatctgtctcacttggcatcgtgggctctgccctgctctgtcgggaggtcccgtgccccaggcttccacttacccagcttgatctgccggtgggaagagctctcctgttcagtaattcaattggaagggtcaggctcctgggtccctcacctggctagtctggtgggggcagggagtggagggacagagggatgggtgacgcatgcagccagggctggggcacctggagtcaagggggctgagactaggaaggggacattctccaataggagatcaggggaggaggtagggatgctgggcaggcggaacccacagggtccccatgcaacagcccctgggaagtcactggcgggacagaaatccaatgggattgagctcttctcagcggagtcctccctcgctgctgctggtctgaatcctgccgtcttttgcctggactagcacagtagctgccacctgggctccacctggcagtgtgagggggccctgaaaacgaagctggaccacatcaccccactactgtggctcctctctcactcggagtccagctgggagctctgcccagaccccgggctctgtgccatctgtccctaccggtctctcggactccccctactgcccacgtacagccagctccagccttctgctccaacgatgcggcttgttcttgaccaccctcctttaaaaagaggtcctccctgtccccacccacccctggctctgatcttgctttgtgggttcatcttctccgcacccatcactcctgggcattctgatatgtgttcgtgccccattccaatcccagctccaagagggcagacacttggtcaaacctctttgcctttgtatttaaaacgtgcctgccacagaatgggtgcataatcaacattctgctgaatgaagacatcaattcatgtccctccctggggatgtggatggagatgagtaggtgggcagcctgctggccagaagctgagctagcatcttatttactcgggacgggcactcaggagatggcaaaagtgtcttccgcaggttgcttaaacttgctggacaggcacttctttgcttcaggcctgtgtgggggaagcagcgttgccaaatcaagccagtgatagggtgtcaaaaggccggcagtatggggccctgggtgtgactctctctgcagggtgggggaatgcacaggtggggcggggggtgattgggagtgggaagtggggtcagaagacgggggctagctccctgccccattctttcacttacaaggccggatcagctctccctggctcccagccctcactgtggactgtcctttcccctggggcctgagggcaggcttccccagccactgagactgcgagatcgctgcaggcttgccctgagcagcactgtgatctgtgtgttgtgtatccgtgtgtttgcaagggaggctgccacctcccggagcctgggtaccggcgggaaaggaagtcgcaggggaaaccattcagaggctttccaggaacgagggagagacaggaagccaaactgaaaggtgcctggctggcgctggggcggctctcccctctctctgggacacccttccccttccccctcaaccgggtggctctggccatctgttggcctcagcgcagaggtcggctggacagctgaggccagatctgcctgcaggggcctagcttctttcctcccctcttagctcttgccctcagcctaggctgggtccgaaggagccctcagagccgacgggactggggtctgtgtgcctctgcctctcccatcccacgctggcctggctgacccaggcagggcgtgctgaccaggcctgagccatggttccccccacagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggtaggtgatgtgctggcaggggggccacggcagggcccaagctccgctcccaggtctcagtgcccctctacccccaggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaaggtgaggctctcatcctgggccacgggaagtgttcgaggctttgggatcaggaggcactgtggctgggagggcactggaggccaggtggggagcaggcagagcgaacctgtgtgcccccccgatggggcttgatctgggcagagcttccagtgcctggcggggccgctctgggcagtgccgtgctcacccttgcctctgcctctagagcagggatctggagcagcagctgcaggatgagctcctggaggtggtctcagagctccagacggtgaggaaagggctggggaggggcctgccccaatggtccagggagaaatgccactcacagtgggggaggaacaccgccagaccatcacatcaccccaagccaggctcagggagaagcacgcacctaggggcaaaggccctctctccctaggcacagggcgttaggctaagtgctcacatgggatcgcccagctctgaggtccaagttccagaggggcaggggtagagggctgggggctggcccagccgtggccttcaccagcaccaccttgctttgggtctccctgcaggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaaggtgggcctggagggcacctcagacgcaggcctatgggccatgggccctaactaggacctgctgtgctgagggggaagtcagggctgggtgcaggggagggcaggagtggcaggacagtgccatcaggttccagggattccatacggaaggctcccagggcctgagagagtggggaaaacagttgcctggccctggacagccccatgcagcctctccatgctcccagcggggcccctgcagctctgctgttctgccagccattccgtaaggtttcagaggggggcaagaagacacttagggtgggtgatggggtgacacgcacggagaaagggccttcgaggtgagcccagtacagagagtggggaggctgggaaatgcctggatggagccgccaggctgtgcgtggctgacagtcatggtctctgggactctgggagcagaggagggagtcgagcatctcaggtgttcttaggggaaatgacagagtttggctgtgttgggggaaggtctccctggctgctgtggttagcgtgccagctttagccaggtgcggtgactcacgcctgtaatcctagcattttgggaggctgaggtgggtggatcacgaagtcaggagttcaagatcagtgtggccaacatggtgaaaccccatctctactaaaaatacaaaaattagccgggcatgatggcgggtgcctgtcatcccagctacttgggaggctgaggcgggagaatcacttgaacacagcaggcggaggttgcagtgatctaagattgcaccactgtactccagcctgggcgacagagcgagactctgtctcaaaaaaaaaaaataaaaaaaaaatagagtgccagttttagaacccaggtgccagcaggttctgtttcatggctcttgatgatctatccctaccctttggggtactcgttccccctcagctctggcccccgcagaggcctgtggccgcttccagctgtgcacctgtgtgctggctccaagctgggtttctcgtgcaccctccatggtggggtgccatgtgcgcaccttccactcatcaggtatctgtgaatagttctgtgtcatcccccacttctgtggggaatgttgtggctcgaaccaaggcaagtggcgggtgaacagccggggaatcaagtcacctcctggcactgggctgagcacactgtggactgtggcgtggggaaggcagcaggacttctgggcttgaccagttcaggtgtagttgtccacagtgggaggggaggcgatgggcattacatgaaaggctagagataggggctggccacgtgcgtgaccctggcacgcttgcattgtcttgagtagcggcaggccaagttcatggagcacaaactcaagtgcacaaaggcgcgcaacgagtacctgcttagcctggctagtgtcaacgctgctgtcagtaactactacctgcatgacgtcttggacctcatggacgtgagtccttggtgggcaggtgggaaaaggtgcctggtgcctcggggctgggaagctgtggctccaggacctacccaagcatctccttgtttcctcctcagtgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtgagggtcaccccctgctgggcttggcattctctggccttcactgtaatggtgggcagtggagtggcatgacccacactttgctcaggaatccaagttctccatggtctcaggcagtgcggcagctagagaagtgtcccacttccatttgcagcctcactccaagggtgcacccccgcaatggccaaggagggcaagacactaactgttcaaaccgtgcagcaggcagccgtgtagctgcccatacattgttctaggctggtttctctgtgtttttaaatttcgtgacacaaacttggcagtaagatggaatggggcttctttatccttctccgtcgagctagtttttcctgcagcagtttatcctgatgggcattgtcaatgatctgggattacattgggcccctttcgggccgacttggaactttacgaagagtccggcatcaccagggcttccgatggcgtcacagctgctccctaacccacccctcccgttcccagctcccacccccagaaacagccacccacctcccggtgtcaagcagccattttccattggccaatgatgacccagtgccaccagcatctctcacagccaccacacgcttccctgcatcttgttctcccagtgggcttatcccagaatttttggctaaattaacattcaatgtttaaatcaccatgacaacaggtactgttggcagctgagccatgtactgtattaggatcacatgtccttccttggacaatttttccttttcttctggaatttataactctcttgcctcaggaatgctgcttgctagaacatgcccattgctaggagttgatcgctacctcgtcccagcactgtcctccacaccaggcacctgtgaggtcaaccttctcctctgcgccctcccccagagccttccagtctggagtgcttcacttctgcccagtgctctgtttccggattccacggcagcagctttcttagtttgatacccttattttggtgacaccttcaccaagggtttcctgactttgcacatctgaaaatgtctgtattctttgttttgttttgttgtgttttgtttttgaaacagggtctcactctgtcccctcggctggagtgcaggggtgtgatgtgatctcagctcactgcagatgcaaccttctggtcctcccatctcagcttcccaagtagctgggactacaggcctgcactacaacgccaggctaatttttctatattttgtagcaagggagtttcaccatgttgcccaggctggtctcaaactcctgggctcaagcaattggcctgcctcggcctcccaaagtgctgggattacaggtgtgccactgtgcccggccaaccctttattcttatttcatgaatacagtacttcttgaatctttctgaagcttttattttttttgagatggagtttcccccttgtcgcccaggctggagtgcagtggcacgatcttgacccactgcaaacttcgcctcctgggttcaagtgattctcctgcctcagcctcccgagtagctggaattacaggcacttgccaccacacctggctaattttttaattttttaaatttaatttattttatttatttattttttgagacagactctttctctgtcgcccaggctagagtgcagtggcgcaatgtcggctcactgcaacctctgcctcccaggttcaagcaattctcctgcctcagcctcctgagtagctgggactacaggtgcccgccaccacgcctggctgatttttgtattttaagtagagacagggtttcaccatattgtccaggctggtcttgaactcctgacctcaggtgatccgcctgcctcggcctcccaaagtgctgggattacaggtgtgggccaccgtgcccgacccttttatttttattttttagtagagacagggtttcaccatgttggccaggcttgtctcgaactcctgacttcaggtgatctgcttgcctcagcctcccaaagtgctgggattacaggcgtgagccaccatgcccggcctgaaatgttttttgttttctcctgttcctgcatttgctctattttcttgcttttgttcgtgagtccaaaatccctgctatatcctttccagagagcaaatagttagttttctgctgatcgtgtctgtttggtgattcttggccatcagttcatatttaagaagaggcctgaacacataccccacaaatgtgggtgtctgtggtgtttcctcctggcccggccagtttccccagtagaaactcttctgaccctgtctagggaggagagggggtgagagggctgggggctcactctgctgtgtggatttccttggaactacctggttttagttccacaccctccagccaaagcctagcaggaacagccctataatctccattgctggagggagccctgctccgtggggagcctggggcctctcagtgagagggtagtggaaaggccttagaggacttgggcttgccttaggggatctgggggagggcccaggtaagtggggcttggtcctggattggatgccttctggaagcagggtaattgtatgattggatgtcttgattaatcttatctagaaagagacagtgatggaggctgaagtgatgcaaggaagtgacagtcacttacattagccaggatggagggatgattttgtggctcggaagaagttcttgattttgtcctcactcatgcgtgatcgcagagtggtcttgtttctgtcttcgcccatcaaggtcacacagtggccttgcctgatgttgatgctctgggtcatttccggtgttcagcaggacagcactgaggccgggctgataggaccaggccagcttccgatggtggggctgctgtgttctctcatcttcctcatctgggaccagtgtccctgagtccaaaatccctgctatatcctttccagagagcaaattgttagttttctgctgatcgtgtgagtttagaggagggataaaatttcaatgttccccagagtatgcatacacttattttttctctagagagagggtctggctctgttgtccaggctggagtacagtggtgtgatcatagctcactgcagcctccaactcctgggctcaagccatcctcctgcctgagcctcctcctgagtagctgggactataggtgcatgccaccatgcgtggctaagatttgtactttaaaaacaattatttttaacctacttatttatttatttattttgagaccaggttatgagacagggtaatttttgtatttttggtagagtcagggttttaccatattgccaaggctggtctcaaactcctgggctcaagtgatccacccgcctcggcctcccaaagtgctgggattgcaggtgtgagccagtccagcctagatggacttttaaaaaaaggtgtggcagaatacacatagcataaaacataccacgttcaccatttgtaagtgtgcggcccaggggcagaagcacattcacggtgctgtgcagccatcaccaccatccagccgcagaacttgttcatcttcccaaactgaagctctggccccgttcaaccccaactccccaccccccagcccctggcacccacccttccactgtccgtctctacagagttcacggctctcctttgaggcccctcacaggagtggaatcctacagtgcgggcctttctgtgactggctcctttcactgagtcccatgtcctcaagggtcagccatgttggagcccatctcaaaatggccttactttctactctgtgacttgcgccttcatgcagtcctgtacggcggggcttggtggagatggagagcagggcaagtgtttagccacagctgaatcctcactctcaattttaactgtaatgtcaattttctagatgtctacatgcttaaaagagtaattccttcctttctaaagcgttggctcccactctgcccatgaggcaagctgctctcatcttgccacagggaaatttatgtctgcccagttacagtgagcagtttttccgtccactcctttccctggaagaggtggggctgggctctccctgttctgtctcagaccccagtcttccttaccattctatttcattttattttattttgagatggcgtctcgctctgtcgcccaggctggagtgcaatggctccatcttggctcactgcaacctccgcctcccgggttcaagcgattcccctgcctcagcctcccaagtagctgggactacaggcgcatgccaccgtgcccagttaattttttgtatttttagcggagacagggtttcaccgtgttggccaggctggtctccaactcctgagttcagataatccatccgcctcagcctcccaaagtgcttggattagaggcgtgagccactgcgccgggccaccattctgttttaaatagagttttattaaggtacgattcatataccataaaattcagcactgtaaagtgtacaatttggtggttgtgcagccatcaccatgtaattccagaacatttttgtcacccctaaaggagccactactccccgttctcctctccagccccactggcaccccactgctccagctggcacccactctgcttcctgtctctatggatttgcctggctggacacttcacataagtggattcattccttctcgtggctgaatcctcttccattctgtgggtagaccgcgctgagtttagccatccgtcagttggatgagtggtgccgccacgaacctctgtggacaagtcttggtttggacacgtgtgttcactcctgccattcttcagctgagcgtctgggctggtggtcctgtgcccggccgccaggccacaaaagggtgcttgcttcccttatgccccggggatcttggcacctactgcccaagcccagcccttagccccctggccgccgccctctgcaggtggctgagatctgcgttgaaatggagctgcgggacgagattctgcccagagcccagaacatccagagccgcctggaccgacagaccattgagacagaggaggtctgggcagcccaccgggggttagagggagacgagggcctggagcctgtacagcctgctgttggaagtggctgccctgcctgcccccctccctttggccccttccttctgacttggacttcctgtctccctccctgtcccccacctcttaccaccctggtgtggtctcctctgcaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacggtggggagggctgggctggtgggcgggacccgtgggggcattgctggggcagagggaggggctcaagccagggctaacacttggggctcttcttggggctgcccagaagctccaggagtatctgagtggacggagcatcctcgccaagctgcaggccaagcacgagaagctgcaggaggcccttcagcgaggtgggcccagtgctgcccccttccccgcctctcccctgcccaggaccctgtctagcccacggtcctcccctcccgcctgtccttggctcttatccacacctttctctctgggatgccttgaagacccctggcccgagaggcagaccaatgttctcccaccccacaggtgacaaggaggagcaggaggtgtcttggtgagtcctccctgagggctggggccctgcgacggtccgccatctcttctcttcctggggcccagctcagctgcccaatcccctgggcctcacttccccagttttcgcactggattgtggaataacttcagagaattagaggccggcttggctggcctggggggtggggcaccctattctccacacctggccccctcagagccagctcccattcactgcaggacccagtacacacagagaaaattccagaagagccgccagccccgccccagctcccagtataaccagagactctttgggggagacatggagaagtttatccaggtactagctttgccccacatgccagcccacctgtacatgctgatctttcttcagctctgggtcacctcagtggccggagcagctgcctgatcccagggtcctccactctcaatcagtcatcaactgtccttttctgggtgggcctcttccaggccactgttgggctcccctatagcctccgctgattgaagggagcatccttaactagtaatgggaacgtatagaaaacctggggcagcggcatttttaggggcgagatattgagagcttctcccctgcgacttctggccagcatggtactgggggtcctggacagtgaaataaggggaagcaagaaagatcagaaaactaatactgagatcagaaagcatcagagggggccaggcacggtggctcacacctgtaatcccagctctttgggaggctgaggtgggcagatcccttcagcccaggtgttcgagaccagcctgggcaacatggtgaaaccccgtctctactaaaaatacaaaaattagccaggcatggtggcacgtgcctgtaatcccagtgaaagaaagaaagagagagagagagagggaaggaaagaaggaaggaaggaaaagagagagaaagaaaagaaaagaagcaagcaagcatcagagagggccaggcatggagaataccagaagatcagaactgatatcgtcattttcagtgatgtggttatgcgtgtagcatattcaaaagaatcaacagattctttaaacgagcactttgagtttctttctttttttttttttttttatttgttgagactggttcttgcactgttgcccaggctggagtgcagtggcacgatctcagctccctgcaaccttcacctcccacctgctggggttcaagcgattctcatgcctcagcctcccaagtagctgtgtgcaccatcacacctggctaatttttatatttttagtagaggtgaggtttcaccgtgttggtcaggttggtctcgaacttctgacctcaggtgatcctcctcccttggcctcccaaagtgctgggattacaggcatgagccaccacacccagcttgagttttgaaatgttacttgattcaagattggtgtacagaattcaattgcatttgtatattccagcaacaatttgcaaatacaacgtaaggcactgcctaaaacctcatcaaaaatatcagacacctacgagtggatctaacaaacggtgtgctaagcctctgtgccgacaacgatgatgtgttcttcagagaaaataaaagcactcagcctggtgcggtggctcatgcctgtaatcccaccattggggagcttgaggcaggagtatcacttgagcccaggaagctgaggctacagtgagccgagatcacgccagtgcacttcagcctgggtgacagagtgagaccttgtctcaaaaaaaaaaaaaaaaaaaaaaagcaattgaatgacaacacagggcatgctgtgtccatggtgaagtaaacaccctctgtccccagagctcaggccagcctgtgcccctggtggtggagagctgcattcgcttcatcaacctcaatggtaagcaggacccagcccctcccgatgtcctggcacccagcacccagttcccagcacctggcatgggaggccatcctggaggggctggggaagatgctcagtgcccaccagctccttgtcctcccacaggcctgcagcatgaaggcatcttccgggtatcgggtgcccagctccgggtctcagagatccgtgatgccttcgagagaggtggggacgggcagggcgggcgggggtgggggctcgggcagatgtcaccagcttcctccccctaccgcaccactcgcccatctgcaggggaggacccactggtggagggctgcactgcccatgacctggactcggtggccggggtgctgaagctctacttccggagcctggagcccccactcttccccccagacctgttcggcgagctgctggcttcttcgggtgaggctggggcctgaggctggcggggtagggcacttgctggggcagccccgctcacgcggctctctctgggcggctttggccacagagctggaggccacagcggagagggtggagcacgtgagccgcctgctgtggcggctgcccgcgccggtgctggtggttctgcgctacctcttcaccttcctcaaccagtgagtgctgcggggcgagtgctggggtgggggccaggggtcgaggggacagggggactcggggtgcgggctctctgcttgtgatgtgcgtgtccccccagcctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctggggtacacccttggtgctgccgaggggactggggggtccactggagaagagcccccctcatctgcctcgctctgccctgaacctcagggacgcccagctggagagcctgggggcggacaatgagccggagctggaagccgagatgcccgcacaggaggatggtgagggcgatgggcagagagccccaccctgtccccaccctagtgtccacaccccctcccacagcttggaccccctctcctccccagacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggtgagtgagccgcgccctcaggccccagggctcccggagtctccccttcatccacccctcccccgaccccaagttagattctgaaggtctgggctgggccagagaacagagcctctctgaccactcctggctggcgcggaggctgctggccctggaccccgtgcagggaaggagcactcgaaacaggccggtccttcccaccgcaggacggagaagcaggtggtgggcgcagggctgcagactgcaggggagtctgggagcagtcccgagggcctcctggcatcggagctggtccaccggtgagcaagaagacggggctcagggggcccacacgtgtgctgttctaggccagaggggactggggtcaggctttggcccagtgggagtgggaggagttggcagatgaggacgtgacagaatgacccagcttgtgacagggagaggctctagaggagcttggggaccactgggccagcctcctttccttggccacaccccaggatgggaggagccactgcccagctagctcagggacttcccagggcccccaccaggctccctgtctgtcctgcaggccagagccatgcacctcacctgaggccatgggaccctctggacacagacgacgctgcttggtcccagcctccccagagcaacacgtggaggtggataaggtgagagtgggtgtgtggcaggtgagggacatctgtcctgggggatctctgcctccccttggaagccaaactcctccctcctcgaggttccagtcgttgccctccctggccttagctcaagggaacctgccgccagacacacaggcccaaggcagagcctgtggagggcaggaaggcaaagatgtgagggcgggtggggatggagagggacggctacggaggcagggatgagagggacagaagacacctggcttgcacgttgggattcatgttcagcttcagagcagggagtggcagggctgagttaaggctgtttacctggtagaggcaagggactccagggcagattcaaggctggcatttgtagctgggctaggtaacaggcggtgccattggcaggcgcttggcacgccagggaggatgaaagggacagatggcagggaggcaggagggggtggctggttggggattggggtggggcagcagcggctctcgaaggagcagagcgaaggctcaagatgtggccctggcaagcgcacaacctgggggaccctgctccgtgctctgtaccatgggccctgtgaacactgtcgggctgaacgtggaagcccgcgggacagttgctaagcccaaggaggagagagcccaagaacatgcgggtgtcccaggtgtggccaagcccccaggcccagggagcccagggagggtccggtagacacggaggagcaggagcgggagccagggacagggcagccaggagacgccatgggaggacattgactggggagtccccgcacgctggcggtccctgaggccatgggcagggggctgtgatctctgccagggaaagagtgggggcgagaagaggggggtccccacttccgggctaaaccaaggaattgctgtcctcagaggagactgtgacagagacaccaacagggacaggagggatgccaggtgcaaagtgggggagagtgacctggaggctgagggactggggatgttggctgagggcttgctttgggagtgggaggaactcaggtgggtcttgggcagggtcagtcgggggaactcactggtcactctccctttctttcccctccgctaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagccagctctctgtctcgggtgggcaggtgggtgctggaggtgagaacagcttccccaggggtcctgcagctttgaagacttggctgcctgcgccatggattccagagctgtgcacgtgactgtgggtgtgtgtggggagtctgtgtatgtctctgtgctgcctccacacccaccgttacccggatccaaggagaccccttgccatgtggaaaatgagctccaatttttattagggagagaatgaggagggagggattagaaaggcggagacaggaaggtcccctggccccagcctggtccttccttttcaggcccctgggaccgctgtctcacctgggggcacctgctccctctttcctgccactcctcaggcctctgctgcagcccctcctacacccagctcagtgagctgacctgaggggcccccacagtcctggggcctgaagctctcctcatacagctggggatgtggagacccaggcaggggctgtggcttgtccagggccacacagtgtcccagcctcggggccacaggctctggccaattctccacgggtccccctcccagtggctcccaggaccagccccaggaaggcagctgagcttctcaaagcctctagaggcaagacacccaacagctcctcacgatgaagtgtccttggccagggaggagctggcggtggtgcaggactcatcttggggacccaggctgggtggggtgcgtccccgggcacagcagagcaagcttcgcagctctgaggacacgctgctgctgaaagatgcatagatccaggggttggtgcagctgttgaggctggccagcaacatgagtagcacaaagggcgcccctgtggaggtggaggatctaggttgggttcaggatggctggtggggcacaggggcatgcggccaagcccaagtggccccgtcagccctagccacggctacacccaccttccagaggtgcctccgggtcccacgcggcccacagctgcaccaggaagaagggtgcccagcacagcacatagacgaccacaatcactagcgtcatcctcacagtcttggccacagctgctgacacgtgggctccctcaccggggctgcctgtccggcgtcccctgcggcgccccccaggcctctctgatggccctggcaccagactggcatgaatctcccggaagatgagcacctggcaggcggcgatacccagggtaggtgccacgaacaccatcagggcaatccaggtgacataggtgcgacggccccagggctccgcaaagcaggcccagcagtcagtgaccccgctgccaccttccacgttgcgctgggcgaagatgaagagctggggcaggctgagaaggagcgagaaggcccaagccactagcaccggccggttccagtgagccccacttccatggcggtacgccagcatgggacggcagatggcacggtggcggtccagcgtcatggccaggatcatgtaggaggaggcatacatgcccaccatctgcagatacttcacggcccgacacagggcatctggcccacggaagcggtcggtggccttccaggccagctggggcagcacttggaacagagccacggccaggtcggccaggcacaagtggccaatgaagacgtgtatgggtgcccagtggccccgccggccccgccgagctagggccgccagcaccaggccattgctcagggccacagccacaaagactatggagagcagcgccagctccgcccgggctagcagcgggtcccgggtgtccagtggcctctcctggctgctgttgctgggcaggctgggcagagagggatgcccaggcacagctgggcaggagtcgggaagagggcctggttagagagggtgctgtgcagggggactcaggcctgcctcccgtgcccccatccggacacccacttcctggctcctagcagaggggactccaggaaagccatgttatgagggatacacaccccaggctc

SEQ ID NO: 16364 - DNA, 9077 bp, Human
tggtcttaaactcctggcctcaagtgatcctcccgcctcggcctctcaaagtgctgggattataggcgtgagccactgtgcccagcccaggactagttttacttcctacaaagaagaatacaccaactcttatgggccaccatttaaagagacattttcatagtggacttcaatgtaattgagtccatgatccttttgagaaggggctgaactgacaagcctccctgagacaggtgccccatggaatgctagtggagagagaaggaaagagagtggaatgggcactgggcaggggcagagggaggaggagatgagtttgggaccaatggtgagccaggacaggagtcagatgagattgtgcatctactggaagacaggcctgtgaagccgggaatgggagctccaagggagtcacttcttaagagtttcatgacaggtcgtcgcctccatcagggttctttgtttcttttcttttcctttttttttttttttttttgagacggagtctggctctgttgcccaggctggagtgcagtggcgcgatcttggctcactgcaagctccgcctcccgggttcacgccattctcctgcctcagcctcccgagtagctgggactacaggtgcccgccaccactcccggctaattttttgtattttagtagagacgggatttcactgtgttagccaggatggtctcgatctcctgaccttgtgatccgcccgcctcggcctcccaaagtgctgggattacaggtgtgagcctttgcacccggccgggttctttgtttctttgaatcaacgtaaccacgactacaatcacaatagagaacttttttgtttgtttgtttgttcgtttgtttgtttgtttgagatggagtctcgctctgtcacccaggctggagcgcaatggcgtgatctcagctcactgcaacctccgcctcctgtgttcaagctattctcccgcctcagcctcccgagtatactgctgggattacaagtgcgtgccaccacgtccggctaattttgtatttttagtagagatgaggtttcaccatgttgtccaggctgatcttgaactcctgacctcaggtgatccgcccgcctcggcctccgaaagtgctgggattacaggcgcaagccacagctcccggcccgatagacaacgtttctacaccccagggcagagttctttcattccatctagcagtgtctcatccccttgcccagtcggttatatagttgtagcctgcctgctgcgcccacccctgctttcatctttgtggaggacgcagtgtcgcggttaagatcgctggttctggagccacgtcacctggggtcaacccaggctctgacccctggtagcgatgcagtggcatctgggcgggtcctgcaggcgctagctgtcactgtctctgttattccagtttcgcgatcccgagtacggggaatggtttggctacctgagccgagagggcaaggtggccctctccatcaagggaggtcctttcaaaggtgagtgggggagagggcggggccgcaggggttgcgcctctcggctgcccccggccctcactacctgcccgcctctacccgcaggctgcttccacgtgccgcggtgcctagccatgtgcgaggagatgctgggcgccctgctgagccgccccgcccccgccccctcccccgcccccacccccgcctgccgaggcgcggaataaaggctgagtccgctccacctgcggctgtgcgcgcgtctgtgggctcgcgggaggggggctgtcgcgccgagggaggggccggctccagctccggggcagcgcccgccccgcccccaggcccgccccgcgctgaccggctccgcgcattggcccgccccgtgcgctggcctgtcccgcgcattggccaagcggccgggaggacgggcccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggggaactttgtgtgtgagcgcgcgcacatttagagggtgtgtttctccaggtcctctggtggggatgtgagccttggccttttgacccagagcatcctgccaggcccgagtacaaggaaagagctttggaggtgggactccctagtctcatgaccttcagcagctgtggccccggggaaggaggccctggacttatgggagagaccctgccttggaggtctgcttggccacgctgaatgtgttttgtggcacaagccggggctgctcaggctcaaagctcaacagcagggctcccactcttggtggccttcagttctcttcccaccttcaccttcagactttctctccctaatcacacctgcttcgggctacagcagctccccagcatacccgtgggctccagatgtggacatccaactgctcattgggcttatctacaaatgtcctgtctgagtaatgacccagccagatgccccatcaacagtccttgagtcctccctcccctgccaccctaatggtcagtgagtccatgatacctcttgagtctactccctaacctgagtttgcatttgaaaataatttatttttagtacaattccccgcgtttccccattgacattttgtattagttggtgtatttgttattgttgatgcgccaatactgataagttattgtaaactacagcccatggtttacagtaggtttcctgtctgtgttgtacagtttctatggggttacacaaatgcataaagccatgtattccctcattaacaatttcatgcaaaatacaaaactgggcggctgttgggtgcggtggctcatgcctgtaatcacagcactttgggaggccaaggtgggcgggatcacttgagctcaggagttggagaccagcctgggcagcatggcgaaaccccatctttactaaaaatagaaaacttacccgggtgtggtggtgcatgcctgtaatcccagctactcgggaggctgaagcaggaggatcgcttgagcccgggaggtggaggttgctgtgggccctgatcatgccaccacactccagggacagagacccgtctcaaaaaaaaaaaatatatatatacatatatatatacatatacacatatatatcaaaatcctgtttttcatggagtcaccctaaccgtaacgctcgtttctgtgtctttcctcctttcccttccctcccctccggctgcaaagccatcatttactgtccctagtcctgggcgggccctgtattcctgagccctctctgtgtcctgctactgcaggtggcacactgctcctccgccgggttgaaaactcgccacacaggcctggagctcggttctctttggctggcgcctcgcacgtgaccagcaggcagccggcagctgtggaagcggagcccagagcgcggcagggcggggccggggccggaaaggcgcgtctgcgcacgcccacagctctccgcttcccggctcgggcgaggctgtgttgattggcttaagacgtgggcttccctttgtatgggccggaggcggagtcctgtcccgccccgcgcctggcggcagtgtcttccggttcgcaagcccgcggcgaggttcgttcccaggctctgattggtccggcggcactgggctcgcgcgcagggtgcgggggaagggcgggcttgcgcactgcgtcggccgcgccccggcaccggtggaagggaggtgtcccaggctcccacggcgcccacggcgccctccttccgccccggccaggcccatgggacccggcccgccctctgccgtccgtccccggcgggcccgatgcctgtcggccgctgagcctccgtccccatgcgggcaggtccgcgccttctgcgggctgcctggcttttggatgctttgaaggggaacaatggagcgaaggatagacggagcagcagggggcagttgcgttcagggccttaaatgccaaacaagtgccctaaaagccagggcccaacactcaggccctaa

SEQ ID NO: 16365 - DNA, 17731 bp, Human
gcccttatggaggctaagaagtcccacagtctactgtctgcatgcagtaaaagtcagtggagtgattcaggccaaactgaaagcccaagaaccaggggagccgatggtgtaaatctcagtttgagggctggagaagataagatgtcctagctcaaacaggctggcaggaagcaaaaaaagggtgaattcccccttccttcaccattttattctattcagggtctcaatagattgattgatgcacacctacattggagacggcattctactttccagagtccaccaattaaaatgctaatcctatctggaaacaccctcacagatacatcgagaaatagtgtttaatctgggcactcaggtgccagtcaagttgacacagaaaattaaccatcacagaggtacaatgcaaatagtggctcattaagtcatgacatccttagctaggctgacagtattctctaatagttctcagaagaactgtgataggcaacacttctcacatgtagcaactgccctggcagggcagaaattcacatttgatgtatagctctctggttttcctccttggttaggaaactctcatggaatctatcttaggagaaaaatcatagtttggaaaccactatgccaaagatcccctcatgtgctgggttctccaatactgcctgcttcaatttcagacttacaacttttacttccgtttttaaatttttttatttcaatttttgtaggtacatagtaggtgtatatatttatggggctcatgaaatgttttgatacaggcatgcaatgcgtaataatcacatcatagagaagggggtattcatcctgtcaagcatttatcctttacgttacaaacaatccagttatactattagttatttaaaatgtacaattaaattattattgactatagtcaccctgttatgctaccaatagtaggtcttattcattctttccaatattttgtacccattaaccctccgcatctccttcccaccactagccttcccagcccccagtaaccatcttttcattctctatctctatgaattcaattgttttgatttttagatcccacaaataagtgagaacatgcaatgtatgtctttctgtgcctggcttatttcacttaacataattatctccagttccatccattttgtcacaactgacaggatttcattcttttatatggctgaatagtactccattgtgtatatgtacatttgctgtgttcatttatctgttgatagacacttagcttgcttccaaatcttggttattgtaaacagtgctgcaacaaacatgggagtgcagatatctcttcaatatactggtcttctttcttttgggtatatagccagcagtgggattgctggatcatatggtagctctatgtttagttttttgaggaagctccaaactgttctccatagtgattgtactaatttacattcccaccaacagtgtacaaggcttcccttttctctacatccgtgccagcatttgttattgcctgtgttttgaataaagccatttttagctgagatgagaggatatctcattgtagctttgatttccatttatctgatgatcaatgatgttaagcaccttttcaagcactttttcatatgcctgcttcccatttggatgtcttcttttacttccatttttatatgttgtatgtgtttgcatgatcaaatctactttatcaggaaacataaaacataaagtgaaacggaaaaaaaaggaaagattataggaaacagtcatttgcctaatatatcttcactgcacggaaggcaaataatagatatgaaacccgaaggtttaggacaggagacaaaggaaagttattgccttattctccctaaccacatccttcaagtcttcttccttatttattacatcacatggacaaatacacttgaccacacctcctgacattgctcaatatttgcttgagtgaaaagaggctgaggcaacctgaaggaggagctctcattaccttctgcccatcacttaataaatagccagccaattcatcaacattctggtacactgttggagagatgagacagtcacaccagctgcccctagtggggctcttactgttttcttttattccaagccaactatgcgagatttgtggtgagtaaactttgagctaaaattactctagagtgatagtctactgaaaactgttgacaagagactctatgtagagttacctgagaaaagatcccattccagtttcgtatgtggttggactccatgaatgatgaaaagggtggcaggagatggtgaggaaagtctcacaatgcatgttgttgtaagaggaattatagattgtgtattcacttgcctaactgctctttctatgctcagatcctctctagcacagcatccctaccaagtaactccctattcatgtgacttttcaatgacagaaaatttatgctcccagaaacttttctagatcatggaaagttatcttttggtcttgatatgcaatcttttttccctgaaattcaatgcatgatttttgggttaaccccttgtaactacatagaaaaaaataataatctctttcaaatagtgatgactgctgtcttgtcatgagtgagtttagatgttccaagttgcatgtccaccttccttcaactctttcccaggacacatgggataaagttccatcatctcttgcatgggtgttgaccccagagattgtgtggttctgtaaaagaactttaaagtaagagaagggaaaactaaattcaggtttagtttgatcccttagttattgaatgacccaacatttctgaatttctttagcttcattcataaataaaggataatgaggggagactattgaagcaaattatctcatgaagtctggtgcagttctcaagtgcatgaattctcttttgtgagactttactctgaaattgagcttcaaaccagtccaaagattactaggtggtactatctgtgctctctaaccagtaagaagagaacaccacagaagacaggcttgtatacatacaggctaaagcatagactcttctgactctgatttttcttcttggcttgacatttcccctgttggatcctaagaatagggaatggctatgtaggttttagctttcaattcattttaaataataatgataataattaaatttatctttgagactcaaggaagctgatttgagttgttgatcaggaactaaaaagtctgtttcagggccagaaaatctgctgagctggatggttccacaaaatctcagagaactgactcacaattgttccattgtgtctgcaacaaaccatgacctttctacaatcactctattcagatcttcttgactcattcttttaaagtaaagaaaactgggcaagagaaattacatttccttgattctcaagtatagtgataaaaactccagttgagctggaaataatagtatgtgcagcattttacagtttattcggtggtttcttgtccaatatctgtaaggtaagtgttaacagccacaatttttaaatgagaaaactaagagtaaaacaagttacataagttattatccacagtcataagttaaggagcacaaaatgtggccaaaatctgaatccaaacctcatgttcttctcactctcccactaatccattagataatctggagatatgtaggatttggggctactcctcaagattatggaaaaatacattgacaaagtgtcctgtgtttaaataaatagtaaatctttttattctcctctatttccttgggagctatggattttcctacttccacagtataatgtgacttccctccatctctggaattggggcatattgtaggctaaaactggagagttttttacaggctgcataatgctaaataatgatctcgatgcccagccagctgggtaatcagacaatgaagttttggggtcaatcaccagtataacacagaattattacctgcattttctcaacattaacccagttgatttagaagatggagaaggaaagaactgaatccaggaagtagaaagtcctgcttactgagagtcagaagacatgtagtctagtttcagctcagcctccaattatggaagtttctttaaggacaatctatctaagcttcatatacaaaattagggaatgatgctagatttcccaggcaggagtctgccagtacacaatgataagtctgcaccagttgttaaaatattaaaacattttcatgttggttgttaaaggagtaatgtctggcatgggggtgggttcaagacccacctttgtattattccaccaacacagtctgcagccactggattggtctaggtctgtgccatatctgttactaaatatttttatataacccctgctgcaagtcttactattttctgagtatgtgtttcttatttccttccttctctgccacagaggtaagtgaagaaaactacatccgcctaaaacctctgttgaatacaatgatccagtcaaactataacaggggaaccagcgctgtcaatgttgtgttgtccctcaaacttgttggaatccagatccaaaccctgatgcaaaagatgatccaacaaatcaaatacaatgtgaaaagcagatgtaagttgctgtatattctggaagatttagaaaaaaatctacctatttaaagattatctgcaactaatcctaaaaaattatgcatccaaagtatccctgctacatcccttctaatggtaccaaacttgaggtaacagaaacatgcccaaaatacaatcccatgccattcaccctagagctaggtcttgcttcttttggtcttaaaaaccacttttcttcaagaagccacaaacaaaagctatggatttttatccattaatgctgttatataagctagcttagttcacaaccacatgggaatacagatcataactaagaaagctggtgatggaaaggcaaccatggaacaacccagatttgaactaggtatgggtgggccttgaaccagtcatgttaatactgagcctcagttttctaattagtataaggggaaaagaagccactcttacctacctcataatattattataagaattatgagaatcctgagagtttggatactctaaaaggcagaacattaaaaatcaagaattactatcctagcaagctggtaccacaaagaaaaaaaaacccaagatcttgttgtttatctatttttcctctttttcactttcataaggattgtatgattccaaaacgattctgtgatttttatggaaaagacaaagatttagtttgcatttatacagtactgctctaaaaggctctgctttgaggataaagaagagaggaatcaaatattcatacaggaatgcatcacataatgatgaatatatatgacggtggtcccacaagattttaatagtgtatttttattgtaccttttctgtgcttggatatgtttagatacacaaatactattgggctacaattgcctatagtattcaggacagtaacatgctatactggtttttagcctgagagcaacaagctgtaccctatagcctaggtgtgtagtcaactataccatctaggttgtgtaagtacactctgtgatgtttgcacaatgacaaaatcgcttaacaaccagtttctcagaatttatccctatcattaagcgacacaagactgtatagagcgcaacagaagaaaaaagtgataggcaatataagtctcaaggaaatcaggaggcccaaaaaatcacaagcctgtaccttattaagcttgaatacttttcttttcagtgtcagatgtaagctcgggagagcttgccttgattatactggctttgggagtatgtcgtaacgctgaggaaaacttaatatatgattaccacctgatcgacaagctagaaaataaattccaagcagaaattgaaaatatgggtaagaattaaatatttagagaccctagactaccttgtcttctcctccactgattcaaaactatatgaagtttccctccactctttccttctcttcatcccgttcatctcactatgtctttgagggcacttccctttttctctttcagtatgcatcttgaattttctttttaaatatgttcagctgagcattgaccctatgtcaagtactactttacatatgatggcagaaacacacacacacatacacacacacacacacatgcacacacacaagtcaccattctctaatcgtccaggagcttggctttaagtcaaatgatgaattacaccagaaatagctgaacaatacaggatacagtgtcataagtaccaaaatatacaatgctagtatatgagctaaaggtggccagagtacattatcactgggaaaaatcaaccggccatggtggccactagtgaggtgcactgtttttatttcagttcccacccaatatttattctatttttcagtaagtccattttcctttgagatggcctctaacctaggtttctacttacagtttcaacaccttactattgaaaacgcaagaggcttggaggttgaaaacctgtattctggccctaactctgtaaccatctgaatatctagatagcatcttaatctctttaagactgtgtcccctcagttataaaatgaaagaaattgagcggaatttagtggcccttaaaagccctcacatttctcaggttttctgattctatgggtgacctcccccttctattagccacctttccttaaatgtaaagaaattaaaatagagtaagtaggaatagatggaaaatgcatacgccattaccacttccatgattaagggaggtatttcttctcttttctagaagcacacaatggcactcccctgactaactactaccagctcagcctggacgttttggccttgtgtctgttcaatgggaactactcaaccgccgaagttgtcaaccacttcactcctgaaaataaaaactattattttggtagccagttctcagtaggtgagttactaagcccaattcccttggtacagaggacatggtcaccagtaggtcttgctctttgagtttttctaccagtaagtacctggattttattttctaccctctttgctctagtcccctcaaaagggaattttctttttgagaagaatggatgatggatggcatttaagcttctttctagatgtgtggtatagtagaaatacccggtttctgctccagctcttctttgggttatataaacaatgaatgttaactcttgatcttaatttttccatttgtaagatgaggataaggcatgagaatatccacatgaaatattttagaaagggtaagttttagaaaagggaaatgcaatggaattcgtttatcttaacactgtctctttctctagtttattgggacaatttggatacctcgagagtcttgaacaataccacctctccagtgacaaagtccaatattttaatcaatagattgtatattcaccttgggaaatgaaccagaaatttcccactgtgtcagccttaatatccataaagaagtctttagacagttagtataggtgcttagcctctatggatccagatatacaagttcatctttctccaaattcaaagttcaaattgaagttcaaagcaaatcaccatgtagtatttctggatagtaaggagaatgtgagatttctcagacttcttttcccatgagagaggaaaggtcccatgctaaagaacacaggagacaccaagtatcaagccagaaaacgtgtccttatctttccttcttccagtctcttgcctcatcctcttttgtaaagaggtttactgggcaacaactctgtaaagtactattttctaatcagtctaatgaaacccttgagagccttacaaagacagtttatttgattcagcctcttaggttttctcaatccctcagccaacatggctaaaagattagagaaagatggaaaagatgagagcaaccaagatgtaaaagtgaaatactgtccatgtgtatgcacctacaaatccataggtgttttatgaccaaaatatgtgtaaaaaaagaaacccagaattgtatttaaaaaaaaaaaaaggcagggtgcagtggctcacacctgttatcccagcactttgggaggccgaggcgggtggatcacctgaggtcgggagttcaagaccagcctcgccaacatggtgaaaccccgtctctactaaaaatacaaaattagctgggcgtggtggctcactcctgtaatcccagctactcaggaggctgaggcaggagaatcactagaacccaggaggcagagttcgcagggagatcggaccacagcactccagcctgggcagcaagagcgagactccgtctcaaaaaaaaccaaaaaacaaaaaacaaacaaacaaaaaacactccagacagcagcaagagagctttagagattcgtgctacatcccaccctaaactgcttttaagctaatttcctggctttttacctgctatgtgtgtgtgatgggtctcttttccttggcaagttcttagatgctttccaggatgtttggattctcaaagacacctgttcctcagctgggctccatggcctgggcttcagacagttcaggcagcagacatatctttgcagggcacttccctttttctctttcagcatgcatcttgaattttctttttaaatatgttcagctgagcattgaccctatgttaagtacttctttacatatgattgcagacacacatacacacacatacaagacaccactctctaaacctccaggagcttggctttaagtcaagatgaactatagcagaaatagctgaacaacacaggacacagtgtcataagtaccaaaatatacaatgctagtatatgagctaaaggtggccagagtacattatcactgggaaaaataaactggccatggtggccactagtgaggtgcatctcccttaagtaaccttaagtgggagacccatcgcactacagtatgaggtatgaactatggagtacatggcaactgaacattgggaagaaatctttaaatatttgagtggttagtgctggagagatgattgctgtatcttgaaatctttcttcaccaattagcatgaccaaccatcccagtttttctagatctgtttttcttttagcactgaaagtctcacatcccaggaaacctctcggcccaggacaaactgaggtggttggtcgcctatcaacaatgttttgtttcctgacagatactggtgcaatggctgtcctggctctgacctgtgtgaagaagagtctaataaatgggcagatcaaagcagatgaaggcagtttaaagaacatcagtatttatacaaagtcactggtagaaaagattctgtctgagaaaaaagaaaatggtctcattggaaacacatttagcacaggagaagccatgcaggtaagtcagagggtgaaacaggaggcagagaagggagtcttctctggaagaaagcagtatttttttttttttaagatggagcttcgctcttgttgcccaggctggagttgcaatggtgcgagctcagctcactgcgacctccgcctcccgagttcaagcgattctcctgcctcagcctcctgagtagctgggattacacctgcctcagcctcctgagtagctgggattacaggcatccaccaccacgcccggctaattttttctatttttagtagagacagagtttcaccatgttggccaggccggtctcgaactcctgacctcaggtgatccactcaccttggcctcccaaagtgctgggattacaggtgtgggccactgcgcccagccagtatctttttcctttcttattggcctcctaagaccttattatacattctgcggttcctatactaactttgattttgctcatacgattcccttcccctccctgacatgtactcttctcatcttcagctttacttccccatagccaatgcttctaggaagcttttcctaactacaatttctctaagaaactctagagtctactacaatctgctttcttgttctatcacacgtagtttacactttcacacacacagtagtccccccattatccacaatttcactttccacagtttcagtcacccaaggtcaactgaggcttgaaaatattaaatggaaaatttcagaaataacgcataagttttaaattgtgcataattctgagtagtgtgataaaatcttgcaccttcccgctctgttccacccaggaagtgactcatccctttgtctatgcttgttaatcacttagtagccggttatcagatcaactgtcccaacattgaagtgcatgtgttcaagtaacccgtatttacttaataatggccccaaagcacaagagcaatggtgctgtaatatattattataattgttctatttgattattgctgttgttaatctcctactgtgcctaatttataaactgaactttattataggagtggatgtatagggaaaaaacatagtatatttaaggctcagtactatccatggtttcaggcatccactgtaggtcttggaatgtatcccccgctgataagagcaaactaccccatcacctccatttcctaaactaggagcatgagtcacagtaactgtgtcagtaatctaactaatctcacaaaaccagaaagtggtgtagattgggatgggacctgggctgttgttctcaaaactcacactcagcacctacactgtcgtgcatatgctctttgaggtctgagactttattcctgcattcattcagccattgatttacaaactctaaggggatgatataagaagcgatcaaggaaggtttacagaaaaaaaaaaaactttactgcatcatcagtatgaatagatattttccaggctgactcagggctagaggactttcaagggagagacgacagtgaggacaaagacccaaaagcacaaaagaatgttaggcattttaaggtcaaggtgttcggcatgaccagcacagagtccttgggaaacataacaggaggctggaggtgtaagcacgggtccagtcataaggttatctgtattgttgttgttactatttatgttgttgattgccttactaagtttgaactgaatataaactgctttcccattttcattgcatatttgaatcacctgaaggagctcttagaaaacactaatacccaggcccacaccagccaggtagtacagaaatttagaggtggagcctgggccttgctctggtttaaaagccctacaggtgatacaaattcacagtaggatcaagagctaattgcctacaacacattgttgggtatttttaaatattaataacatttaatttattgttatgtatgtgaataacatttattgacgtgtcttaagaggaaatgtactatgaccagtttttcttttttcttaatatcccacaaatgcttgtggacaacttggttagcttaagaacctccaagaaaagatgaaaacaggaactgtccatccctgggaaactacagagcagcatgttcaagtccgacccaccttagttcctgtcttgcttaccccaatgccctcctaacttttactacctcacaattctgccccttcaatcaagcttacattctgctgccaggagagtttctgtttaatgaacaattagactccccattgtcaatcaaataatgtcagacacctcctcatcgttgtcaatcaaatgaggtcagacatctcatcataaaattcaagcatctactagtctagcccaacttccttctccagcctgtttttccacagttgcctccaatgttccccatacatcagttctcctaaaccaggaggaatcccctgaggaactttgctaaaatgcagatactgtcatcattgccaggtcatgtcctggccattcctacctaacacctttgttcatgttgttcctcttgagtgctctatcctactctccaaggcctaactcaaataccaccttctccaggaagcttttttttttttagcttcattaaatgtttgtgagctcctctcctcttttgaaagaggcatcccactagatgcatcccttagggcattcctctggcaactccttttacagtagtttgttaatatttattgagtgtctcctatatgacaggtatttcccagcactgggatacagaaatgaatgtggcaaagtctgccttcattggaactattatagcttgtgttattaagcagttccaacctccctgcccaaactagtttataagcttctggataacaagaaagataactgagttatctgaggtgcttcctaggtagtcaatgttcaattaatactgaattagttacatatatagttatagataaggcttcccccttatttgaagtgtctcatattctctctctgtctctctttatctctcatcacccccccaccccaccctgcctcattaggccctctttgtatcatcagactattataatgaaaatgactggaattgccaacaaactctgaatacagtgctcacggaaatttctcaaggagcattcagcaatccaaacgctgcagcccaggtcttacctgccctgatgggaaagaccttcttggatattaacaaagactcttcttgcgtctctgcttcaggtataagcattaaagagagcacactgtttcgcttttcaccatagcacccaaagcatgtgagattcaggtgtcctttgaaaccaaaagtgaccagataaacctccaaaacataacagttgccagagagaattcagttttcctcatgttaccagggtttacagtcacctgaggatttgttcttaactgagtgctagatgtccctcttagttcaaacattaacaaggcagacctgattaaataatgtctatctccaaaggtgtattttctgactgttggatatagaaggatctgagcatcattctcatcctaaataaagtatggagtattggtaccgtgactctgactttgcacagtgagtgatcccttagggaaatgagacatctgtgtggaagtgatatgccagtattcaaaaattgtagcatgcattacttattcaaaaaatgaccttgcaaccaggtagaaggaaaggagacattgtcttatatctctgtccattcctggttcagccactcacaggtttaggaaacttggacaaaatgtttaacctctaagcttcagttttctaatgtaaaagttgggaacaaggacagtacctaacataggtttttgtaaagattgaatgagacaatccatgtaaaatgattagtatagtgcctggcaattcatatgttttcaataaacgttaagcaataaaaaggagaaaagacaagcattattgtatgctgtaccaaggcaaaaaaagaaaaaaaaaatcaggatcctctgtgagaaacagaagttagagcaactgaattgcttaaacagctgggagttgagccaagtgccaacattcacaagctggtgagtttgggtcttagtttctgctttagttatatgagaaatttgccccttgagtgatgataattgctccttatagtaaatccgtgtctgcataaaggcaaggagtccttggataggggttgagtaggtctgcaaactctaatatcatttttatttttctgaatattgctctgggcttttctgtctctgccaggtaacttcaacatctccgctgatgagcctataactgtgacacctcctgactcacaatcatatatctccgtcaattactctgtgagaatcaatgaaacatatttcaccaatgtcactgtgctaaatggttctgtcttcctcagtgtgatggagaaagcccagaaaatgaatgatactatatttgggtaggtctgtacctaacctaaggttaagatgtttgctgtcatttctaaagatgcagtaagaatgcatttgcacctaaatacaaagtatatttaaaatgcttctgggtcagtagctttgctgtccatctacatctcacagcaggagtttaaaataggaggtgaggtatttcatcttcttgcacataataggtagtaaattaatgttcgctaaataaattaatgaatctcagggctctctcttatttcagtaaaattcttgcaataaatgtaacttctaaagtcaaacatttgagatctagaacagtggttcttaactctttttgaatcacggacccctttgaaaatcaagtgaatgtaatgaatgttcatccaggaaaaaaatgaacatacacacaaaaattggcatttgtttatttatttattttacagacagcatcttactatgttgcacaggctggtcttgaattcctgggctcaagagatctgcccacctcagcctcccaaagtgctgggattacaggcatgagccactgccaaatttagcatttcaactgagggtttcacagataccctgaagcttctccctgccctcgctttcagaaaactcatagatccccaaactaaagtaactggtcaaggaggtcaagtattaaaattaaaataatggctttgcctctgaaaagtatgacttatttggctccttaactctagttgacagttatttatcatatctaacaacacagtgtaggatgctataaagaaaatcagaataataatataatatacattataaaggctaccctcaagggctttaagggaggtagaaaaatgactacggaatataaaacagatactgacctgtcactttttaataaacacaatatgaaatatcaaattatcctttcctgttcctcttttctaagggaaaactcagtaacttatggtgtctctagcacatgaggatcatatgttcttctactgaatcagtatctttagcagttactatcttggggtggaaggttgaagctgttatctgaaacctatctaccatggcaggtggggagagcagaaaccatgagcatcatttctctaatttagcatggagtgtggagtgcctgcattagaatcagctggagtgtttataaagcatgcagattcctgatccccagctcatatctaaaaataaaaatatctatggatagggccaggaaatctgcatttttataatgtcatcaagtgattctcaggtacattaaagtttgagaaatgcctattgttggtttcctttgacaattctaagttccagtaacctacttgctgtcacccacagtttcacaatggaggagcgctcatgggggccctatatcacctgtattcagggcctatgtgccaacaataatgacagaacctactgggaacttctgagtggaggcgaaccactgagccaaggtaagggagagacatgccaaaaagacccatgctaaaaatgcccaaatggagaggggtgtgagcctctgtggggattgggccaaggggttagtagagatgacatccattatttggtgatttagtggccaaatcatttgacccagttctctttcttcttccttttcaggagctggtagttacgttgtccgcaatggagaaaacttggaggttcgctggagcaaatactaataagcccaaactttcctcagctgcataaaatccatttgcagtggagttccatgtttattgtccttatgccttcttcttcatttatcccagtacgagcaggagagttaataacctccccttctctctctacatgttcaataaaagttgttgaaagattaacaactatacaaaaagagcatgttctaattagttcattctgaaaggattttaaaatgtattagaggaaagtccacctaaggaaaaactgaagtgaaaagaaatgagaccacatgtctaataagcggggttctactcaaggttctcctactaactatctcagtggcattgggcaactgggtaaaatggggataaggttctaggtctaatgttgcagcaacaaccaatgagatcaagcagaaagtctgtgaaagactgagctctctgaggcccagatgcaagagaggagcccattggtcacactgatttcatacaggtagtgggtaaaaaaaacatgttgctcagaagaaagggggaaacgtgaggcatatacataaaaggtctgcccgtagtttgagaaacaatctcatcccctgcctccagatgtctcccttgggtcccacttattcttctcttacatttattttccctttatttccccataaaatcaccccaatattcatgtcatcaaaatacatatgcaaaaaagtcacttatcatgttcatttccacagaattcacttttttccttttttatttttctaatcaatttttgtcatgctaagaagtcacgtcttaaaggaaaaaagttgaatcacatcaaggcagcatgagcttgtacttatactgagtacctgggctacatgcagtacagtcagaaactagaaggacacttaagataccaaaggacaaaaggtactttatgtaaagtgtaaagtaacccatttaaagtaatttcctgcaaataaaaaccacaatgagacaccatgccacaccagtcacaatggctactattaaaaagtcagaaaataacagatgctagtgaggttatggagaaaaagaaacacatacactgttggtaggagtgtaaattagttcaaccactggggaaagcagtgtggagattgctcaaagagctaaaaacagaactaccattcaacccagcaatctcattactgggtatatacccaaaggactataaatcattctacatctaaatctaatataaaccgcgtgtatgtgtattgcagcactattcacaatagcaaaaatatggaatcaacctaaatgtccatcaatgatagacttttaaagaaaacacagtacatatacactatggaatactatgcagccataaaaaatgagatcatatcctttgcaggaacatggatggagccagaggccattatccttagcaaactaacacaggaaactgcatattctcacttataagtgggaactaaatgatgagaacacatggacacatagaggggaacaacacacactggggcctatgagagggtggagggtggcgaggagggcgaagatcaggaaaaataacgaatggatactaggcttaatgcctgggtgatgaaataatctgtaaaacaaacccccatgtcatgggtttacctacacaacaaacctgcacatgtatacctgaacttaaagtttaaaataaagtaatttttaaaagaaaaatgccttcaggtagaattagttgaattattatttattttattattttttttagacagagtttcgctcttgttgcccaggctggagtgcaatggtgtgatctcggctcatcgcaacctccgcctcctgggttcaagtgattctcctgccttggcctcctgagtagctgggattacaggcatgcaccaccatgcccagctaattttgtatttttagtagaggtggggtttctccatgttggccaggctggtctcgaactcttaacctcaggtgatccacccaccttggcctcctaaagcactgggattacaggcgtgagccaccacgcccagccaggtgaattattttaacaatgtcttcctcatttctcctgtgttttcttcacaatcatcctagcttcctctccttcaccagtgacactgcttcacagtcagagattgaaccctcttccaacatactgctttctgctattgatactcgatgctc

SEQ ID NO: 16366 - DNA, 108310 bp, Human
  misc_feature (1)...(108310): n = A,T,C or G
ctggggctggaccctggaaaaatcttcaggaattacctccttaggatgagaccatccctgctctgcaccttccccacctcctaacccccagctcctcccagctccatcgaaaagctttggcctcatcttgggacacttaaccaggcctattatatgcaaggtatcccaggcagctgctgccctccctccacccatccccattttcctctatccctctgccctaagattcacagataccaggaatccagagttattcagcagcccaccagggagcctctctagcatgcaaatttactgagcgtgctttgaaattcagcacaaaagtgaatgagattcaaaggagttcatagtctggggaggggagttggcagagcagacgtgtaagcaaatgatgacatcagtacaacaagaagggctgggtgggggagacttctaattgtgcgggggcccaggagcagctgctattctgctgtctttccaggagtttggcaaatccaggagagaggaccaagtggaaagggctggaggaaagaaaaaacccagtgcatcaagttccctggaactaggccagagcttggggtgaagagcaaaaagaggcacactgggagaagtggctaaagagtgggttgggttggattctggatggctttgttactcttctaagaagtctagactcttcaataaagcatatatatatgcatatataaatgatatatgaatatatgtgtatatgtgtgtgactatgtagaaacacacgtacacatatacactggtatcaggtaaaatgctgtttttagatgctggagaactaacacatacaagagaaaaaaaacaggtcatgataaagtcatcctatttactcgaactgctcatgtataagtattatgcagtacaaagaatattatgctcatttttctatgtgccaggttgtcttttctttttttaatttttttgacacgcagtctcgctttgtcacacaggctggagtgcagtggtgccatctcagctcactgcaacctctccctcccgggttcaagcgattctcttgcctcagcttcccgagcagctggtattacagacacctgccaccacgcctggataatttttgtatttttagtagagacgaggtttcaccatgtcgtccaggctggtctcgaactcctgacctcaggtgatccgcctgcgttggcctcccaaagtgctaggattacaggcgtgagccaccgcgcccggcccagattgtttgttttatttgattacacaatgaattctcttcttgaagtttgcctttcttctctttttcctgtccctttctttttactgtatcaatagttgtctgacccaaacctcaacaagtagaaggaattttggactgaaatgtttccgttcactaagtctcaattgcgttcttggaaaggtgctggcacagctgagggacaccccagctgttagttgagtttgtgaattgcagatcctgccccagagtcagtgaaatttctttttcccttatactatctcaactttacgcagccaaccctgtgtacccaataatagctcaatttagtggcatccgctaaagtcttgtatagagaagttttccctctggatttcccctttactgaagaaaaatggggagacccagacaagggtcccgggactacgcttcccagccgcctccgcccggcgcccagtccaacttcccttacagggatggcccctggcatcttggccccgcccatccccagcaccatattgcgaactacaattcccagctgcctccatgcgtcggacccttcaaaatgggcttcccagcagcctctcgggcgaagagccccgcccttcggagctgctccccaggtcgacccggcgcactcttcctgccccctgccccgtcacgtgatgcagtcccgccaaccggcacggggaggcgggcagcgggcggtggccgggggcgggcaggccgtggggggcggaccccagagggggcggagcagggcccggcagccgagcagcctggcaacggcggtggcgcccggagcccgaggtgggtgcgcgctcacggctggcctggctcggagccgggcactgcggggacccgtggtgaggggatcgggaggaggaagttgggactccttgggccagcgggtcgcgcggggccttgccgcaccgtcagggttgggtgggggtttcgtccaagcgccgtcgctgtccccgcggggcagggctgaggccagggagcagcaggcaggtacctccggcttcctcccgttctccccgcccaaggtggccggccggcggcgggcgaaggtcgggacgggggtaggggttggctggccgtggagctgggggcggacgtctcagccactgcctggactttgcttccccgtcccggggcggtgagtgggccgggcgtccgccctgcctccccggcgacgctccgcggctggtcctcgccttggccctccgcacggagcgggcgtccgtcgcatccccggtgggccctgcggagcggccgcagcccggcactggccgcgaagcctcgatggccgctctcggccagtgtttctgtgtcatacacgagaggtttatctgcttttgcaacagttgagggaagatcttagagggaacggttagttccctgatacgcagtcggaagtatgtacaggcacgagcaagcgcccgtggccgggttgcctcccttaactgtcttttgctgcgctcaggaagtgaaaactaattttagtatttgcctaagcaagtaagaagtgaatctgctgcaaaaattatattagagctttatagacgcacgcatcgtttgaggcgaagtgggttgcgactggttttgaaacagatacaccagatcttcacaagaataaaattatagcattttagaattgactggcaccctgaagtttacattgttcatttgtttcctggatgggggaactgaggcccagagagggtaactaatatgtcccgggcttcagggcaacttaatggcaaagctaatatcacaagccagctctttgggggtatcttggtgtctgtctagtctggattctttttaccacagctcagtattattccttgtgaaataagcaccttagagtcttgagactgagccagcaattttgctagactgcaaaccattttgaatttccttcaaaatcggtttaccaaccaaataagacaatcaggcctgttactttgcagacacgtttgccttcatccaacatatatattgggcacgatcatgtattcaccagatttgattctgaatggcttttggctgcttcacaaaatcaaatctacttttcagagattccacaccatgggggagatttgaaccagtggtgctgcctgcagcaccagtgtatagtaccctcccgggtgcttgagggtggataacattcacggggggcttgtagattctagtgtagttagtaaatgattggtctctttaacttaaagttctaactacatttattaagttgtcgatggtttcattcattcatcaaacacaagaatgccaacggtgggcactgggaagacagcaaagagccccactgctgaggtccctgccttatagagtttatatgtggggaggcacacaataaaaaaataaacaatgatatattttctggcagagatgagcgctatgagaaaaaatagagctctgaaaccttacaatgacagtaaaacaggctggcatgattgagaatgacttgggcattactttgaatttctagttttagattgccagctgctgctccagtaaaggaaataaatccaaaagtaaatctctgaatcaaagagattttttggagtcatcatttctccaatgagtgtcttttagatggtaagctcatcccagcctcatttttactcacatttccccccaccccgacatgcaaacagtaagtgatttcaaatacctagagaggtatttttcaaatcctttgctgttttcatagttagatagctgactgtagctacagaaagctctgctgaggtcaatattggttgttgatttcatgccggtgtctgctggactctcaggctaccttgcacaagggtttctcttcctgtgcaatggtttgtactgtgaacctcttatctgaaatgatcatcagtccttgtgtggtttgtaaagaaactagttcattttgaaatagctcaagagaaaagaagcactcattcttaggaacaagagtgctcgctaataaaatggcattaatgagagttgactgtaaaagttcatctgtttaataccttctaagttctctcatattctgtatgttcaatggcttcaaagcaaaattttaaacttttacaggtctgaaaaataattaaagttacaaaaaatactttaatattttttgttccaaaatgagaggcagattaacaaaatgtagttacttagaaaccactgaaaacacatggttcttgctcttattgagggctccaaaataaagagaaaagtggagactctcaacgattaataggtgacattttaaaggggtaaccagaggatttcaaaggctggagtttctcatttctaaagtttattcgattttgtaacagaataatagattgttttcattattctttagtaattttcctttcctgttttcgacctctttgaagttctgctttcattattttctagttttctagttctttatttcctttttggcagatgtgggggatagggaccgtcatttgcctagaagattttgactctggattgggcagcctgccccaatttgaatcctggacctaatattatctgtgtgactttaggcaaggtacttaactctgtgctttagtttccttatctgtcaaatgagaataataatagtacctttctcaaagggttgctggagggactgagtgaataatctatgctaagtgcttagaaaagtgtcttgcatgtagtagacactaaagaaaagctgttattgacttgaacgatatggaactcttttgtttttaagaaaatacattattctagctatgtcttaataaacttttggaatccagtagcttgcttttctcgacatttctctgcatttccttgttggcacgagcttttggttccaggcgacgctggcagcagtgtcctccgttcttgcagtgctatattccctttaccatttggacttagaaatttcttgaggccaaattttgttgctacaaacaataatagagcaagagaggccttcttctagtttatctgccttgaaagtgagagtgtatcaggagacccagtaggagttactgagttaggtcccgttgtcatcctgtagttgggggaagatttttcattggaaatctttgcagtgtatttttccactgtgagtaccacgacagtctcatctttttctttttaagaatgtggaggcatctctttagataattggcattgtgtactactagtgctttctatttctaccagaggaactatggtaaatgagccttttgtttgtgtgaggtggtagaaagcttcctgcatttggattccagaagctgagttcaggtcccagttctcttccttaactctgtgtcactggacaagtcatttaaccttgctgctagtggctcttccatctgtaagatagagctaataaaacctgccctgccaagtttccagagttcgtcagagaatcaaatgtgcctcagagccctttgtaaagtgtgcagcattattattattgcatgaatgtgttgtataagcagttgctatttggagaactggtataagagggcagttgtccttcctgttcttggactgtcttccctgtggctgtaggtgtggcctctctgcctcaatctccctcttctgtcatcattaaaatatgcaggtatttatattgcctctttcataggggcctgatgtcactggtataccataacaagtttttgttttatgtattcctaaaatggtagtagtgtataaccaacaatcacagggtgacagcaaggcaagctcagcctcagggaatgttgcctgcctctcccaagtgtctcagaatggaagactttctcttttccaatcgagacctgaccgcagctcctgagtccatactagactggatgcttgtgcttctggggttagaataaaaagcgatccaggctctggggaagagatggttgatagctccccaggtctgtaccatcctccttgctggaacagggcaggctcctgagtgatagggcaggcgcctgagcggccttttctcgttaaagttgtttctcagtatcttgaaatgtctctgtaagttgcactttgcaatgaatttcatgtacttgtattagtttagtattgctgttccttgactgtttgtcttaataggtaactcctacatatttcagtatgtttttcattttctatgattgtaataaaaagggcgaggttggagatattttttctgattgtctgaaacctaagatggtcctatacacacagtagacatttagtaaacattatttaacttgaactagacaaaggaggccagcttagaattgttcacacatgatcattgtaaccaattctgttgcatgtctagagatcatgctccctgtctgccagatgaaatggagctcatgcttaacctttcttgccgtggtcaaacagcaaatgagaaagttctttgaatcagtcattgtcttgccacccttttcttctcagcttcttgatttttgaactcttggcatgagcagtttgagtacagattagtttttgctttgcttgctagtatgtttggggtgggaagttgaagggggaataattgaaagtaaaaataaaagttgtttgtaactcattcatctcttatccccttgcctccaaaccctgacagcacacagcaatgccctttctttagcatgtgataattgttatattttgatagcatgtccttgaacttttttgtgagaaggaagcattgtttatttcccagagccttttgcttggaatgtaatggattgctacatcagttatcctttccccttcttgggagatgtagaggcagaggtgggttataaggtagattcttagcatcaggtggtggtgctttaaattcccttatatgacttttaaattgctttatggccctgagacaacttaggtggggatttaggagaataggtactatgctggaatccagcaggcctggaattggcccaagctcttttactgaaataagaaatgtacctgcctgcacagcagtgacccttggccatgacatgaaatatacctgcgtgtcagtactgtttgtggataacagtaagaaggaaagtttgcacttggtttcagtgagaccccaggagggcgctgcggttaacacgggttatgtgactaggaggatatgagaaaccccagccagtattccattttgagtttcctggttctgaggtgttccttgcccatgtcagtggttctggatctgggagagaaagcacaggtccctactgccctaacaaagggaggactgaccgttggtgctggcccccacctctttgaatcccttgcttggagagagaactgattttttcaaagttgaagctgagtctaactctgctggacatgtccttccttcactatatcaactctaataatctccccagagattcccattacgcctatggcatgaaacaggtttttcttattgatggggattgcccttgctccccgggagctggtgaaacaggcagaatttcaagccccatcctcacccactgagacccaccaccgactccttaagctgaatgtgaattttaatgaggcccccaggtgattttgcagtaaattaaagttcggaaatagtctaatagtaccagctcatatcctggcttcccagtcctttaagatagcgctagccaatagagaatgtgtaatttaaaattttctagtagccacattgaacaagtaaagaaacaggtgaaatcaattttaatatatttaacacagcatgtgcgaaatatttcaatgtgtcatcgacataataatgacacgtttttccttttttggtactaaattgtcaatcaggtgtatattttacattatagcccatctcagtttggattagccacagttcaagtgttcaggagctacagctgtggagagatacatttggtcttgatttgctgaggatttcatcagattcactgtcaatgcttaaatagccgcctcagtcataatttacattaatattaggtgtaatctttgccaagtccttagcccagtgcttttacatcaggtctcatatgaatcctcacagcatcgctttgaggtaaaaactgttaagatccccactgagtttcagagaggttaggtctaagctgaagcgtttaggaagcagtaatatcaggatttgaacccaggcaagtctgacttctgggtttgcagcctccgctgcaacttcctgcagctctcatgactacagggttttttctcggtttcagtttttagttttgtaagccatattaaaaaggcaccattggtatatgtatgaaatgcaatcttctttcttgaggggaacttcaaagaactcgaggaatgcctctttcttctctggcttttcagagctggtgcagagtccctaaacagaagtttcctcatagagggaataccacggaccaggagattgcctttcctgctgctcattagaatcacttggggagttttacatacttgctgccctgggcatcgcccacagatattcgaacttaattgatctgggctgagactcttgacatctgcatttttaaaaagtggtcccagcgtgcagcactaccaggagcgcttctccaacttcattgccttatgaatcacctggacttcgagttgaaacacagattctgactcagtggttccgggatgggcccggagagctttttcttctcatttccatcaagctcccaggtgatgccaacagtgttgctctgtggctcccactcagagcagcaagccacatcataatcacctgaggggtttttgcaaaactacaaattcctggcatcatgcctggagtttctgattcagtaggtctggggtggggcccaagatctttacttgagaaggctcttgctttcaatgtttcaccataaagtattgtgtttactctaggttttgtgtaggggcacttctagtgtacatttttttcggtcataagtggatgttgagttttatcaagccccttttcttcctttatggagataggtttttggtttgtgtttttgtagagagggcttcttactgtgttacccaggctggtctcaaactcctgtcctcaagcaattctcctgcctcagtctcccaaagtgcttaggattacaggcgtgagggagaacctgtgttttccctccttgaacttgttaatgtggtaggctattttaagggattttctaatataactttgtagcattaactaagtttgtattgctgggataaactcaacagggtcatgttctttcttactgctgggtttgattgctaatactttctttaggatttttacatcttatatacataagatttggtattagttttcctgtgctgtcttggtctagtttagtatcatgcttatgctagccttataaagtgagttgagatattccctttttctgttctctggaagtttgtataagattggagttactggttccttgaatgttgctagaacttgcacatggagctgcctggggcctggaagattataaactaccagcaaatgtctgccaaatctatagctgtgtctgtcttttcattcctgcatcctactattgtttgtttgtgccctccttttttctttattagtctaaccagaggtttgtcagttgtggttatggcaccaacttgataatataattatgttcatttgtttcccttttagggcttttcccctgcttttttgattaatttttaacgagtaaaaactttatatgattttgaagtcacatttatttcaaggtatattcagaaaagtcttgctttcaccccatctctgaccaggtattctgtttctttcccccccgtagatgatcaatcttattagtttgttcttctaagtatcttttgcaaatttgagcaagcacgtacatgtattttccccttttcttgcacaaaaacatatttcatacactattcagcctcttgcccttttcacttaaagaatataccaggaatcattcttcattttctcctcctttctttagatttattctgctgtttggatgtttcaaaacatagtattttcatgattatttagttgtgatattttctattatgattatttcattcacctgcgagctgtttagaagtatatttttacttacaaatgtattttctgggtattttcaaaactgatttacaacttaactgcattatggtgaaagaatatgatgtgaacactcgtagttctttgaaatttgtcaaggataggcttatgtggtatttttgtggctggcttctttcacttagcatactgctttttatattcatttttgtgttgttgcatgtatcagcagttcctgactttctgttgctgagtagtattccatagtatggttataatgtaatttattcattcagtagttgatcatttgagttgattcagtttttggccattttgaaaaaaagctgccatgaacattcacatacaagtctttgtgtggactcatgcttttatttgcttcgtgtaaatacttaggtgtggcattgctgggccatatgtttagtgtatgtttaactttacaaggaactgtcaaactgttttccaaagtggccatgccattgtgccattttgcattcctactggctttaattgtctgcctttaaaatgttagccatttgactgggtgtataatggtatctcattgtatttttaacttacaaattcctagtgactagtaatagtgagcatgtctttatgtgcttgttggccattaagtttatcttctttggtgaaggatttgctgaaatcttttgcccatttcttattaaattggattgtctgtctgaagttgtgagggttctttttatattctggatacaagtacttcatcagatatgtgatttgcaagcatgttctctcaaactgtggtttgtctttcattttcttaactgtgcctgtgcctgtgcaagagcaaggagttttgattttgatgaagtcctatttactttttcccctgttatggtttgagtttttgtgttttaagaaatctttacttaacctaagttcacaaaaattttcccctgtgttccttccagaacttttttagtcctgctcttatgtttagatctgttttggcagacagatctttccaacccctggtgtttatacctgtgtgatccccttcccttgagtgtgagcaggacctgtgacttgcttctagaatatagactagaatatggaaaaagtgtagggattctacagatataattaaggtcacaaccagtagattttgaattaatcaaaagagaagttatcctgggtaggcctgaattaatcagcacaaaacccttaaaagaaggtctgggtcctccccgaggtgagattctctttgctgacttgttgatgtgagcagccacattgaggaaggccacatagaaaggaactgcaggtggtctctaggaactaaaagctgcttagcaaaaagccagggccttcaaccatgcagcctaaaggaaatgagttctgccaacactctgaatgagcttggaagcagattttccccagttgagcctccagatgagaatgcagcctggccattaccttgattgcaactttgtgagaccctgagcagaggacccagctaagctgtgcctggacacctgacccacagaaactgtgagatgataaatgtgtgctgtttatggctgctaagtttgttattcagcaatataaaactagtatgtctatgttccatttcaagttaattttgtatattttgtgaagtaagggtaaagattcatttatttttccatatggacatcaaactgttccagcatcatttgtgggaaaaggcccacacattttggtaattttgttgaaaatcaattgaccattgctaggacctcaaaaagaagggcctaattatagtctctgttctgttccattgatctgtatgtctatccttataccagtactgcagtgtcttgattactgaggcattataataagtctggggatcaggtagtggaagtactgcaacttttttttttttttcttttcaagattgttttgaatattcttggtcgcttgcctttccatacaaattttggaatcatcttgtccaagcctgttgggattttgatagggatttcattgactttgtagatcaatattgacatcatgacaattaggagtctttgatccttgagcatgcgatatgtatctatatatctctatctatctatctatctatctatctatctatctatctgtatatttttgttttgagatggagtttcgcttttgttgcccaggctggagtgcaatggtgtaatctcagctcactgcaacctccgcctcctgggttcaagcgattctcccgcctcaacctcctgagtagctgggattacaggcacccgccaccacacccagctaattttgtatttttagtagagacggggtttctccatgttggtcaggctggtcttgaactcctgacctcaggtaatctgcccgcctcgtcctcccaaagtgctgggattacaggcatgagccaccacgcctggcccaagcatgcaatatttctccatgtatttaggtctttaatttctctcagcaatgttttgtagctttcagtgtgtgattcttggacgtattttgttcagtgtttccctaagtatttcattttttttggtattgcaaatgacatttttaaaataaagttttttgagacagggtcttgttctgttacctaagctggagtgcagtggcatgatggtggctcactgtagcctcaacctcctgggctaaagtgatcctccctcctcagcctctcaagtagctgaagactacaggtgcatgcccccatgcccagctaattttttttttttatgttttgtagagatagggtcttgctgtattgcccaggctggtctcaacttcctgggctcaagtagtcctcctgcctcagcctcccaaagtgctgagatttcaggcatgaactatagcactgggccagtatttttatatttcagtgttcatatgttcattgctaacaatacaaatataattaatttttatattggctttgtgttttatgcagccttactaaatttacttattctagtagtttttttgtagtattcttaggattttttttgcatacatgattatgttgtctgtaaatacagttttacttcttttttccaatatgttatgtgttttgaacttgctagaagctctaaaagatgttaaatacaagtgataagagtgaccgtccttgccttgttcccactcttattggtgaaagaagaaatgctttctaagtgtgatgtcagctgaaggtttttcataggtgcccttgacaattcctgatttcctgagggtgtttttaaaaatcatggatagatgttgaattacgttaatagaagccacgtctcagatacaatcttcaggaagatagcacacctcatgaatagtcttactgactatacatatcaccacatttatacccattcttaaccaccactacccagcttttcctcctagtgtcgataacagaatttccatctggatcttgggaattctttgtggagcagcatatactgctccttcaaaagacatagatcttctctgcgagattcacatgtatcattattttagaactggaatttcttcatcctctctttccttgccattcttttaacactggttttggttcttcttcatcttgccttttttatttctgcctttttttttttcaggttatttctgccccatctgtgaaaccttgtctgccaatagtgccaagttataaaaatatgtacgttcagtcctttcaccttcttctgtaacaaggatacgtggttgtttgtatttgtgactggaagaagtaactgctccaagtatgaagataactattgtccatactctctaggtcatggcaagtctttctccttctgattctcccaggatcctaattaagccatctttggggattccctttgcatactccttctctactatggcaaactgcctgttgggcaagctgctactcctactgcttatctctgctaaccttcaaggtcaacctgctcttgcaagttaggactaattaagatgtatcaagcccaacattctcaacaatcaaaagaccctaggcagcgttccaaaagccccatgtagaggaaggtcaggaagttccaaatccaaattattcaatgtattttggaactcttctttggattgacttcagagaccaggcacctttaaaaaaatatcctcgcacctttaaaaaaaatatcctcaaaggctctaggccaaaatcattttgtatcacctctattaatacatagaatgggcaccggtgctgtatggagcattggttttggtttaaaaattaagatatggttaaagttcatgagatggtaccttatgtagctttaaattccaaaggcagtttcaaaagaataattcaaagaatactttgaacagtggccacattgctggaatttgtgtacaccatcaaaggggactactttgaagaataactcagctatatatgatctgacaggctttttaacaaatgcctcattacatgatagttgcacctcatggggtgttttgtgcactagtaataaaaactttctccttttaaaagatagttttaataaagactaagtggatacaaataaatagtagacaatcaagggttgtgctgtttcagtgactcacagacatggatttcaggggaaaaagcctatttgttgactcatctttaaagtgaagtctagggttcttctttgtgaccatcagattttatcacgtggatgaaattccgaaaagattttttttatccagctgtgcaagcaggaggcatgatgtcctcattttaatatgatcatctatgagagaatgagaatgacagatatctatctgttagtggatgagagggccggtcagattgcctagatttcagttccacctttgacagttattagcagacaaattgtttaaccttcctgttccttgtgtttgtcagttgtcatatgatgatagtaatacctagttgccttttaaggttttggtggggattaaatgacttaatctgtgattagaacaatgtctgacaggtagtagatgatctgtaaatgaaagccgtgatcattagcataagcagatactctgttttgctttaattgtatcacctctgttattgtctttattactatttaaccttttttatacatattaattatctttattgttatctaaacatttgtttgtcatcttcccaactcagtttttagctccttgaagacatatctcaaatttttttggttgaggggagggggaactctccattgtggtccagagtagctgcccactatatagttactgattgtgaactctttggaaacaagatttaaataatgatatatgctgagttaggagtatctcagaatgattggcttgttgtcatttcattatttcttctaaaaaaccatattattatttcagtactagttaatttcataggtattcattgaatgcttatggatagattgacaaatgaaattgttctgaatgtaaccatatgttgacatgaccattttatagattgttaatttctgtagccaacctcctgcctattatgggttgaattgtgtcccctaaaaagatatactgaagccctagtccctatttcctcagactggggtcttgtttgttactgcagttgtagttagttaagatgaggtcatgcagcactggagtagggtggactcctcatccagcatgactggggtccttatgaaagaggaaagcaccatgtgaaaacacagacacacagggagaaagccatgtgacaacaggcagagagattggagtggtgaagctgcaagccaaggaatgccaaggattgcagccaccaccagaagctagggagaggcaaggaagcattctcccctagaggctccagatggcacatggcctagctgacaccttgattttggactttgggcctccagaactgtgagagaatttatttctgttcttttaggccatccagtttgtgggacttctttacagcagccccaggacaccaatagactgcccatctgcttgaattagagtgttgacaagcttgggatttcatttcaaacggtggatttgcctatgttttcatctattatccatcttctccagatactttgatttaaatatataaatataaatacatatttatatatttaaatataatttatataatttataatttatatatttaaatatatattaaattatatatatttatatataaattataaattatgtaaattatatattatataaattataaatatatataaattatatatattatataaattataaatatatataaattatatataaattataaatatataaaaattatataaattatatataaattataaatttatataatttatataaattatatataaattataaatatatataaattatatatattatatataattataaatatatataaattatatatattatatnnnnnnnnnnnnnnnnnnnngggggggcgtgcaggcgtcccctgcgccgcggagtgaccggcgtcccgtgcgaacgtgcgcgctgccgccgcgctagagatcctgccaatcatcgcgctaaatgtgcacctcagttatccacattatgcgtccgccatgtagtagtgtagatatctttcatatcacccttatatctaagatatctcttagatatatatcttagatatgcacaatatatatagatatatctcagatatctcagatatatattatatatatattaaatatatatatttaatatatattaaatatatatatttaatatatatataaaatatatattaaatatatgttaaatatataaaaatatttttaaaatatattaaatatatatattaaatatatatttcccatacctgatctggcagcaaatatatttttatatatggcagcaaatatatattttcatatatatatatgaaaatctggcacaaaaatacggttcttatatgcatgctaggaatgggagacgtttccaaagatgcttataaaagcactgtttataattgaaacctggaaacagctcaaatgatcactgggaggagaatggaaaaaccaagtgcaaagcagtggactgctatgcagctgtgaaaatgagtggaacacaactatatgcatcaacatttatgactctctcaacactatgtgagaaaagcaagtggcagaagaatatataatgattccatttacataagacttcagaaacatggaaaatcatattatttagggatgtatacatgtggaaaattttaaagatatgcaagggaattataaacctaaaaatcagccctagggaggtaggttggagtacctttaatgactgatgactaacttctccaaagtcatgaaagtttatgagggtgatgctacatttgtttcttcacggaatactgagtacccaaactgtgctttgtgctggtgccagaatggaaaacatggtccttggccttaggaagttctagaaatctaagagacgggacacaaaatatcaaggcataagtacagggtaagaaatgaaatacaatcgtcccttggtatttgcgggaaactggttccaggactcccgaggataccaaaatccttggaggcccaagtccttgatataaaatggcatagtatttgcatataaccttgcatatcctcctgtgtactttcagtcctctatagattacttataatacctaatacaatggaaatgctatgtaaatacaaataaaaattagtatttgaagtatttttctatttgtattatttgtatttgtattattttttgtcatactgttttttgtgtttcttcccaaatatttttgatccgcagttggttgaatccctagatgtggaactcctggatgtggagggctgactatattagaaatatgtatggtgtacagagaagtggagagagagagagagagagagagaaagagtgtgtgtgtgtgtatgtgtgtgtggggggaggtcaggaaaagctttccatgttttgaagcaggtaaatgccaacaaagcatatgccaacgaagcccctgcttctgccttcaaatgagagtacctagaggaattgtttcaaatggcaggttatctccaaccttttctcctctcttcagttttctagatactgtgcacatccactctagagttccttttttcctccctcctccactactgattctgctcagaagaatcttcatcagtaatgcccaatgcctgggcttttctttggggtcctttagcccagacctgagaaggttcttggaaagtaaggagatgttttgatctggcacctttgttactatcatagttataactatttatacgtttctattcttcaacaattactgttttaacttttgctaaataagttactgtttacttataaatttaaaatgtactttttgtgaatagttctcacaggggaaaatagttcaataaaatgcagtttttttcattgagcagatcagctgggttcatgagttttggaattggcagatgcacgggaacttgatcttgttcctattttaaaactttgtttactggcaggtatttgactgttaaaaaatccattggtgagtttaatgatctgtttaaatgtgtgcagtattgctaggtagcctttgtacattaaaaacagataacctgatagtagttgacttttctaatagtttacttaccatatcactttcaatttatgaataatttctaaagttaccctgttccatggccacagctcatgccactaaagccaatcagctgtcttgaagatgtgccatttgtcgtgaggggaccaagaaatagggtgaagagatcagcccaaatccatcactagccactggaaaaaatgattcaaaatgcattctccactgagtctgaattacattatttttagccaaaggtctttgcaacatttaaagaaataggggtaggtatatcatcatgtttaaaatgaattgtaaatatcaaaattatacagagagtgagattttaaatgaaatactatatagcatcatataattttcaaagaggaatcatcaaaccaaatacactgtagccctaagatttgaagtgaccaagacaaatcaagaagctctaatgcttctgttacatgtgtctatgtggacagtaaaccacttacttgggggatccttttttggagtaaatatagttagatttgtagcctatttttagatatctgagcctgaatagaaagtaatgagatgagatctgtatgttaagtatttcacagaaagattccctgggctaggagtcaagtgttttctttttttaatggaaggaggcatatttgaaggtaaactactgtaaggctgattggagtcttggcaaggttagattgatcatcttagaaaacctgtgtgcagaatggttaggcaatcaaggatatggtatattttgtggacaaccaacctaacatattagcaccagtttggggaatgacttaagagttcactgggctgggtgtggtggctcatgcctgtaatcctagcaccacaggaggaggccgatgtgggcggatcacttgaggtcaggggttcaagaccagcctggccaacgtggcgaaatcctgtcgctactaaaaatacaaaaattatctgggcatggtggcgcacatctgtaatcccagctactcaggaggctgaggcaggagaatcactcaaacccaggaggcagaggttacggtgagctgaggtggtaccactgcactccagcctgagcgacagagtgacactctgtctcaaaaaaaaaaaaaaaagcataaagcatctctggtaggaggaagggaactggtatttgagcatctttgttatgccatctgctgtgctataattttacctgttcctcatgacagcactgtgagggctggcgtcacacccattttacagactggaaactgcagtaattaagtgagagaattgggatctgagacacaaattggtctgaatacagaatcccttcctttttttcaactgtatcacactgttttgtaggtgggcgcatagtggcattttgacaagctctcaatggtggggttaatagcttgttttttagtttaagagaatatgattattatgtacttcggctgaagacggttcacatgggaattattttaacagcttaatgcagggcgtgacagcctgtttttgtaaataaaattttattggaatatagcccatcatttatttacatattgctgcttcagtgctacaacgcagtactgagtagttgcaacagaaatgtctgggtatctggccctttacacggaaaatttgtcagtcccttgttcaaaggaaaatgtataaaaatgaaccaaacttctgcttttgcagatcatagtttattttcatgtgagttgagcacttcttccccccaaataaacaaatatatgtgttaaattgatggtgtacctggtctcaaaatggctggaatatgaacatttatcttggttcacagtgatttggttgaggacgtctcaaggtatgtttcatttttttgcatcctaggtggcctacaatccaagctactttaatgcaaaaaatcagaataaatttatagtaaatcctgtgtttactggcactccaggtacagaactctgtgaatggttctcattgggggtgacgctccccctagaggccaaattggaaatgggggcatgttttggttatggtgtaattcattgaaaaatacattattttattataaatcactgtccttttatttctcctttatattggagttagtacagtatattgattttgtatcatgtttagattgaggatatccatggttttcatttcagcctagcaaaggggactttacagaaatttgttttataaaaagggagtttcgggtctgatggtattgagcaccactgccaaagagatttggcatctttttgaaaacagacttctaagtaaggacaactaccttagaaagacctggaattctgaacggagaggctgcttgttctctgacaaactttagaagtcaagttttaagtctcagtatgtttccataagcagcatctttccagagaaagagcatgattgaacttaacgtaaatgccaacacagagtcataaaccacattaaaggctcatcaaaagacaaaagctgcatacctttgtcactgttttgtttgtatacagaaaagttcagaaaaaccactcagggccattgatctcaactcaggtgacgatgggaaatagagctctccgtggtgtttacagtttgcttgcaaaggccctatgaggcagagatcaaaattattttctagttctgctgcttttagattcttaacataagcgttaaaatggcatgcattttttaatgtttttagttaatgtgtgcttcaggtttgtgtattgttgtttttcatattcaacagaaaaggaaaaacagttccttagtctggaaaaagggcgcggtgaaagaggtttttgtatctgcctccacagattcaactgaccaatcccagccccctgtactgggacggctgtaccttaatttgaaatgttcatggaaaagtctataagggaagatagcattactcaaattattttcagtgcaaatcgtttcaaaggggtacaagttaaccctgcagttaactacataacagtatatacacttaaatttgctgcccagaaccaccctgcctggaccatcctgatcagccaaggccttgtcgtaccatttcaaacatgagtttgtatgaacttgtggcttaagtgaaatattacactgccaacaactgttatgttccttggccaatccttaattgcccagttcattcactcatttaacaaatacctgttaagtatcttttgggtgccaggcactgttacaggtgctgtaaataaataaaacataaaattcttggggcttagaggccccaaaggttggttggctaggtgagttgagttctcttaactatgtttcttagtctcaagctgttctactgagattgggaccagtcacgtgcaacctggtttccttccagagaccacttagaagcacttttctgtaggtagaagggactctgcaatgcagggagacctaggctagagttgtccctgccagtaagtcactccaggaccttgtcacacaccctctaggccccccgcatctcctctgtaataggagagggttgggcttaaatcatctcaaaggttattttgggggatcaaaagtgatagaagtctacctctggttagaatgctgtagttaacatatatatacggaatcaacttttaatttttgctttaaagccaaggtagccaaaaatcaacatttttttgtttgttttttaaataaaaaggataaaaaaacttgattgttagggctttgggatgaaatactctgtaaccaaaagggtagctgatttttgtagacttcactatagcttctaattatcatccaactgcctttacactaacatagtcattttatacacgaagatatggatgagctttctttgcttggtaagttagagacagcccagggcttgtacacacctgtctagtacattttccaaagtactacactgctttccattttcctattagagtcattattgtctttttttttttttttttaagcaaaaagcactttataactgagtggctgctagccatgcgctatccctgtattagttaacttttctcctagtatttccaaggtcaggactaatttgtagaattggctaagacattggcattcactagctatccttttgtgctcataaaaattaaaaattttaaaaatactagtaatttgttaacagatacactgtgtggttccaagccctgcatgaatgtattaattcatttgtttcacctaataatgttgatgtaaaatgggggtaatagcaaccaaagcccagagaagttaaataacctactcaaggtcaaatggtgagttgcagagttggaatttgaatgtagtcagctgcaacatttgtgcacaccagcatgatgctgttccagcttctataatcttcagggatcaatcaaaaccattcaacaaagagaggctcactgatgagattttaaagtaagcctcattgtggaactggcacatgttatctggacctttggatttctcggatgtatacttgatccaactattaacagtagtagtagtgtctggtgttcctctaaaaattagagctttagacataaagactgcatattgttcggtttcatttatatgaaattcccaaagtgggcaaatttatagggatagcaaattcgtggttgctggaggattgggagtggtgggtgactgctaatgggtatggggtggggtttctctttgggatgataaaagtgttctaaaattgattgtggtgatgggtggcacaactttggatatactaaaaacctttaaattgtacacttgaaaagggtgaactgtatggtatgtgagttgtagtaaaacagttaaatgaagggaaaatgagggatttcgtcctttatattcattttaaattgaaattttttcatgaaaatcagaaatagcaggaagactcatcattcttttatggcccatgaataaacagggtggtgacgttgactgagttgactgtacaaccaggattttagattttttctactgacttgatagtaagaatttaactttttgttttaaaatgttgacttacattagtgaagcattttaaatattaaagtatctatactaaaaggtagttttatatctgttactgaagaaaatctgcccctaatatatagtcttgttttgtcaatagaaaaatttcagagcagatacatctgacttgctccatagttcatctcatccattctgctatctctgagaataatgggttattttgcttggacatgaacttaaggttagaaaggtttttcaaagcatattttacgattttgtctgaatttaattcattttagtgttattcattaatctttttaaaaagttacttttaattttgcattgtgctacctgtaggtagtttcagctcttctaagttgagtatctctttctataaagacgtattttgctctaattgttaattttcaagcatcagtggtagttgcctagttccagtgttctgggatttggtgaactagtatacatgtttgccccatcatgacatttcacagtattgtatatttgccgcataatcattcaccagatagttgtgagttccagtgtgcgccaggatacagccacgaaccagacagacacaagccttggccttgtagtgttgaactctcacgggggaatcctgacagtcctaaccttgtaagatggcccctatctggccatctccccacctcttcatcctggtggctgtctttttctgtgacttcgtcacctttcttgactatttcttaaggacagtagccagtactgtgaagctgttaaatcccactagattttgtgccaaggtgtgttaacccatttatgcctagtgttccactattggaacgctaagcttgtgggagttatttacatcctgctgctcaaggtcatcaccaaggtctgatttttcacaaaaataatttgcaacctccggcataaatgggttaatgttctccattgctggattttgttagtgtgtctggttgctcttaatacagcctggcaaaaagatatttataaatatccacagtcaccttgttgaattggatgtggtttacctcccgctgactttatatgtatctatctgtgtcctaaactttgataaaataaccaaagcattacttagtgttctgttgttgctgtaatcttcttaagtctaaataaatccttgcgttaaaatggtatttgtgtatgttctgaatagaatgctttcatttatgcctgaattgtgatgaatatgcattatttaaatgaagtatatactttccctagaaaatactgattaaatcaaatcttaccaatttgatttcagtcaaatccatgccactctaaactgccatcatttggagaaaacaaaattcttaatagagaaaatagtgtgagttaaattgtccattcttttttcattctgctcggctgcctctaaattatctttaaaaaataaggagtatggaaatttgaggcctgttgcacaattaataaacattaagtttttttagatggcaattagagcactacgaattaaaattcctggaatgtgtatggcgtcttctgctgagctcccccttgtgcatttagctccccttgtctgttctcccctagtcccctgcacctttattggagctctcacatactgcctgtgctctggttcatcgtttctatgtcttattaccactggggcctagtatggaaatagaacctgtaaagtagtaccgtttgctctcagttgccatatttaagtctcagatgtcacatatgtttgaaattgcatacaaattcagttgatattgaatgttgtgtttcttggtagagtttccaggatggcttctgcatcaacttctaaatataattcacactccttggagaatgagtctattaagagggtaagttgaattttcagatttatctgtctctttccttgcatttattttgatatttgaatattaggtcattttgggctggcctattgaattatgaattttattattcattcacatataaatacatttatacatgtggtttctttattgtctcaccttgttctagaaaagcttttttttttttttggagacagagtctcgctccgtagcccaggttggagtgcagtggcaagatctcagctcactgcaacctccgcctcccagattcaagtgattctcctgcctcagcctccctagtagctgggattacaggcgtgtgctaccacacccggctaatttttgtatttttagtagagacggggtttcgccatgttggccaggcttgtcttgaactcctgacctcaggtgatccacttgcctcggcctcccaaagtgctgggatttacaggagtgagctaccacgccggcccagaaaagcttttagatagaataccttatatgtgttaagtgagttttacatttgtaaatcctttcacataacttcatttttgaaaacctctgtctcgtgaaattactgctagacctcatgtttaaggtactaggcaatcctccacctggaaaggttgctgaaggacatactggaaggctaaggcctgctgagcaggctgctacgccttcctaattattggcattattttctaattatgataaaattgttgcataaccaaaacaaatacaactttaacagaaaatggttcaaggtatccagggggagattgtgtaattagagggagattttggaatgtgcattcaaaggaagggattaatttaaaataagctttattcatggccctttaaggccctaagattatccaccagaaaggctaatttatactcccaccaggtggatagagatgcctaagcaatcagaagggagcaaaaggtgatcttttcattggtatttcttgattactaatgaggttaaccttttttaaaaaagtgtgtttatggtcaggtgaggtggctcatgcttgtaatcctagcactttaggaggccaaggtgggaggatcacttgagctcaagagttcgagactggcctaggcaacatagtgaaaccctgtctctaccaaagatacaaaaaattagccgagtgtgatggcgtgcgcccatagttccaactactcaggaggctgaggtgggagattgtttgagcctgggaggcagaggttgcagtgagccgagatctcaccactgcactccagcctgggcgacagagtgagatcctgtctcaaataagtaaataaaagtgtgtttgttattagtttgcatttctcttgtgaagtgattgttcatgtcctttatttggcttttggggattttgaggggagttcttattgattatgtgttccgtgtgtgtgtgtatatgtgtatgtgtgtgtataatttttttttgagacagagtctaactctgtccctcaggctggagtgcagtggtgcaatcctggctcactgcaacctctgcctcttgggttcaagtgattctcgtgcctcagcctcccgagtagctgggattacaggtgtgcaccatcacacctggctaatttttgtatttttagtagagttggggtttcaccatgttggccatgctggtcttgaactcctggcctcaagctatccacctgccttagcctcccaaattgctgggattacaggcatggaccaccacacctggcttgttccttatattttgataatcagctctataatatgttacaagtcttcttcctgatttattgttggccttttaattgtatttatggtattttgattttgaaatactgaagtttaaagtttttatgtgatcacatatatcaatctatattttctgttttgggtgcctacaaggaccatcctcatctccaagattatatgtttttattgtatttaagtatttttatgttaccagaatcagttctaaacacaggagtaatttcaagaatgtaactataaatcctttgtgtaatgctgctctggtataatgtatagcctatgttaatcccatgttatcctgttttaatcagacattcacttcccttattttgtggttgacctagaactgtggtatttaaaaggtatactgagtattgcatttgctcgttatgcctgtttttagttagtgagagggagtgttaaagggtgataatttctttcctctcttacaatttatataaggtgtgtggttttgcttctcattgaggaaggcattcctggctgagaacagtttgtcttgcccagctggttaaaatgtttagcttgcaagtactagaaaattttttaaattggctaggaattttcattcttgcctctgaatgaaaaaaaaaacattaaagattcagcataacacccctctttgacagcttatatctcacctgaatatacaattcacatttctcttgtttcataataattctctccatttgcatagcctctgataatttacagaagtgtgcacagtagctcacacctgtaatcccagcactttggaaggtcaaggcaggcagatcacttgaggccaggagttcaagaccagcctggccaacatggtgaaaccccgtctctactcaaaatgcaaaaattagctgggcgtggtggcacacacctgtagtcccagctactcaggagaccgaggcatgagaatctcttgaacctgggagctgggaggcagacgttgcagtaagccaagattgcaccactgttgcctggcaacagagcaagactgtctcaaaaaataaaagtgtgcttgtatatatattttttcacttaatactcacaaaactgctctaacggaagcatgagtaacttcacttatgaaatgattgcagtgtgattttggacaacaaatagaaaaaaatgaaatactgctgaaaaaaactttttgcccaaacagatgttagtgatgtgcctcaaatgtcatcagactagcacctgcaacacatcttcgtattaatccactagggcagctgaataacctgaaagacaatgggtagctatggcaaattaggctctgcgaactcgcctgcaggttgtagtggttaatattactgtgcccacctagcagagctgtggaagtgattgaatgaggcacatgcttgggaatacctctaaagccaggaagcctagagaaatagtaaagtgatgtgaagaatttgtacaaatggctcctaagacttttgccagctcaaaagttctctgacagaccactcttacctcttattaggacagggatcttagtaaatgtgaggaagtaaaaagagaggaagggtcttagtgaaataggaaacgcaataggtaatcacaatgattttcgggcattgtaataggattctggctaatggctgtgctgttattcagttaagcctctgtggaattgaagttttccttcctactcttcccaaaagatggctgaatatgaaaaaaagaaagctgctacagtgtatgtgtatctatagaacacacttaatgtttactttttatcactttcccgaaagctgttaactttaaagtgcttggaaatgtagtttaaaaattaatattattgaaaagcatgctagcattatttaatactagaagttgacacatctaattaatgttggtgccagattgtaacttttttgtttgaatttttgtgccagttttcccaaatgctaaatctctaatgctttttctttaaaaaacatatttctagtggcttgtattcctagttgcttaaaaacagtgtgtaaatgtaacgtcattacttctgatgcatctgttttgtttctagacgtctcgagatggagtcaatcgagatctcactgaggctgttcctcgacttccaggagaaacactaatcactggtaaggacctgctgacataagatttgcataacttgaggagaagtctggcaggatcaggtggcttcagtcccgcttactctttagcagtcaggcttagacaaataggctacctttgtttagaagcgttaacacagaactctctgcatccctttcttgattaaagagttctttcgagagcttcatgctcacaagggtagtgatattcttgtgtctgtaccaaagactgagaatgatttaggggaaaaaaatgtggattatctcttgaaagtctctcattggagccataagctctcatggtttaaggttttaagagcaaaatgatttccagtcaatgatgcatgctttaaaatgataaacttaaaggcttgaaggcttaatcattctcctctttgaaatataggagaacatattgctttaaaatatctttcattcgtcagaaaatggaagttagtatttaggtaatattttgatgttatttttcatgataaacgtatactaaaaggaagggatcaactttggaagggctagatcactacggcttaagaatatagaagcatctgacagcttctaagccaagtgctaatgttctgggcaaattttatatgtggattaacaccctcctttcagacttcaatgtatttgaagcagatgtgatgaccattgttccagggaaccttttgattaattcagatctgggttgtttagcttaaatggctaaaacctcgtgctaattagatggcgggcctaagcgaggtacctttgggaattagccatacaccatgagaaattctcttctgagtccacaaacttgcacacattctagtcttgaaatggagaccagtgggatgtgttcatcccaatttctggataagagcaaagaagatattttacttttgatcgtcttcatatatgaagttttggtggtaggtatcagcgcctgaaccttaacccaggtggtaactaatggaactagcataaagtagctttattaagtattttttatttagaacttgaagagaaagggatttcaaaatcattacgagtcattaacacattcaaggacatccctgaaagatgagaggcatatttctattataattaattattctgatttagcttctccttatgtttattctaccaaagatgtactattctttcggccacctgttttatatcacttcagtgtttgaaatgaacctagccaaactctattctagactattaaaaagaaaaaggtttggtgcggtggctcacacctgtaatcccagcactttgagaggccaaagtaggaggatcacttgaggccaggaattggagaccagcctgggcaacacagcaaaacttcatctttactaaaaattaaaaaacgagctgggtgcagtggcgcatacccatagtcccagctactcaggaggctgaggtgggaggattgcttgagcctgagaggttgaggctgcagtgagccatgattgtgccactgaactccagcttgggcaatagagcaagaccctatctcaaaaacaaaaaaagacagaataaactggaaagatttctactgctgacatttatttattaaaaacatgattatgtttctgtggttagagattggtagcctcatctctcagtctagtggttagtccgtgagactgtcccaggtgagttgccgtcctctggctgaagtagctcaaatagttacctttacaaccaccttagggtagcagcagcagtattctcattcacttctattgtcaccttgccccaggtagtgacagcattgtgggaaagctcagggaagcactgttagtgcctggaggtggtgtggccccactagttctcccactaccccaactcaacccagcacggtaatgtagaaacattgccagtgcttgctttcagccttttcagtaatttttaaaattgtagttattcttagctgaatagtttatattaaattagtgccatttgttgtgtatcttggtatctatttccattattttagggtactttttttatcttaatagacaaagaagttatttacatatgtcctttcaatggccccattaagggaagagtttacatcacaaattatcgtctttatttaagaagtttggaaacggtaagtagaatataagaccataaagatgaccctaactgttaaagataatgctaaattgtttctcttctactttgcaagattgactgtgggtcaaattaacatggggtatatttgcttctcaactcttaattttttgcttatgcaaaactcatttaacactaacacttgtatatgtaaggaacagggtcaattaaaaaaagtcttatccctcataatggtgggggaggggttagtaattgtaaccatttgctagtttggagaagttaggtgtagaacagtggttctttgccagaagcacatatgaaacccacttatggagcttaacaacacagtatccataaaagttaaaaataaaaaaatacagatgtcctcgatagactgcatcagaatatccagacctgtggtcctggcacagttatattttctaaaatatcacagaggaagatagtgatgtgaatttctgggtgaagcccagcattctagaacttttccaggtgttcaatgataaagcaccaggtagcagtgtagaactaggatgactatggtatggcttactgccactctaccttttcaatccctgaccatgaaaggtttgtcacagcattttgaggaatgttccatcactaggacaataacatggaaaagagatgccccagaaagggaagagagagtgagtagctgctgtggctgtcactgaaggacttccagtggatgtggtgggttgtcattgcccaggtcagcctgaaggggaggtatattttgataggatgtgaatggggaaagaggtccagggttcacagagagtagcccatcagcagcttctacacaggtgaccttgaggctgtcggggaaatgtagcttttttattgcttttaccccaccattttttaggacagttctaatctagattagtttgtatcttttaatctttttttcttttatggtgttcattattatgtctgaattctgaaaaaatgctgtttattatccccattgccttagctgtgggagcccacttttatagctgccccaacttctggaatctcctctggcacagtgcttgtagggacatgtacatggatcaggccacagggcattttatttatgtgactctgttcaaacttttaagtaagagtggagatgagtgaatgttctagatttccagaatgggaaagaagattctgaaaattaacaacagcgagctgcatgttcacccttggcaacaattggcaaaaattctacaaataatcattttaaacatgatttttaagtccttagaaaagaaaccaaccattgggagtgttattgacacattgtcttgatggaaccaaggccatatgacagaccccggtaaagacacctgggccaaatggtggcagtacacttaggtggagttacagcctatggatttcaggcttaatgctaggaagggtggtcgctaacatcttgctgtgtagggcccttcctttccagcatttctgatgcaatgcagaggagcacatagaagacatgcatttccaatgtatgaaaaaccccatactagccaatgtgtgctaggtgatgggatcagggtttgaaatgatcttaacttggtaggatattggagcaaaactaataatataaaattgatatagataacaattactcagttgttatcagtaaaggataggaggtctgtcttaacggatccaagcttatttgaaccagtaattggatatgactgattaaaaagttaatattcccctaggctgagttaacagaagtataacataattgccagacaaaatgtaacaatagccccatctgaagtgttgtattccaagccagatgccaagttttaagagggacattaacaaactgaagagagttcagacacagataaccaggttagtgaagggactgcagttggagcagtgatcaaaataaatgctgatcttgtctgaagaaaagatgactaaaaagggacatgatggacccatctttgaatatttgaagtgcctttctgtggagcagggattcgatttattctgtatagctcccaagggtcaaattaggatagattgaaagattttatgctaatatatgtgagaattatcaaaagttgcaattaaacattatggtcccttttgctgcttgtactcttggctttttgactcaccctgtgtagccagttccaccttatgctgtcactgatgatgaactggggaagttattcaaactgatgatatgacaaggttgtgtatgtagtgtgacctcaactacgaaaaacaaaaattatctgtagaaaagaggctggaaagaagtacaccaaaggtttcagtatttgggctatctgaagaaagggattatgcatgtcttgtcttcttcctttcacttgtcaatatttttcaaaaacccagaatgaacatgtattacttttacaattggaagaattctcagcaagttttatttttgtttgtatatgatgccctagaggatggagttagtgctgagtgggtgaataaaatgcctgtctgacactgactactaacttatttcttcttccactaagttttacataaacattttgagcaattggccacaacatttagtccaagtataaaagcaagcagctgacagcagaaaacatcatataaagaatgccatttaaatggttatacaggagtctaaaaacatagtcatcatagtgtttcttcaattaaagtcctaagcaagaacattaactgtggattctgctgcaaactgaaaaaaattttgttgcatgtttgacaaaaagctgtcatctcactggcgttttgaagtggacacctgtttgtttcaggtatgtaaacactgcagtaggagtgatgagtccagatgtgtgtggtctgattctggagtcagctctgctattttgtaaggagtcaagggcagattccctgcctcctgttgcccagagaagtagagaaacagtgtccatgtcctgagattgccacagtggcctgcttctacctagccctccttgcctggtctgcccctgcattctggcccacgccccgtctccagcgtgttcgtccttagagtgaggccgaccagcttatttctcagttccaaaactatcatcggttccctgttgcccacagagtgaaatccattctcttggtatggcctaaaagtccttctgactcctccaaccttgactcacatcacttcttcccaagtgcattgttctcaaactacgcagagcctttccttctcccatcatgcatgtgccattctcacggaacctggatgccctttctccacccctttcagaagctgctagtcatccttcagaacctacctcaagagccacaccctctctggagtcttccccagcttctcttgaaggaatcattccttctttgtgtccctgcagccttttcttcatgcctctgtgttattaacacattgctatgaaaccttccctggccctttagctaaacttttaatatgtcttttctgtgtttaatttttctcttgagtgcttgtcactgtgtcctatgttatatatttcactgattcatcttgtttgttgtctctctaaggacaaggatgcttgtctgtctattcactgatgttctttcagttcttgggaaggagtctggcacattgaagatgctaagtcagtgtgtgttgaatgaatggattctgtcatatttatttgctgctatgtctgtggtcttatcaaatgctgagtccatttggtccttcatgcctagctagtacagtgtcctggtagacagtaatacacagtaaaagtgtattgagtgaacttgggaggaaatgggctcctaagttgttagtgctgctcagagggcaaaggcctagtcactgtggtttgaccacagtatggctcctgctacattgtggcatcttgaatactaacattgcttctggatttgagaaatcccatagctaccttttggccttgagggtactaaggaatttggctttgggttaatgttgtgactatagtagggcctactgtaggtaggtgataccctgtaatctggtagactaccatgagtaagactgctttcaggattccttccaggagcactttgtgtttaggtgctctagtgcatgagaaagataccttaaccctcgttcattcaggcattcatgtcttcattccagaaacattcactgagcaccatggtgaatttaatactgtgcaaggtgcataatactataccctgaggcctgcataacctcataggatatagagttgagtaattgtggtataatatgacaaagcctacagtggtatgcatagtgctgtgagaaggaagaagacgtacaagggaaaagacgattatgccagtgtagcaagtcatagaatgctttatagaggagatgatacttgaaccaactcttgaagaatggtaacaattttctggacaggaaggaaaaaggagcatatcaggtagagagttaccgtgtctatatggtacttttctgtatcgcatgtataacaatatggaaaagcaccatttgttatgaagatggttgaatgatcggttggagctggaacattgggggttgatggaggagtggggaacagaagaggatgaggctggaagaagagccagcagccttaagagtctcataagtcacagttaagcagtatgcaagttacacagacaatgacatatccaatgtgatttcaggaagagaactccagctgcagtgtgtgtgtgatgggttaggggcgggagagactgaagtcaggaagcccaactaggaagttattttagtttcctaggtaagtgataagggccttaatacagtcatagtggagatagaaaagaggggacagccatgagagatttggagggcttgagtggccatttggaagatggagttgaacaaactttcacttgaaagataggagctgctcccattcatctgaatagacatattacaggagaaggaatatgttgtagataagcccaatggggaaattagtctgaaggcatggacttacagctctacaactaccacgtggaaatggctcagaagcagttggaaacctgactctgaagcttctgaagtcattagcatattggtagcactaaagaccacagacattcatgagctgggaagagtatgtaacataaaaagatatgggctaaggagaggaccccgggggacatggacacttttccatggtgcggagagcgagaagagccagtggagacaaccaagtggcagcagccaaagcagtagaaaatctttggataaagggctgtgatggaagtcagtaggagagagaatctcaagaaggaagggagcagaccatggtgtgaaatgttgcaagtttcagtaagataaagaatgaaaagaggccatggagtgtgtggccaggaggaggctcacaggagccccagcgagaacagattccatggagatgtgagtccttgggtctttctcgcagtcctcttccaccttggtctttctgtaaagattctgcagcttccaggcctcagcaagctgctctgcatttattcttctccccgtggctttaagctacccccttggctttagtcacttccatgcacatgaaattgtatagtaacaaagctccttagagtttacccagcctttttccattgactctttcatctgagcatgacaacagctgacagataggcaaagcagacgctaccctagccatgttttttcccctagtgctacctctcttttgagccccagtttctctttccttactgcctgctggagatcccttgagttttcacctggcatcccagactcatggtcaagctgaaattgttcaactcaattgtctccctcccccgagttccttcttttggtgttcttgtttctcttaatggtgccattttcttctcatcaccctggagtctcctctgtctacccatccccacttctctgtagacttcatcacatttgcctcatcctttctagtcacgttgccctaccctcatcctcggtgtctgtctcctaggccctggcagtctccttcagctaggcctccctgacttctgcatctctcccttctattctatctgctccctaagacatacctgcaatcttctcattcccttactcagaaactctcctttcctaccttatcgcacattccctagccaggtgtccacggtcctcaccactctgctgccatcttatcttcccagcattgctctttctcccctcccttgtgtatacaccccgtgctttggctcccataagcaacttggtcttcctaaacaagccctctgcctcctcacctgtggacttctcgtgcagccattttgtccccctagagcatacattcatccccaccccatctctgccatttgcccccgactcctcttaaaaatcgttccgaagtatttgctatagaaagcttatgaaaaataacataaatgtctgtgggtccaccacccagctgaaggaattccatcctttcctccctcttcacagcagaggtaatcaccatccaaaagttggtatttctcactcgtggtcatttcacacatccctttttaaaatagaatggaatataggaaatgtggaggaagctaaaggaatgggggcttttaaggcttccagtggagcagatcctaacccttggtcagtataatttggctctaggttcaggactgctggcagggtgagaaacatgttggatatagagttttcattttctgaagacaagtcagaaacagcacattcttcctggattaaattcaaggacaaatttgttgtttggcttttctctaaaagatagtgacacagtgattcaattcttcaggcagtgtattacccaaagattcttgaatccttttcaatttgatggctcttttgttgattctctataaagatggagcatacagtgttaacttttagttggtaaaagtgcttctgtgaagaactatataatgtggcctactttgtttttctgatgagttgccagtgcaaaggtaatatttggagaatcaagacgagtaggcagtttacatgtctgtcaaactctgtctcaaatacctggttatgaaatggctttcagatgggtgctgggtgttgtgccatctaagagctgggtgtggaacaagtgcagcagtactcgggtttcctcatctctattggtggctgtcattggatctgtaagccttggatactaccaggaagggaggcagagtttacctttcagtgtgagcatttcaaagccagacctatattctttttcagagggaaggccagtccacttaattacaagcacagccaaaaaggattcctgtagtattttttccttgaagaaaaaaaaaaaaaagcattggaaacttttcaagactgtccttttcaggtccttctctctagtggatttggcacctcttttcattttatggtaggtgaaataatgctaaatagactataataaaacaccctagtctgtccataaatcggaacatcagtgggagcataggatctatgctataggtattattttaaacttccagtcttaaatcatcttcttatattgctgctgcaaaatgaatgccttcttcacattaaaaaacaaaacaaaacaaaacaaaacaaaaacctaattcctgccagtacccttggttcctttgtcccttgtccccatgctaatccccaaactttagggtctgtaagctactaagctctgatgttgaaagtcacataacaggtttaattaattagttccactacaagttcaggctttcagaaagggtctcatcgctgctttggcaattccttcggtctcagattgacttctcactacaccttccaccactacagtgacaaacctttcatgctctttggctaacctcatctcttgttctgttgaaaagtccccttgtcaccacctaaggaggtctaccttcacccattttttcctccttccctcgcatctgagaggaaggaatcagacatcttattttccaaagtgaatcccattctttacacctttctcctctggagtcttagttccccattggttattctgtgtcttacatttttggttttcatcatttttgattctccttccccccgctctgtgaatctgctcaacttccttcccttccttccttccctcccttccctctcttccctttcttcccttccttccctcccttccctctcttcccttccttccctcccttccctgggttccctcccttccctgggttccctcccttccctcggttccctcccttcccttccctcccctccccctcccctccccctcccctcccctcccaaaatggacagagctgtccattttgagacagctctgttgcccaggttggagtgcagtggcgtgatctcggctcaccgcaacctccacctcttgggttccttgggttcaagagattctcccgcctcagcttcccgagtagctgggattacagacatgtaccaccacagccagttaatttttgtatttttagtagagacattgtttcattatgttggccaggctggtctcggactcctgacctcaagtaatctgcccacctccgcctcccaaagtgctgggattacaggcgcgagccactgcacccagccttgcccaagtatctttatttgaaaacaccttcttgtattcctgctaccactgatactatcatcctctttcttccccttattgcacaaacttctttaaaaattagtccacacatgctgcttccacttccgtactattgactccttacttcttgtggtctggcttctgttccctattgaaactactttactgctcaattccagtggccttggttgagttcttgacttttaaatttctatgcagggattgattctgttgactgctccttcctttatccttttccctatacattcctggctctcctctcatttctgcctcttgccttctatgcggctcattttttctttcctacctcctaaatattattttccccagagttctgtcctcaccctcttttttctccattgtcagttgctttccaattctctagctccagttccaatctttcattctgtattcattgagtatctgagagtccagtatgtgttaagcactatgccaggtgctaggatatgatggtgagcacagcaaacagtttctccctcacgaagcttatagttctcatgggattgataaacattcttctgatagtcacgccaatatataataacaagctgtgatcagtgttgcgtgggagtagtacaggggcacaacagtttgaggagcctgggaaattgtcctgagaaaatgcttgacctggggtctgaagaatacatataagttccctagatgtgagtcaggggctggggaggtgagaagaagctgagagaacagcatatgagaggacctgagaccaaaggaagcatgaaaaatgacagtatggctgagttgggggagaatggcaagagatgaggtgagagaggtagatggtggccagatgtcctcggccttgcccaccctgttcaggatttggggtttttattttttcatttattcattggattgattgatttgagacagggtctcgctgttgcccaggctggagtgcagtggtgcaatcatagctcactgcagccatgacctcctgagctcaagcagtcctcccacctcaacttcctgagtagctaggactatagctgcacactaccatggccagctaatttttgtattttttgtagagatagggtcttgctgtgttgcccaggctggtctcaaactccttggctcaagcgatccgcctgcctccgcctcccaaagtgctgggattgcaggcataagccaccatgcccagccctttaatttattttttaattgacaaaaattgtatatatcgtgtgcaacgtgttttgaaatacatacacattgtagaatgagtcaatcaagctacttaacataagcatggcctcacatacatattttgtgtggtcagaacatttagaatttactctcagcaattttctagtacacaatagttgttagttgtagtcactttgttgtacagtagatctctggaacttactcctcctattaactgaaattttgtctcctttgaccaacatctccccattgccttccccaggatgatgatgatgatgatgatgatgattattattattatttttgagatgaagtctcgctcttgtcccccggctagagggcaatggtgtgatctcggctcactgcaacctccgcctcccgtgttcaagcaattctcttgcctcagcctcccgagtagctgggattacaggcacctgccaccacgcccagctgatttttgtatttttagtagagacggggtttcaccatgttggccaggctggtcttgaactgacctcaggtgatccacccacctcggcctcccaaagtgctggtattacaggcgtgagccaccatgcctggtcaggatttgggtttttagagttcagcaatgagaagcttttgaagcttttcacaccactttcaaagtggtgtgagccaaggaatgataacatcagatgtgctcttctaaaagatcaccctggctactctagggggaatgatcgtagattttgagaccactgcaaccacggcagtggcccagagaagttgctggtagaattggagtggttagcagagttgagactgatttaagaggtagacataggagactggcttaaggatagcagagaaggggatgccaggggtgacttctaggtttctagctttcgtaaccagccactgagatagggaactttggagaataatgtagtttggagagagaactgcatttagttctggacatttttagttcgaggtacccttgagatcttgtcagttctgtatatccagccatctcctgggtatctgtacttggttcatttatcataatctcaaaccaagagtttctaaaatcggccgtgttcatctttctctaaaaccccctcctgtgttcttcacatcttttggtggtaccaccactatttatcccagagatctgggcccaaagctgattcatctttgagtcttccccagtggctagtctcttttgctttctacctcggtccttctctacttctagatcctcatagcctctcacttgtactgaagtatcagctttcatggttttgaggagtggttgtagcccacttcttgctagtccagaatgctcagtgctgccagatgaatcttcataaagcaccagttaatcatggcattcctgttctccagaagcatcctttagatctcagtctccctgatcctagccgtgtagtactccccaggaaattcccatcaccgttgctgaaacctggcctatatttttttaaaataaactctccatgcttttcccacatgtgcagctgatgtgactcttacttgcttctcaaatgccaatctccagttgctcttgatccatcctttaaggatcatttttaatgcagtcattgccacagaaccttcatgctatctaatcatcagatatggtttgccctcctttgacctcccctttcactttgtgtggactttgcctatggctcttggcactagcaacctggcattgtagttacttgagtccatgtgtcttatctcccagatagagctaggccctgaactccatgtgggcaactctgcttcttaacttcatgaaccctagggcccagtagagtttctgttacttagtgtatgagacagacagacagacagagacagagagagagagagagaaagaaagaatgcattattttaggttatttaactcccctattttcatgtcaattactttaggtagttagaagtacaaggcatagacttttgagttagaatgggcctttgaaaatccttaaatatttaatgatatttagatactgatgactcaggtatccagaaagttcagctaatttgcctattcctggatcttgcagtttggcctgctgggttatctgaccttgaatgtgtcattcagggagaatgtagcaagtaaccttattagacggtgggtgcctttggtcagaagctggctggttctcctcagcgacctgttttctttttttctgtgtagggccagggctctttgagctatacagtttcctctgtacagagacaaagagtagcaaggtgttagctcacttttaattcttccacttttttcaaacatccttgcttccatgttgatgctagagtatcagacttatttagtgtctattctgtgtattttatgtataaatttgacatttaagaatacagttcacagacactcaaatgtcaatatggtatatctaagcataataacagactgatactgtgttttaaataactgcactgtatcgataagtaaatacatgaaaatatgctgcttatatacgtacactgttactgagtagtatttttctctttgggcatttaggtttcagtcatgtcatgaggtgtcttaccccgtgacattcctccttataggtacaaacagtaagatctgttagatgcttgctagagcatactgatccactatatttgaagagcacaattacatcttccaaatactaagatattctttgccataataataataacttccattgttttctagctactggcatcaggcacgacgccaggtactttaaactcattttctgtaatcatctctactttcagataaatgtgactgagtgatagtaactcaccactgttatcagctagtaaatgtcaggattcagattgagccagttttgtccgccttaagagcttgtactattttctctacattatgataattatactcgtacacttttttgcttttttattttgaaataattatgagctcatagaacttgcaaaaatagaagaggtcctttgtacctattactgagttccccacaataactatatccctttatcaaaaccaggaagtggattggcacaactagactgaccatacttgaattttagcagtatttttcccgcactcactttttgtgtgcttttgtgcacagttctgtagcatttgatcccaggtaaccaccatcaataatcaagacatggaactgttctgtcaccacaaaagaactcgctcgtgctgcccgtttagagtcgcgctatccctcccctcaacctctgcaaccacttctctgggttccctctctacaattttgtcatttcaagcacattatataaaaggaatcatataataccttaccttttaagattggcatttctcagccaagtgtggtggcccacgcctgtaatcccagcactctgggaggctgaggcaggtggatggcttgagcctcagaagttcgagaccagcctgggccacatggtgaaaccccatctctacaaaagtacaaaaattagccaggtgcgatggcatgtacctgtagtcccagctacttgggaggctgaggtgagagggctacctgagcccagggaggttgaggctgtgttgagatcacaccactgcacttcagcctgggtgatggagtgaggtcctgtctcaaaaaaaaaaaaaaagattggcgattttcattccacgtgatgcccttaagattcttccaggttccatgtatccatagttcattcatttttcttgctgagtggtattccatggtatggatgctcgcagccttacactttttgaatttctagataacccatgagctgcatttatattttatgaataactgcttattttctgtattgtattttaatataaaaggccaggagcagtggctcacacatgtaatcccaatactttgagaggccaaggcaggaggattgcttgagcccaggagtttgagaccagcctggacaacatagtgagacccccccaccatctctacaaaaaatacaaaataattagttgggcgtggtggcatgcatctgtggtctcagctactcccagctactcaggaggctgatgtgggaggatcactcgagcccaggagtttgcgaccagcctggacaacatagtaagactctgtctctacaaaaaacttttaaaaaatttggctgggcatggtggctcatgcttataatcctagaactttgggaggccgaggcaggtgtattacctgaggtcaggggtttgagaccagcctggccaacatggcaaaaccccgtctctactaaaaatacaaaaattagccaggcatggtggcacatgcctgtaatcccagctacttgggaggctgaggcaggagaattgcttgaacccaggaggtggaggttgcagtgagctgagatcgtgccactgcactccagcctgggtgacagagtgagactcatctaaaaaaaaaaaaaaattaagtgtggctggtggtgtgtgcctgtggtctcagctacttggaaggctgaggtgggaggatcccttgagcctgggacgtcaaggctgcagtgagccactgtactccagcctgagcaacagagcaagaacttatctcttaaaaaaaaaaaaaaaggggggaaagaaaagaaaaactttgtagccccaaaaggtttttaaggaacaaaaaaccaaataacccttaaaaattttttttctttatttttcaaacttatctatcacaatatgaaagaaaagtttggattaaaaatggtgtagcccttcatgtctttgtccctgtaaatagatatttcatgttattgtagtcaccgtgtgtgttgtatgctgctgtttcccacttaaacttacttttccatgtaccataattattttaaaaactgtatacttgttccagcgagttgactataattttttctaccctgttatctacctctagctccattgaacatcttccttctgttaagtgatagccataagttcttagtagcgaaattattggatcaaagagtaggacaatttttatggcacttttaatgtgtgttttcaggcattgcctcgagtctcaaccctgccctatacttactaaacaagttattgaagctttgaaaaacttaggaaatggggatacttcacctatatcctggaacggttgtgaggataaaatgagatgatgcgtgcaaagcccctaatgtagtacctggcacagaagagaggtatttcctacatggcagctgctgtgatgatctcctggtgatgattgtgctattacttgactaacatgattccatcatgccagcagtcttctagaccacttgcacccagcgttggatagcaaatgatggagaagccttgctgtgcattaaggcccttctgctttgggaaatgcacgcatgccagagacaagcaccatttccagatgcttggtctctagtgggggaatacatatgtgtaaattcgtggtaacaaggcagagtgaagcaagtggttaacagcagtcggaatcaagtgctatggaacttctgaggaaaaagtgatgaattctgcctgatctaattgggaagcaaggcctcattagaggtgatgcttgctgagccaaggcgaaagtcatggggacaattttggtagctgggaaagacagatcattctaggcaaagggaacaccctgagcaaagcaggtggcttgatcgtagatgaagcatctgaagaatgaagaagtttacttagttggagtgcagaatatcgtgggagagaatcccacagaaacaggctggaagtgatatcacggacgtcctggaaatgtgtacctaggagtttagtctttactccagaggcagtgcacaatggcaaatgtttggggatgcattttgattgcataattgactgttttaatgcttgctctgtcatgtgtgatctgtatcatatttttgttcataaagtgctaaaagggccaaggtaaaatcactctgaaagcatatggttgtttttatatgttttttgatgttttaattatactgacagaaatactgactactgtatttttgtccattacaggattcttctctaatacttgatgttcctctgggtgtgatctcgagaattgaaaaaatgggaggcgcgacaagtagaggagaaaattcctatggtctagatattacttgtaaagtaagagattcgatactttcttatgcaaagaacaaggcacgttagtgttgaatgatagtagacaattaatgtggatttgaaaaaaaaaaatcaaaatctcatgttcatctaaggccctggaaatggttcttcccttaagaacaagcttttcaaaagtgcctgggaaatagtgcccacgtgagggacccactgcaatcaccaaatacaaggactcgaggaactggtcagtttgttagcttgactgagtgggaagagaactttatagataaaatttcttaaaccactttagtttttgctccagcttgctcctggcgccccttcatgtcatatgttaacatgaaggaaggaggaatagaagagattttgccctctgttaacgggatgtgtccttacctctaataaccttcgtaacttttgcttaggtcattttcagaggtacactttgctgtgatagtaaccatgtattgaacatttgtgtccatccaaacacatgctaggtgctttgcatttgatcctcaagtgcaaccctctgagatggcgtgatgggagcccgaggctccaaagagttgggtaactttgctaagataatttctgaaggctgggacccaaaaggtggggatgtgttcaagcgtctcgtgtgactatgaaccaccagtccagtgcagggctttgcagactttttctgtgaagggctcagtagcaaatattttaggctttgtgggccacatcagatttctgttgtgtattcttctctgtgtgttgttttttcaacccttttgaagtgttaaaaaaaaaaaaacagtcttaatttgaagacctgggctgaagtttgctggcccctggccaatccaagtcgttcattgtattgatagagaagtgaggcctttgctgtgtgagattacttgccttgtgttgcctagggagccagcggaagagccagaaccaaaaactaagtctcctttttctagtctcatacactgcgatttctcaaaaccaacattgtgtgcttatatttggattatgctgcaatatggtgtttttctttccgtttataaaagatcaagactcgttttttctatcagaaactaaaggataatgccattattaaatcttaactgaaattcaccactaccatccacctcagcttttttttggtggtgttttaattcgagctaccttaatgctttatctattatcccagctactgtctaccctttggggcctagaaacatgggaatttactttgaaggaagacttttgtattttgcataaaaggatttatgggagtagagtgtttaatattagagtgctcaagggaaaatggggttgctatattgacagttttgaggtgactttcattcttacagggtttaaaaaaacctattttctgccttataataggaaaaacttgtacttaaatatcaatccccccaaaattaatgagacaaagcacattttcacccttgactatttacgaacaaaaggcgtaggaacaactcaccaagcataattctgaaatgttacatatgtatattttttggagttagcatgagcccaaaggtgatggcttagaacaatgttgtagcacaaccttttaactaaattgtctccccagaaacactgacgtcacagagtcatattccattttctcagtaacaaacctgacattgatataaaggaaatctgcttcggtgagataaaagactcactgtcctgtctctcataggtcaactttcgcctgcagtcaataaccatgatacaaccgcatttctctcttgaaacaagtagttacaactcctataaatttggctatgccagcaatgcacatagagatttctgcttgccagtagcaactttcccatggtagatacaagtcccagaggatgttgtccagcagcaggagaaaggtagttctgaatatgcaaattcttaccctgcaggccccataccaacccctggtgcctgtgtggagtctttcaaacaaaaaaaagtgaagtaaaaccataccaccacaaagccttctctttccttccccacctcactcccatgtactcgccttaaagacatagtgtggcattttgaagtcagcagtcatgtgtgttgtttctttagaaatgatgcctcaataaatcaactcttcagagtcgttgcagcagggatatgtattcttcaactcttactgtagtgaggcttggaacatcaccatatgacccggctgttaaaaaggctgagggtctgactaggagactcttagcccatgtggatctttccctgatgagtcaaactctgaggagaccaggtggaacttaccagttagtctgtgctcctatttctgttacagatttggtgatctgccgcctgtgagtcatttgccttttctacttcagttttgttggcaagaaataatattctgtctttaattgcatcttaatcagatggcaaaaagaagttacttgaatcacttgtgctttggcacattaaaagtagctgtttgaatcactgatagatcagaataaatattcatgtagagatggtctaatttctggccaagcagtgaagagaacgatgttacagagttaccatctgacttgcggctgttaggaagaaagttcctcacagggcctgagccctgagaatgctcagctctccagtattgcacttgtggctggtcgtaaacccttgtaatgcatatcatcccattgaaatgattattccccttatttaactgttcatttcatcacaaaccaataaccaatagcccaattttcttgggaggtgatatgaatgggttgttggactttattctgtgacatgctttttaaaaaagcatggaatcgtggagctggcaaggcctagtagatgtcatctgtatacagagtgctcaatctcaagttctttattagtggtctcagactttagttcttcatacttcatttgctgctatttgtgtttgagatgtcttgtgaaggccatagcctgtgctggtccttcagactgaagacttgggaagcgttaagagtgctcttgagataaggaaggaaaaagcaccttgaaaaaaaatgaagactgtgatatccaagagggcaacaactaggtctgtaccgctcctgaagtggctccatggtccagcacagcactcctttatctgaaatgaaagtttaaagtgcactgcagagcatagggttccaatgcagagccatcactcagtcacagcactgtaattgacttttttttttaagatacaaccttaaaaaactccagtcttgaaaataagatagaatgttacatctgtatatataatacaaattgacatttaaaggagcttatttggtttggatttggtttaagacaaagttttcctgcttattgaacagatatgtattggaagctacctttaaaatctggttttgactgtttatttttagttcccaaaagtgtagttactactaatatgggctactttaatgtggcttatatggaactctgtgaaggtaaaattgtagaataaaaatatatgacttgcatgagggcttaaaatgtcagtcatttaggaagagagcttctgtattttaatgacatgtttgacaatgttgagattatatttgatagcaggtactctttagaaaagttgtttgaataaaatagttttataattaaaaaaaatatcagggccggatgtggtggcttgacacctgtaatcctggcactttgggaggccgaggcaggcagatcacctgaggtcaggagttcgagaccagcctggccaacatggagaaaccccatctctactaaaaatacaaaaaattagctgggcgtggtggtgcgttctgtagtcccagccactcaggaggctgaggcacgagaatcccttgaacccaggaggtggaggttgcagtgagccgagatcatgccactacactccagcctgggccacagagtgagactatgtctcaaaaactaaattaaataaaataaattttaaaaaatttaaaaatacctcagaacccagtgaaagtagatggatcatcgtagatgttgtgcaaggcaaggtttgatttttttttcctttttataaaatgaattttagctctgtcttctccttagtgctagttgctttatcttgtcttcacattcatggctatgacggaaatattttcaggtgttcttaagccagatataccaaattaccatataaaacaaagcaattttgtaataatttagattaattgcccttttaggtaagtgaatcttctcccttaattgaatggaagatttcttgctaattaacatgactttctttgaagactgaactgtcatacttctcctttgcccccaggacatgagaaacctgaggttcgctttgaaacaggaaggccacagcagaagagatatgtttgagatcctcacgagatacgcgtttcccctggctcacagtctggtaaattccagtgctctcctcagcgtgggaaggttctcagtgcctcctctgtgaaaactgcctgcaaactgggatcctctttcttttaatgtctgtgttgtgtttcccagtgtgatgtgtctgcagaggtgtttattaaataatttcatcatttccagagggaacaggtctctcccctgtcagtcaactttggagctaatgagcaatgagtgtcaggcttttgtggctccaattgtaaatgggaacaaactctctgagcctaaatgccatttgaacaaatacagatgtgtggtgtaggtactgcaccaatagctgaataggggcagttttatttttgaaaagaataacctttcaaatgtcatttgatagcatttattatgtaattgtcaggaccaatttattatgcatttaattagttgtaatctatgacttagtccaaaggtgattcagtatatgtacctaaaacttttccttcctcttcaccaaactactggagtaaccttactcttactgcatgactgaaataaggctttctatgagttttgcttgtagaacaatctttctttatatcctgcctcggccttgcctccttttttactgccgtgccttgcttgaatcttctaaccccagtcctcctcctcagtttgacttgaacttagatgcaaatacctgctaaggggagagtgaaaaaataattatttacaacatatactgtataaatgcctttatcttaagtataggatgatcatattgcagactaaaccgaaggtgatggaagggacccttaagtagaagaggcatgtgttgaacgcagatgaaaatgtaatgcttgggaacaaatgtgctgatctcataattgaatctattttcagccttttctaagtttctgattaaatatgtgatttttaaaaatatgtctatattagagtttttaattctattaggataaaaagagagtctgatgggaacacatcttcttaattattatgaaagtgagaatgtgagtctaattgatgaaagttcaattaggaaatgtgttctgtcttgatttatgcatatctggccctaaattatcagaaattgacagaatggcaggtttgaaggagctgaagccccagtctgtctcctgcaagatcttgcttcatcagacatcccctttctctggtatcttctgtttcttctagggtatactcccctaaaaaagtcaagtgctggaccagctttccccttatactactgtcccatctttcacttcattgccaaacttctggaaagaatattctagcctatcctcgtctccagtgcattcattcctccaacccattccagtatggagctcattactggccaaatctagtggctcatttccatctcattctgtttgatctcttccccagcattcaacaattttgaccatcgtcttcttgaaagtcttggtttctgtattcctgcaccatcttgattgttcctttccagtctccactacctctgtcttttccttaaatgtaaatatgtcttcactctcatccctcttctcttctcatcttattaactttgccttgatggtttcgtttagtttaaagtcgtcactgctatgtagatgacttctaaatctaaccctgatattgtccttgagtgagtccaatgagtctaaccctcaaattccttcctctgggagtctgagaatcatgagctcatctggcgcagtggctcacgcctgtaatcccagcactttgggaggccgaggaggatggatcacttgaggtcaggagttcgagaccatcctggccaacatggtgaaaccctgtcctactaaaaatataaaaatattagctgggtgtagtgctgggcacctgtaatcccagctactcaggagtctgaggcaggacaatcgcttgaacccgggaggcagaggttgcagtgagctgagatcgtgccattgtactccagcctgggtgacaaaagcaaagctccatctcaaaaaaaaaaaaaaaaaaaaagtagaatcacaaacttcttgttgccctgacctctttgcagttcatgaaacctacctttcatcctatatgtcctgcaagtttgaggatccccagttgtttaggtttgataacttgaagtcagcttttcagttccccccctgctattcctcccataggcacatcaattctgaatcctgtaagttctacttagtagcaacacccagctatttcctctcttttctacttatgcttcctaccttaatccatgcttccaaactggcttcctttctttcagtttcttccccttccagctaatcctacacaatgctgccagttgttgtttgttttgtttttaaatatgatcatgttactgtatcatcctctaccccccaaaaaacaaacccccagttacttttcatagcttgtgccctacactgcagctgcacagggctgccctatgctcttctagcacacacagtactttcttggttcagattttgctgtcccctttacctgcagtcccctcgtctcttgcttacccatcttccacacacttagccttcaacatcttaatctgtcctgtgtccttttccaggccatatgtgtgtgcccccagtgagagttcatcttaccgctcaattgttagtctttgcaagttcctctatcagagcacttatctcagtgtgccttatggaataattttgtcataactacctcctacctccccctaccactgcctgataaattatgagcttatcaaggcagggatcagcctttatttctctctctactgtcagcacagtgacatctgcatgggagttttgtaatgatggctttcttcttgaactcgggttagtagaaaggaaggaaaaatcactatatggaaacaaatgagatggatgtttctgagtattacaaatctaacaccaaaacctagaaatctctgttgctgttattggagtcatccacagagggcttgatttctcaagtctgtggtacttggccatatttttcatacctgtgctgagaatccctgcttcttgttttaggaagtcaataaagtaagaaactgccaaaaaaaaaaaaaaaaaagtcaactgaattgctcatatgaagttttggaaggtgacattatcttaggttttaatcactgaaagtcatccttaaaaaaagtttgccagtcaccaatacaatgcaagatacagattgaaacagatcagcccttgaccctgcttttggaatagcagtccctgatattcaagtccacatgtgcaactgtttcatcagtcaagttcatttcatgtcttgtgttgggtggtgtcaggatgcagtgggggcagtcaaggatttagtagtgtgtaggatgagtgatacctagtcccattgagggatgtgacagtcaaacagtagtgatgtgacaaatatgtttagccccaacataagatagtatacattcatttgtgcaagagaaacgcaaaggaaatccacgggggactcacaggaagaagagaccacatctaaccaaaattggaaaggcctacatggaattgatagttgttagtatagggccttgaagaatggatttaatttccagtgaaggacttctgaggtctggggcttgagtgatgagggtggggcactgtccacagagtagggaagtcagaaaaagattttatttgcagaaacaggtggaagaaaggggaagggggaggaacaatgagttctgttttggacacatagcatttcatgtattttgacagaattgacagcaagccactgaaggcctgcccctcagtaaagagtctagagatatagatttggaatagtggttcttaagtcatttgaagttatgggctcctttgagaatacgatgtaaattatagtttcttttcccctcaaacatgcagtcatgtacaaaaccttacctaaaattttagaggacttctggcccctctgaagcccctttgtagggccctggtaaagtaatcctggtatgtaatagagaagtcctgaaccagaatcttgggagaggccatcttttagggagtgaagataggaaaggagccagaaaacggaatggttacagaggcgagggaagagcctggaaaggattaacaggatgtcatgggtgtcagtgctgggagagctggggagatggatcacaagctccctagggacctgaccctaactgacctgcttaaagtcgggacctccttttattatctttgcaactctagtgcctagtccagtgcctggcatacgtttttgttttttggggttttttttctttttgagcctttataaatctcagaaaatgatctcggggtgacggggacaaacaccagtttgcaggtgtttaaaggaagcatagttggtttaaaaaagagtggcaggcatgttgagggaagaaagtttttaccttagaatttgaaaaaggaaaatgaatatatttgtggaaagaaatcttgcctcttttcaaggcaagagagagaagggatcttttcttgagcaggatcctgaagaaggcagagggggatgggatccagcccagtttgtggggcagtttgggaaaggagaagggaccattatttctgtgagacaggaggggaagaaaagtttccaaactgtcacagtggggaatgtgggagtgtgccaaaaagggctttcctaggaggtaacataagcctgattgccttgaacaatacaaagggcccctgcttgaaaaagatcactttgttaatattattggaactgttcagccagctgcagattatcttagtgatttttattggcatttgaagtcagaagtgaacttgctgttgcatctatgaaatggtgtctggaggccaagcaagctgggtcctgactccgaccaggtcatgaatacaccatgagtgggctttttcatttcagaccacccctttggctctctctggcctcctgtcccattagtattttcaccactcagtgttttcaagtcacgacttaacactttgaattgaacttgagctgttcagcaacagagttcaccccaaaccattaacttcattgtttctgtgttatgtcaatctggtaagatgcgcactttttttagtaacatttctattttggccaaaaatagaaatttattcatttattttctttttaaaaatctatttgctttgcttttcaaacactagaaattgtactgaattctcataaattgcatgaagctcaatactagttctaggtaaatgatatattttaataaatgtcagtgtttctgatagtatggcgatttttttaaggcagaaattaaaatcatgtataactgaacagagcctgatagtgctacagaaagataaagagtttgattgttggggtgataagttcaatggcaaagttgttcttttgttgattttctttattgtttgctcattttttactcagatgggataatcagagataatacacatattagatgagagttttttaaactgtcaatcctaacctattaatgagtcataaaatcaattcactaggttgcagccagcattttaaaatagaatagaatagaataagagcataacataatatggataagtgtggctacgtgaaacatttctctccggtgtatgtgtgtattgggtcatggtgttgaagtgcattgcttaccgttaatcgtggtccaaaaagtttgaaaaacaccattttaggtaatggtagaatatgtagaataaactgcactttaagttattgtaggcgtgaatatagtcacttaaatctgcctttatagcagtaggcgcacatggattttcttgaattttaagtgaaggtttagagtttatgaataaacttgtgggatatagactcacacaaaggaaggctagggctagaagaaatgaagcctgagacctgggtgccaggctcatagcagccactgatggggagaccctgtgaggggacacgtttgcagagcctttctggtgtgtggtaacaagcatgtgccattggagtccagtggtctatgtctgaatccagctcagtcacttacctgcttggtgaccttggaagtcacataatgtttatgtgcttctgtgttctcatctgtaatggagataataacagtctctaccccgttggggttttgtgaggattaaatgtaaagtgcttacgacgctgcctggcacgcagtaagtacccaataaatgtcagttctgttcttagtgtgccgttttcccagcaggtgtagagaataaggatgactacccagcacacttttgcccaagactattaataaagtaatcgtgataacatgtggggcactttaagctctttcaaagaaagatgctatatatagattagtattcttattaacaaaccattggttgtaccttgagaaaagactctttgaaagtcagagcataatatccagaaagcatgtgacctagaagggtgagatacggggggcagtgatatgtatgaaaagaattctttagaaatggttttccatgtttttctttccatcttttgaccctgctcaggcttactgcttttagggaaacatggctcattcaggtttttgtttttgcacttgccgctttcctttcacattctgcatgaagctctttcgcatcaaaatatttctgttattctgtgaactgattagcagtcatatagttgcgaaatttttgttttcgtgtgtgtggtgggagatatttgaccttcttatgtcagtcagaaaagacacaggtgaggtaacttgctcttggtaactctaatttcaggagagaagcagctgggttgcacagcctttgctgtggagaccagcagccttctgaggactgctggtgtagtacattagattgcatgcaaaggatggaagcaaggtcttccagacagcagcacctttgtgagcagggctcatcagcatttgcaggtgtttgttacagccgcctttggttttcatagtctttgctgcttatttctttttgcctagctttggtgaaccacatcaagccctgccgtgtggcttaaacactaccatatctaccccatgtcctctcttgctctactccagttgtgcttacttgtaaaaagattttcataaaagttagtagagtgcgttatggaggtatatatcttttatgatcatttgaatgacaggtataaatgatcctatcaatggagaattaacataggatttttttgttattgttgtttttgttttttgagacggagtcttgctctgtcacccaggctggagtgcagtggcatgatctcggctcactgcaaccttcgcctccccagttgaagcgcttctcctgcctcagcctcctgagtagctgggactacaggtgctcaccaccacgcccgactaatttttgtatttttagtagagacggggtttcaccatgttaagatggtctcaatctcttgaccttgtgatccgcccgcctcagcctcccaaagtgctgggattacaggtgtgagccactgcgtccagccaacataggatgttttattttgtgcctcagaaatgtggaaatttttataaattgctttgcaattttaaacgaggcttaaatttagtggacccttactttctgggctgattatggaattaatagataaaaagaaacaactcattttcagagggacactgaaatgaagtacacacacacatgcttttagcctacatgtggcctaatgactaaaagttatgtcttagttatctgtttcctttttgggcaggactgttttttcttgaatcaacagtaaacttggcaaattgacacactagttatgcttttaagtctccttccttcctgcctcctctaagacttggtcctctattctcgttgatctctctgtctccaccaccttctccctctcagccttgaaatgtgcttggttcttctccctattgcctgtcctctggaactgacatttcacctggtctcctgtagcattgttgtctatggtcagaagcgtagaattccccgctcgcatccattcactccataactcattgcaatcagtcgtctagcccgctcactggagtggaatgattcttctgaaaatgaccgaagaccctacaagttagaaaacttggtagtctgttagaccatatgcctttcaactgcaccatcgtttgactgtcaactatcccaccccttccttgcaaagtggtgcttttaaaatattgagtagatacaagaggatatttataaaatatgtataaaatctaaagaatgctgattgatggaactttcctttgtctctcctgagatgtaagctgggtaatttcttcagttttatcttctacttcggctgtgcctgatctgagtttttgtttgctaaaatttccattgttatgtttttttaattataaaagttctatttgattgtttttcagatctgtttggccattatttataatctcttcttctgtgctcagatttctcatcctctttttgacttccgaaagcacattaaatgtaatttataatatgcatctgatgattacaatacccgaagtctttgtggacttttctaccacaggtgtgtgtgtttgctggctcatggcactttgtttctgatgtgggtgtgtcttgtgattattgcctgcaaattcctcttccttggaagtttatctgtgggaatactctgagcatatgactgaaggcaattttaccaagagaggatttgtgtttctttctgccaggcatcttgaagcatgactggtttgggacgcttatgaattaaattctcaggttggatgtttttgggaccatccaagttttgtgagtttcgtccacatactacttaagggctgacttgtgactacaaatttctagtgggggatggtggcagggatttgtttcctcccttgcttagcaccaataatctagacaggaaggttctcttgaagtccccaggtggtcctttcccatgcatccttcccctgagtgtagcacttgggaggtttcctcattttggtttggccaggtcttcaggccctatctcctgtgccccaagaggccatgaaaaccagttctggaagtggcctgaaagtgaaagccagtgtgttcctcttgctgtctgcattcctgtttgcagttagtttttggcttctgagtaaaaaagtctctgttatatccagcatttttaggtgttttcagcagaagtcccattatggtataaagaccatcacatttgcagacacctctccctcttttttttgaaacctaactttccccatagcttctgagatctaagtcctctgcctctcacttcttttctggctcctctgcatccttctaccatctagacatgggttttctacaaaagtctgtccttgctctgaattatgccctgggcaaactcatgtccacgaacagtgcctttctaagcatggcttccaaatataaagcatggctttatatttccctgtagctgttatagaacttcaagcaacaccaaaagatctgtttaaaatgactctcatatgccccagaaacccactcctctgtgttcccagttactcttaatgatatcattgtcctcttgttcattcaaatttgaacattcgaaatcaaggccatcagaggttttcatttcttccttttcttgttttctttttttttttttgagacagggtcttgctctgtcacccagggtggagtgcagtggtgtgatcacagctcaccgcagcccgcaggtgcatgactctacacctggctaatttatttttcttttcttttagatggtgtctcactgtgttgcccaggctgacctcaaactcttgacttcaagaaatcctactgcctctgccccctaaagtgctgggattacaggcatgagccaccatacctggcccctgtttcgtagcatgtactaaatccaggggattctgcctccccagcctgacttaattcatatcttcatctcctctcttctaaactgttggaacattgttaggaggtctttctacctccattctgtctcctatcccttgcccgcaaacttcaaccagttcctccctctctgtcagtgtgaaggcagacctctgtctctttcacagtgtggcccacctctctccgttgtttgttatccgtcttcactcagtggagttgagtgtagactgagatgttcgccagtggccatatattctctgagtttggctgccatttgtgcctttttgttgtcgtcttgtccagagttgtcttatccttccagggtagttcagataccaacaacgtccctccaagccccatctgtcaagaagttatctgggcattctctgggcctcatagtactttctctctcccacctgtggcacttgctgctatcctctctatatgccctcctcatctctctcctttggatgacttccaactccttaaaaacagaggctgtgtcttccttgcctttttctccacttcataccttgttcatagtagagcctcagtaaatgtttatcgagtgaatatactaatgtaaacagagcgaattaatcggaatcagtagcaaccaagacatcaatgagaatattctgctttttagaaatagcatttattcaataaatatttactttttaatttaagttgtaaataggtaatatatgttcatgattgacaattcaggaactgtaaaagggtatacaggaaaaaatctccctcccggcacacttcagctacctcattgccctcctcatagacaacccaggtttcagtttattgtgtctccacccagtgatagtttaggcctatacacttaactgattcacatgccttcccccttaaccctaatggtagagagctatatacactgtcatgtacctatttccatccaccaatagacattgcccagtgaatgtgcttctccaccctatgatcttcattccatgtactaccttaattcctcattgccatatatggtaacgtaacacaggtttgagggattaggacatggacatctttgggaagacattcttcttcttatttttttaaacagagtcttgctctgttgcccaggctggagtgcagtggcacaatctcagctcactgcaacctccgcctcccgggttcaagcgattttcgtgcctcagcctcccaagtagctgagattatagcgtgggccaccacacccggctaatttttatatttttagtagagatggggtttcgccatgttggccaggctgatcttgaacccctgacctcagaggtgatctgccctcctcagcctcccaacatgctgggattacaggcatgaggcccagccctggctgggaggtctttattctgcttaccatagcaacccagtatgttttctgatcttttaatctttttcaatctaataggtgaaaatgtagcttccagttttattttgcatttatcttgtatgagtaaaattgaatatctttaggtttgagctatttgtatttgcatttctccattctctgtatcttctacctattttttgtttggatgtttggtctttttcttgttagttgtacgtactttttgtgtaatagctatagtgatgtttaatatgagtgactaatatttttcctgtatgttttttgactttatgatggattttgctatggagacttgttttctatttatttggtagcatttgagagtctgtgttgaggggctctaaaaccacccccacgtgtggtgattcgataacaggactcactggactcatattgtactcacaggtatggcttattacagcacaaggatacaaaacaaaaccagcaaagagaaaaggcacataggttgaaattcgggggaaaccaggcacaggcttccagagttcttgtccagtggaatcaaacaggatgcacttaattcctccagcaatgagttgtgcagcacatatgagatgttgcccacctgggaagttcattggagactttgtgtccacagtgtttattggggctggccatgtaagcacccactgcctagcacaagcaaaattccaggcttccagaagaaaagcaggagttcagtgtaaaccacattgtttatacaaacagtttgggcacagtgaaccaatcttaccagtgagggaatggtgagaactctgctgaaatccagattaccaagtgtctggcaagggccaaccatgtatgcaggcctttctaaggagggcagcctcaggcctgccatgttaattcttctgcacacttttcttttatagcttctgagctttctatcccaattaggaagatcttccctactcagacttataaggaattatctcagccaggcgtggtgagtcacgccttgcaatcccagcactttgggaagtcgaggcaggcagatcacctgaggtcagggattcgagaccagcctggccaacatggtgaaaccctgtctctactaaaaatacaaaaattagctgggtgtggtggcacatgcctataattccagctactcacgaggctgaggcacgagaattgcttgaacctgggaggcagaatttgtagtgagccgagattgctccactgcactccagccggggcgacagaatgagtgagactccatctccaaaaaaaaaaaaaaaaaaaaaaaaacaaataaaataaattatctcatattcctctagtaatttggtttcttccttaagatttaagtatttcatctatttggaatttatttggagttaaagtataagatatgaatccaactctttcttcccctcttgttgcaatatcatttgttgactagtttgctgatttgaagtactgtccttatctcacactaaattcctctgcatgtttgattttatttctaagaggttctcgttgcattaattattctattcatgcaccaggtgtgctcttttaactattgaagctgtataagatgttgcactgtatggtagaacgagcctccccttgttcctcttctttttcttttcctttctattgttgcttaagcaattacagaatgctacattatggctgtgctcagggatctagagctgatacccacttcctgttcccaaggagtgctgttttcctgggtaatgcaaacaaacagatgcatatgatacagtggtgcacaggatgtcacaggagcacaaaggagggcttcctagaggattcagattctgcaagatgagtaggagcatttgtcaggcagaaattgacatgtcatactgaaggaacagtctgtgggcatgcaaagaggccgcacagatgcaggctgaactcacatgcagtttggtgtccgggagcacagcgtgcatgtgggggtaccaacaggagatagtgctgggggcagaggaggctgggtcaaagattgcagagcctaacattccccactcagaatgtctgctttttatctgaaggtgaagggagccatttaatggttttaagcaggaacgtggcatgattaaatttccatttcaaaaagattgctgggctgcagtgtgtgcagagtaggtggaggggacgggagtggaggagagaggaagaccatttctggggatttttgctagtcaccccagtccttgatgatgagggcttgaagtggggcaatggacagggactccagatgatgcttttgagaaagattcagatggtaaaatcagtagaatttggtggttgactgaatgtagttatgagggaggatgggatgatagggaagaatccaccctggataaccagaccgatggtggggccagtggttgagatggggaacataggaggggagtgaggaagaggtggcaagttccattttggttatgttgagttgagagtgtctgtgagacagccaggcagagatacctaggagacagatgaccacatagatccagagctctggcctggggagagctttatttggtactcctggatcacatccacatcacatcactagcattttcatagatgtggccaaaattgccaggagagagaactacagtgagaagagggacaatgtatgaaccctcagaaatctcagccttaaatgattatgatagtggacaagttgtaaagaatattcttttttccaaaatagtttcaaatgacatttcaaatgtacatttgtggtcctttcgtgaacaaataaataggtacgtttatatatgaagacaatgatgacacaggaatatcaagccatttccccgagaggtactgatttagtcagtagtagaaataggattaggagaactgtttatgcaaacagaagtataattggtaatctatgtgctagctgcttttgacctgttatcttttgtcaggtttttggaataactgcgtcaaaactgatataaatgaacttactgtgtcaagtcgtgtgaaatatacagaaagcattatctagcattagggcattagaattataaactttaccacatatcagtacgtcctatggttctttaaaattttaggctttcccctccaattttaatgaaagcatttttttcttacatgatcaagtcttgtttctaaagtttaaaagatgaaaatgaggtaattttacattactgtacccttaaatggtagatggaagctttttaaaaagatgagtgtctttaatttcagaaatcaaattcaaaaaaaaaaaaagctagcttcaattcctgttcaaacgttgcaaaatttaatccagaaagaagcagttgggccagatgccgtggctcacgcctgtaagccaagcactttgaaaggccaaggtgggtagattgcctgagctcaggagttcaaggccagcctgggcaacatggtgaaaccctgtgtctactaaaatacaaaaaaaaattagctgggcgtggtgatgtgtgcctgtagtcccagctactctggaggctgaggcacgagaattgcttgaacccaggaggcggaggttgcagtgagccaagatggcaccactgcactccagcgtgggcgatagagccaggactctgtctcaaaaacaaaaagaagcagttagtaagtggttccctgaagttttaagtttaggtatttggagacataggtcattaagagtcatcttcctgaaaaatcacattcatcagttgtgccattgggtgctgttaacatcatttgaaaacacttttaaatgttcatagtttatcaatttattcccctgattatgagctggagagagcctatgacagtgacagacagctgtccgtcctcaaaggaaactcaagaattaacatttatagattctgtttaaataaacaaaaaatccaatctagatgttttaaggaaatcagtgcatctttatataggtgccatttaaaaataatggctaattaagtgaaagctaaaatctgttgtcatttcagagactttacccccacaagttacaatgataaatgtagctaaattaaaatgacaagttatattccctatgtcagagctgtttttatccctggtgtgaaatcagagagtttcatctcaagtttgtcctttaacatttttcaaatgttacattgtgctatttttaatccggaaacaatgcacatgattgctttaaaaaaaaaaagtctccatgtacagtatctcttgactagtacggatctagtgaattgtgaattgatgaaatgcccaaatactaatatagagcaaaattaaggaagacatgacttgctcacttgaggaaggtgagggtggccatttgagagtatcttctgtcagtttcctgattttgatattgtgctaaaagttatacaagatgttaacacctggagaggctggctgaagatttacttcttgtgaatctataattatttcaaaataatctaaaacaaactaaagtagctccccaacagcttgaccacacagaatccttaggctacattcctgagagttctggtacatcccacatggcccttctaggaccaaggaggtagaaagtcaccccctagagattctgattcagtaggggtgaggcagggcacagggcatggtttagcctctggaaaaagcagcccacttcacccccaattctgaggcagagccgtagataaggaccacaccctagaagaaagccacgtaggacttgctgaagcatctactgaaaggtgatgctcagcaaaacatcttctctgtcctaagactttgctcaattgggactgaatcgttcttgaattttccatagtcgatgaaatcagtacttggacgtgttcattgagtaagctttatcattacccatttagcaaacaagacgcgcttgatggttatagtggaaaatacttgagagccagctctctccatgtgatttagagttcccaaattaagggtcaaaattgacccaaggttatatttaagaataatagttgaaagtgtcaacacattaataaagtgttaaagaatacattgtctggaagagaaagtaaatgacagctaaaaacctcaagacgtataacctattcacttcaggttttaacaattttgaaataggagctttaattaggcttgtaacaagttaccacttgtaggggattttatgctttttgataatgaggtacagatgaatgtgttttgttattgctttatttttgtttttgtaataatccaactttatgttactctgagagcctatattctcttaatctttaagaaaaaaagaaaatatatctgaaaagtaggtcctcgtactttcaagttcagaaaatggtggtattggctctttcagactgctcacttcaattgagccaagtagcttatggaaaacttagtttttaaataaaaacaccacataaacactacctagtaatgctttttgaaaaatgtttttctgtgtttgtaagctaatttatttgaatggtgaaaatattggtttaagcacccagtcttttctaccctaagctccaatttaatattagatgtgttgctatgtgcttcacgaggagaaatatttggctgttgtgcgattcataattcttcctgaaatatctggggtccaagcctggctcttagcatcaagagtaaactgggagttgtttttgtcaccaattctaatagacatgtttcgggttaaaggataccagttagttgactcattctggatattagtcagaatgtgaagtatcatcatagaagtgatctcatcagagagtccatctgatgtgtggttaccatggggacattgtctcagtctcatactaatgacaaaaaaaaattgatgttgcttctgttcaggttcttttataaaacatattaaggaagttaggtagataatttttgtttaggccatatagctttgattttctgataacaattttataaacttagaaattttcatgtaagatacaggaatactggaagcaaaaaaaagaaggtgctttaaccttagggattgaaaaaatagtaatttaggttgaaaatgctgcttgaaagttaatgctgatagcattactacacatgatgattttttctggaaggaaagctttatctgggccttcaatttaggaatttttctctttggtttttaaaagctgccatattcacttgagcttcatgggaaagatgcaaataactaaaacaaatgaacaaaaaccatgttgaggtcaggaacttatttcaagaaagcaagttctaggttttcttttaaagtgacagtagagccttaggcctcaaaccatctacaaccatgttaacagtacatcactcaaatcattcaacattcctgaatgtttacctgtgccaagtactgaccagcgcagtatcagatgttcacagtaatgatatattgccaagagaatgcttaggcatgtcccatatattctgtttatggataaaggagtgcaccaaacattttagtgctattttcgcccaaagtccctctgtctttaatttaaacttaacagaaatcacttatttttcccagtggtactgaataattatgcattgctgtggattcagtgtcaggttaaagcctcagtgcatcgcttagctaggtcagcatcattaccagtgtgtgcttatcatgccagccatccagaataaacagcacttgggcctagcgctgccagagttgagacctgcagagtgtgctgcatgcctgggaaagtttgagaagacattgtggagagcatgttcttgggcagttttcaccttaaacctcttgccattcacatgcagaaaactgttgctgctgaaagatgcttttccagaaatacactgtgttgtaggggagggaacactggtgttcaaagtgattagtctgatgacagaggaaaatggttggggagggagctacatagaggaaaagtgcccagacgcagcgcctccagagaagatggttgtacaggggctgtgtgggccttcatgtcttcattcggtcagcgagcctgtgttctgcctccctctgaccaggcgccattgtagttactggggataaaggatgggaatgaagcaagtgtgtactttcatggagcccatgtcctaggggaggggatagtacatatgtacagtgaacaagtacatatgtaatatgtcaaatggtcataagtgatagggaaaatcagatgggaatagggagtgctgttgtgagggtaacatgtttttttgtagggtgtcggagaaggtcttactgattaagattattggatcagagatgtgagagaagacaagaagccatgaggtaaacgaattccaggcagatggaatagtagccgcaaaggccctgagagtggcatgtgcttggtgcctttagggagtggcacaggaggcaggtgtgacttacgtggagcgagtgagtctgagagcagagatgtggcgggggagatggccagatggcagacagctgcataagccattggaaggacttccacctttactcctcgcaaagtggaaagctacgggaggatttggggcaaggaaaggacttgatctgacctatgacactgtcactctgacttgagaagtacaaagatgaaagcaggggagcagttaggtttttataatcaaccaagtaagagatgatggtggcttggacctgggtggtagccacgtggtgacaaagatgaatccaaggttttcagctcaatcagctggaagtcatgtactgaaatggggagactgtgggaagagcaggactgggtagggggagccaagagtgtttggctttggttgtgttaacttgagagttcttcagatgcctcttaggcagtctggtggggtggtagagtggacacttggatagccaagtctggaattcagaggggatgctggagaatgataggtccttactagtcactagagtatggatggtatttgaagctatcaaatgtatcaacagcacgttgagggtgagtatatatagagaagaggtgagaggtctgagtcctgccatttcacagaaaccagggcattgattcagaattcacagagaacagttagctcagagttttcttaatatcctatctttttaaaaaataaacatgtcattgttcccttttgagacagttgcaccgtttaacaataattcctgaattttatttttcttcctttccttctttctttttagtggcttgtacctgatcaattgctaatactgtttaaaattgataggcactttttggtctggtaatctgatttttttgtggaacatcattaaaagaacaattgagagatttatagccatagaaaattgaggcttctattactcaagatagaagttagcgtaagtctgatctgagttttccactgtttttttttgttgttgttgttataagccttggtgtgggttgtaatttcatggtcggcaaatctggtgaaatttattttgcgagaaatcaaaagatgtactataatagtagactgttccttcacgctgaactttatttattttttgccttttctagccattatttgcatttttaaatgaagaaaagtttaacgtggatggatggacagtttacaatccagtggaagaatacaggaggcaggtaagatgttagatgctattgtctggtatgtgatgaacctgaaacatgcattatgacagtatgtcatcagccatgctttctgaaaatcagcgacatccttgctaaatatcttttcaatggtggtgatattatccacattttgtacaatatatctcattctatctattactgtataacttataagctcattccattgccatatgcaagctgcatcgaagactgggtcactaaatcctatttccttccctatatgaagagcatcaattctgtgttgtttatgaaatgaattaaatacttaggatttagaaaagtcaaacattttagaagttacactttaggacttgatattgctatgtatatgcatgtttgggagcttaactattacctgcagttagatttaaattatattcatttcagtttgcagattcaaatgaattagaactgttttcctgtagtgatgtctttttcaaggaagctttgataagtgtacattataattgtctttactgttctcttatatgaatgtcacctacatgcatgtttatttgctataataaaggcaagaggcttggtctcatattgctgttcaggaacaaaagtctcttgcagtatttttgttaagggaattctgtgcataatatgtaacaagagccacagtttgacctctggtataaccaaatctgtaggcagctaggagttgtgtgatgggattattcacaattcttgttctacaaagctcttaagataattgaaaagttttgttgaatgagatttgagaatcagatcaaacccatttgctttatatgaaaaggtagtgaatataaagtaaaatcgtagaaccctagacttgagaagaaccatctagtcaccaccttcaccatgaaaaacctggattggtttccttttttagtcttaatcaacggtttgcatattcatgaacagatttgacgctctggaatttgggtgcaggagtttagctttagaacatatgtgacatagtatatcctgttgcttccataagtcacgtttagactgttgagttttctaaggctttgcactactcccattttaatggcctcagttctggactagctactgaggcggaagaaggaccatgaaaacattttgcatgttttggagacctctgtaaatgatgtattaaaatatttttaccttctttttgaagtattactgataacattaagacttttttttagttcaaagcttctagcttgaaacaaaacagttcctgtttttaagattgcatgcatatatgaactgttgaaggtattttgttctagactgccattatattcaatctttttttcttataactttctgatgggacttataactgtctaattggactcagcatcagactcaacatctgtttggtccgtggtctctagggccagacctaaagaaaaggtacaatgtctgtccccaaagcaaacacccacatagctcacttttgtgtgtgtatctgtgcatttgtgagaatggggagagaatattccaccacctctggatcttttccatactaaatacaattttgtgggggagatgataggatgggaggtgtcttctgtgtctccctgtcacattagcagtctgcttaaaatgcaaatgactgtatttctcacacaaactatagggcaatcatcgattccgaacaacttgattgaaaaaaaactcatcggaggtggcgaaatgagcctccccagagggatcttcctttacttcccctcatgattttcttcatgagctcagcctctttccactttggagcagactgaagcattcactctattttgagcagggagaggaagttgcctgatctcttttctaccctcagttagagccagattaagatgaagcagggtatttttttaggggatgggaggggtgcatgggcgggggatgaacttgggtttatctgtgtggtacaggtagtaaagaatatgtggacacaaaataaaggaagacgaattcctttgaattcaagagaatctgtatttacaaagtatagtttagaactgtaaaaaccaccagtgttttgtcttgtgttcttacgttgtctggattattgatttggcacccttattataaataggtagaccgtcatcaccctgtggtcaaagaggcatgtgcacatattgctagaaggaagaaaagaggcccaaggccaaatccagagatgaggtcaagcaatactgacttgaatttctttttttcctcacagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgagtactgcaattaacgtttctcttgaagagcaccttttagtccataagaatggtagtcatataacttagagaaacggtccttttggaattctatcccaaaaaatacttactaagtgctttgtgagtacaaagtaccataccagactggagaagaagtgtgccgtcacctgccttctaggagcttgcaactaaggatcaagaatgaacgcaagtaaagagctctctacgagagaggggctgcaagtaatgggaaccaagtgctgtgtggaaggaagcaaggaaagacaggctctttgtggcttttgtctttgtggcacagtacatgatactatatgataggctcttgataaatgtcagataaatcatgctggaaagaacacactgtcttgttataaaatgtgtcagcacagactttgacatacactcaccacgagctcacccccatcacctttgcaggctgccccaataccattgtctaactggagtcaagtatagattattccagacactatccatacggtatcactgcacctagttcacaaagctctcttttggtccttaaatattaatggacatgtgatactatctaacattgacaaaaattgactaaaaatttaggtattctcccctgctaattttcagggtctgtcataagtaccttggggttttttttttcccctaataagtaaatgtttaaaaacaaaggttgaagaaattaagacttaatgtcaccttgcctttttcaagtctagacattttttttccttaaaaggatatttgtgcaaaacttttgtattgtcagcctaatatgaattgtaattttttttaattcacttgttatacacttctagccataaaaccgcagaagtgatgctgtgttctcagtgcaccaccttaggagacatgctgttgatttgtcccgttattagtgatgttaactgtgattattctgctaaggcagtgtctgtcatgtttttccactatagcactactattttacccattaaaattaataaatgctttatgtaatgatttttttaattcacttgcttctccagttagtagtgtctgttcatatcttcgcgatataaattgtacttgaaagtatgttctttagctcatgttgttagaacatgatgctaatgaagctagggttacaagttcagtcttcctgtgctctgtttggacatgctcttctgtaccatagccacagactacacccctaccctggctggctgtctgtcttgctaatgcatgccttgctcacaaggacaactgggctagggtagcctggctcagttttgttcatgtattcattcagttcatatttattgagcatctaccgtgtcatttgtgtatgtgggtgaattctatgggatttgaaacagagaaaattgaacaactgtgccctttctaccatgcttggttgccatcttgatccagtagtccccattattctgaatgaatgagtgtctactgtagagcagatagaatttcttaactttttatttagtcatgttattgatccttcttactttatcatggccaccaatttgtatttattttttctaaaatggcttttatagggaagactaagttccccatcacctctacatatttatagatttactattaggtactattaagcgtggtaatatgttctttgcagtatgctttctaaccacccggctgttggctaagtctcagagctttgcttccacccagaaaacatatgtgcctttaatgtgaaatcattaatatctgatagttggttctttttataaaacctcatgtaaaaatacaaaaggaagtgacatgaaagagatcttattttgcatgtaaataagatataaactataataaaatattgctgggtagagaaataatcaatgtgcattaaatgtttccattaatggatatgtattctcttattctcaaacagatttctcttaattttatgagtctttaatgtatgagtaatgcacgttcattttaagcattataaaaaatactgataagcaaaaaggagtctgccacctagtgagaaccagtgttaacactgttggtatatatcctttcagacttccttctaagcatatatctacacacacacacacatatgtatatatatttgaaaaaagtgaaattattctataatttgtgtctcagtctatagaaattattctataatttgtgtctttatctagcaatatcttgtaaacaacttcccatgttgctaaatatgatccgctcatatgccagtgtgtagatgtaccatgatttaatcagttttccattgtgagacattcagcttctgcttaatcttttgctattgtaagtaatgctgtaataaacatctttcagtggttagatatttgtgtacttaattatctatggcttctagatatgaattttaataagaataatacagtgccatatactgtaaaagcactcatggtagttgacactgtgaaatgaacattatttgtacctgtttagctctgtaataagcatccttttcaaaaagtagtaagaatcccccctcctgcaaagaaattaagaggagaaacaactcagaggagtagcatttcctaacatggcaccacaaagagaataggggtcgggaggccattgcctatggcccgactgaaatttacaacttgatgagggtctttctcaataataaataatttttatttttaataatttctcaaattattaaaataataaaaaatattaaaaaatattttaataatttctcaaataataaatcttttaaatgtgtagcaaattgctcctttaaagtggtctcatgtctcttgtctctcttgataccagggccatagagggaaaggaaggcagatctcatatgtgctgtgcattatagattggaaggtggaggtttaggtcccactggtaccttctccaaggctcccagttctgagcctttggactcttattaggcaggggctacaatggtgtttttaattgatctctagcatggtgcaaggaccatatttgttctgagaatgaataaatattactgtataatcttttctcaataacctgttgtcattataaacactcatttttataaacatcaatgtttgtcatttgccatcatggggtaggtaacttcagagacatcagggaatttggtgttatgttgagtgagcccacatgattaagcttctttcgttctttgtatctgcattttgtagtttttgctaactgactttcctggctgctgggcctgcctctataagctaacacgagccagtgtttattgcagactttctgggcattcttcttcaggccaccgagcaaccctatgagattatattattctccccattttatggaagaggaaagggaagccagagaagctgcgagtgaaatgcctgaggttagaaccacggcagagatggcactagaccccaaagtccacattgtcgcccactgtgctgcagttctccagcttcccatttttaatagctttattgagatctacttcacataccaaacaatttcccatctcaagtgtacaattctgtcgtttttggtatattacattattagctaccttttacgtgtattacttttcacatgctatgagcttggcaaccagggagcaaatgtgctagacttgtgtataaagttagagaagataggttctgaatcagggcttgatgaggtctcctaggcattggatgtccacactgcactgtggagacgagcagatctatgctctttgggctgtcctgagatcagttttgctctgctcaggttttcttccttcctgtgttagattctagaattgagactgttgggaaaatgatctgtagacagagttggtattatgagaaacatattgtaccagagacaatttcctttacctctcactttttgccaaagctgcttctatatgataacaaatccagtgcaagctacataattaaaataggatcaagctttcaatttcctttaagtgatataactatttttaggtaagcaattaatttatattggatgtggtgctaattaagaaaagactggtaattgtacttgtttctgagttatattattaaatgcatgtctctgggcacacacacgcagtgagattgcaagtgaacaagtattctattttagcacaatcagattcacttcttgataaccgtcagtgctttactgttttacagttttaattgtttgcttggagatttgctttcttgatagcttaaactttctgacttaaccataggtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggtgagtggacttaatgatgtgctggacacttagcttacatatggagtgcagtgttttctgtgaatgtttttgccatgatatagaaacacgtgggtttaaattaatagttaagaaaaccagttctcttagacagaaagtagttttaatcacaaaacttaaacaaaattgaatatatcaaaatcaaatgcaaataaactttaggtaaataggcatgtctagactgtaatgaaattgggttttggccaggaccttggcaggaaaaagttagattctctttaaagccctttcagctgtggatgatcactcattgtgtacactattggggcatctgtaagaagctatgggaagctgtaattattaaaatactaaatttgcatgcttactcaaacactccctcccccatacccgtatatactcacatatgtgtattctcatttacataagataattcaagaaatgagtaggtccacgtatgtgagttttccaggcacaaacatatacacaaagttgaccgttttcaaagaagtctgtctcaattgactttttgctgtaagcagaatatgctgaatgcacttaaaattgattagggtcatcatgaacatcagtgactgcatagtgttgccttcagaagctgctgcaaggtgtatggctgtttgcttgctctactaaatggccccagattgatgtgcattttacgttctatttctcctttttgttgtttttcttttccttctcctcccatcattgctgtcactttcaaatgctcacgaggggcctgccccaaattgctcactcccattccagctttcagatttattgtttctcctctgctgtaagcttaaatttcatcatatttaatacattgcttatcctgaggttatttgtctagcatcttcaattattcagaacataagacaagaaccagaaagcaaaacaagttcttgagcagctcagataggtgcagcagcttcctaatagaatctgtgatatctgtctggactaggatgtgtcagactgcatgcatgcagagctcaactcttcattatttgtgcacagatcttctgtcctacacatttaatcctgggccacctccccatccccatgcatgcttttaaaccagctatttgttactacggttgttttttggtccagagatgattttgaaattatatgtgaagcagtcagtaagttaaattgacaagtaaattaggaatcgtaagtgaaacactcaggaaattaaatctaactctaaatatcttcttggattgtccttaattttatatatctgtgtacctattatctttcatatatatttcagggtgaatatatatatatatatatatatatatatatatatagcaatattttcatgtacatatttagcctgaaatagatatgatatagcattacaatgaagtatttacaaagaatattttagaatattaaaatgcatgaaatggatacactaattaaagctcattccagcaacagaattcctgaaggcctttttaacactcaggaaacaagcttctatttctagtcctcttaggagtcgagggaaggaaaatatcagggaaaaagcctaagctttacagatctctgtcattcttttaaaaagctcacttgtttctcccttcctctgctgtgtctctccgctagtcgctaatatccatagcaacaggcccgtagacctttacatcatcgtcctaggtaatctacattgttcttttttgttgaagaaaggaaaaccaaaaagaatacttcaaaagtaaccagagatgtagaatttgaactttcaggaactcagtgtgtgcttgactaattgattgttgccctttctgaccttctgttctccttggacctaattgttcctcccttacggatatttagaaatttacatccccagatgcaacaagcaacggcacatcattttaaattaaacaaaatccaaggattggtaagatctagcagcaagccgcttctatttttgtggcggtacatcgtgatgaattaatgtggaactgtgctaatgtctgtttttaccagaaacattagcgatgagtaataaagtatatttttccttttattttttcacttattttcagttatttatgaagagaactctagtttcaagaatctctttgaaaatcaccataactatttaaaaaccacatgtgtagagaagcaggaagaggagaaagtggcccacttaaataataaattgcttatttattagctaataacttttttaaaacaacactgtgaatgtttactgtctacttaccagtgatactatttagagcacgctctaaagaaatatttctgcctaactatattttcttgcctagagtctttagagaccaagatctctggcttttaacataggtctccaagtttgaaacctaaatggatggtagccttacttctgcaggaaacctttttctgtgactacctccaggaaaaaacaaaaacaaaaaacaaaaaaaaacctaagtttctttggcccttctatccatggctacaagcttatattccttccattgttgttaataaagagaaaataggcatattgtagctatggcacatttgtctggtgacttctcctttcctcttcagccccaggcagatgtttccctgttctgttcctacaggcactctggagttagtataatattgttttctttgcaagtctcagaactgtttaactttttcttaaagggccaaaggccacgtgttctatgccatttcaaaacgtttaagcagaatgcagccagattcctaaatgaaaccatagcatctctttttgtcagtgtggaaaatgggcactcttcaccatgctgtgaagatgaaccaaagcctgccctggcaagttaatacttgtagttgctgcagtaggcggtagccatcttgtctcctcttgaaatcttctattctttcagagctcactatgtgcagtgctctctcattggtgtttgcatagcagagaaatagtcatggtttagtagaaaaagttcgagctttgaagccagacttagacttaaattccacttattacctatgtgacttaggggatagttaactagcgtctctgagtttctgttttctcattggcaaaatggggacagtaatacctatcttgcagcactgctgaagagagaaaattatgtaaagcaagagtcacagtacctgggatgtcataggagttcattaaacagtggctggcattagctattataatagagtgtggttcctttaatagtatgagacctaggtaatattatcccctattttacaggagaggatgttgaggctcagaaatgttaagtgccttgtcccagatcacatggcaaggagaagctgaagctgagctatctcagcctgggtctgtctccaaagcctgttgttttcctctaatgcatcacgtcctacgtgagtgctgttacagtgccagaggtgcctgctgctgcctcagtctggctgcctcccgccttccccctgaagagtactattagagatacaaaactaatggagaacgaggacctttcacaacctgcttttgcctttccagatccggaagaagagctattaattatagagcattttgaggatgatttttttccttaggaatacagattccccaggaaattgccagccttctgtctttttttcaactcaaagtatgactaatgtttttgagacttgttgttggctaggaagtcaagtcacatcaattattcatttaaattggagggtttggggttatttggaggacaaataactagaaatatttgtgtaagtttctgatgaaatagaaaactcaactgattgtttgtatttcatgttgtttcttaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaaggcaagtatattttgtgaaaatatttgtgtatataaaaaagaatgtaattgtttagtggaatggacatatttttaaattccttaaaaaaatggacattgagagataaactttgtagtagaggaccacatttaacagttttatgttgctttataatttgcttacctaaattaaagatttcacatcatcactccagaatatatttagagtttgcaaagacatctctttccatctttcagtattaagtcgttcagtctttcatgcaggtttatttaggaatagccaatttattatctaaccattactggatatgacctctttggacctagataagaggtggttagttttgttttttttgttgttttttgtttttttttgttttttgaaactaatctcaaatgacttattttaaagaattggttttgtgttttattatgttcaatcctttatcctgataaaggcagcaataatcctccactttttaaaaagtacttgaagtgatctgagggaactaacacttttagaaaccatttagttctgtacacaaacaaaaagtcagctttaatgtataggtgaattattaagatatattctctagtcaaattttgttttccaacttacccttcatctgcaagtggtggcatgctcttctcagctagcgaggctcaccctcttggtgtcatcctacatttctttagctcctgcactgagctaatcatcaagtaccacaggcccttccttggaaacatgtctgtcactctcatagtcccctcacccccacactggcagcattcaaactaggccattactacccctatctttgcactcttaaaatggttctgttttctcttccttccctctcgtatctattctataagcagctgacagaacattttcctaaaatatcctgctattccaaaacctctgggggctcccaacagcctaacctgacagccacacccctgttcatctggcttctgcaggtttgtagattaacctgcaactacagaaatccttactcttcctaattccatctcacttatgcctgtttctgggcctttgtctaggttgtcctctttctctagaatggattcccccatccttccactttcttcaaggaccagatcaaatcccaccgaatctcaaagggaatgttccttccactgactttgctatacattatgtctctttttacacatacctatcatctcttcaatcatatgtgaacctccttaaagtcttataccattttcccattcacaaggtctaacataaaaaccaaaataaaactttttattttacaatagttttcaatttacagaaaaattgtaaaagtgctatagaaagttcccatatacccaaccgagtttttcttcttattgacgtcttacactgctcataactatggcatgtcacattgtacagtatactagtcacaactaatgagccaatatttatacattattaacttattattaataaagttcatactttatttggatttccttagcttttacctaatgtcctttttctgtttaaggatcccatccaggtatcacattatatttagttgtcacaattaggttgtttttttttttttttttttaacaattcattggtgaggatgacaaattcataaaaaaatgaaaggcaaaataaaaataagatttgattgggaccttggtcaagagaaacaccatgcatttggggtagtgatgggccgtccacctggtggtgtctagcaggcaggctttctgcaaagtagaacccaaaatagagacttaacacagagatgttggtttggcagtcagctattgggcaacaaacgcaagcaaagccctttaatgtagattctgagagaggatgtgtggggaaaagatcagaggactttgagtggagctttgggcctgtttgtattcagggcaggaggtgagaagtggagctcagtgaaggaggcataccagagaaatggacatcaaaggaggatattggaaggtaaagaaagggtcttaagaagaaagggtcagtggtacttgaaggaggtttattagcgaggtcctttatgaccttgggggtgtctagtgatgtggtgggtgtgagtgagaaaatagaggtaatgaatatcaactgttcttttaataagagagagagttaaggaagggggaagtgttgaggatcatatgactatgagaagggcttttcaagtcatgggaagcttcagcctgttttgtagacaaagagaaaagatttacttcaggaatttttttaagggaaataatcacacaggtctgaaaatatgaatatactagaatgcttatgatagtggaaaaacagagccagcatggtggctcatgcctgtagtcccagtgctttgggaggtcaaagtgggaggatcgcttgagcccaggagtttgagaccaccctgggcaacgtagtgagaccctgcttcttacaaaaaactcagacaaacaaacaaaaagacaaaaaatagttgtagttgtgcacaactgtagtcccagctactcaggaggcagaggcaggaagattgtttgagcccaggaattttcaggctgcagtgacctattaatatgattgtaccactgcattccagcctgggtgacagaacaaggccccatctctttaaaaaaaaagtggaaaagcattggaaagaacctaaatgtacaagaaaagttatatatatatacatatatatatacatatatatacatatatatacgtgtgtgtgtgtatatatatatacacacacacacacacacacacacacacacacacacatacatacagaatttagaaaggtatccaccaatatgtgaataattattatttctgagtaatagggctatgttttctccatttttttccagggaatatatattttctaaataagaagaaaagcttttttttaaaagagagagcacaggtacaggagttattggcaaggtggctcagctgctactctgagctagatagaaggaagagagactgggtgagagtaggtcttgttcaatggctcagatgtctgaggaagttaggaggtaaggccatctgcaaaagatgaagtatggaagttagcacttaaggaatgtgggaaatgttttaagagacctctctaaggttttatagttttgtctatagcaaaggggatatgaaagaaatgaaagaaactgtcattgttctgtacagaagccaaaggagttaccaggagactggggagtctaggtggacacttgtaatgatatctgactcagggcttctcaggcatcagtcacatcatagcaattcagacagtgaagcagagttgtggatagccttgagttggaccttgaatactggttggaacgaggggaaatccattccccgcctcttccagcttcttgtaggcatatcattccatcctctgcctctgtggtcacattgccttcccctcttctgtctgtatgaaatctccctctgcctctctcttatcaggatttgtgtgatgtaatttagggcccacctggataatccggaataatctgtcttctcaaaatcactaagttgatcacatctgcaaagtccctattaccatgtgaggtagtatacacaggttccagggattaggacgtggacatctttggtgaccattattcagccttctatactatcttatagccctgggtctgctgacaggtggcatggccatcactaacctgtaatctggtgaaatggtgtcaccattcaatgtatgaaagcggggcaagccttttgcaatgagaaaatcaccatccttagcatgcctctcaaatcatcattccagttcactgacagccccagcagggtggaagaaggactctgtagtgtctggagcttgtatttcctctttgtccttttcaatacaatactcttcccctatagtcctgcttcttttaaagtatcatattgttttggccttcttggatggcagctagccctcattgagcctatgctcaatgtgagcactttatggggagcatcttttagtccaagacaagctagtggggacatggctcatttcttcacagtagagagagagaaaccatggttactcaattggcccaaagcacgagatatcaaaagtggaatgaggtttcaggcccaggtcttctgccatagagccagtgctcttaactaccgtgatgtatactgcttgatggctgtcatttctttcatcagtcacaagtccatcagattatttaagtgtttttaaaactctggtatagttttattagataattatagctgtttctgtcagaagtgatcgtgggaattaatacttaattggaacacagctaacatttttgaaaataattggctgagattgagtcctttttatattataagtgagggaagtatctcgagtgagagttgccctctgtaaaaatgcattagaaccccaacttcattaaattggactcaagtgatctagtatattaccattgcttctcaacagccctttcttcagaagtacttcaaatgaaaattgtaaacaggatttcaaggagaatacttaaaatgcttgaagaaataaacggctctagtcattttaggagtaatggattttgtacaactaattgatgtacatccttaggtcccttaacctttccttcttggcactactttatccacttatctttagttacattgtatatgtaaaactaatgaagttacatttctttatttttatttttgtagattcaaggggtaaatgtacaggtatgtcacatagatattgcatagtaaggtttgggcttctagtttacccatcacccgaatagtgagcatggtatccagtaggtaatttttcaaccctaatacatcagatctttcacttggtctgccttttctgtgaattagttaaaataagcgaatttccatttccttgaattgggtaaaatgactataatacatgtctgttgcatggctgttagaatttggaagctccgtggaagaaatcttttaaaaaccaacccaaaattacataatatatacaaattgttgatacgcatgtgaaaagatggaactctcatacattgtttctgggaatgtgaaatggtacaaccacttttgaaaatagtttggcagtttctttaaaaaattaaacatatggccaggcacagtggctcacacgtgtaatcccagcactttgggaggccgaggcgggaggatcacgaggtcaggagatcgagaccatcctggctaacacgatgaaaccccatctctactaaaaaatacaaaaattagctgggcgtggtggcgggtgcctgtagtcccagctactcgggaggctgaggcaggagaatggtgtgaacccaggaggcggagcttgtagtgagctgagatcccgccactgcactccagcctgggcgaaagagcgagactctgtctcaaaaaaaaaaaaaaaaaaattaaacatatattcaccatttgatccaaccgtttcactccaagatattttacccgagagaaataaaaacactgtgtcccttcaaaaaatgtgtatgcaaaagttcatgccagcactattcatagtaaccaaatgctagaaacaaccaaatgtctatcagttgatgaatggataaataacgtggtctatctatatacaatggaaggttatgtgaccatgagaaggaatgaagtactgattcgtgctacaacacaaatgaaccttgaaaacatgatgctaagtgaaagaagccaatcacaaaaggccacctattgcattatcctatttatgtaaaatttctagtaaaggcaaactatagagacaggaagcaaatcagtagttgcctggggctcaaggtgggagaaagattgaccttagatggcacaagtaaactttttgggtgatgcaggtgttctacaactacattatggtgataattgcacaactgtataaatttgctaaatcttattgcactcacactcaggatgggtatattccattgtttataaagtatgtttctgtaaatgcatgaatcatcaaaaaatgacatcatagcaataacttgttatatacataaatttattgatacttctaagtctcaaatttttactagaatactttcactttaagtaccctactgattatgagccagataagagttgatatattgccaatttaaaggtcaaaaggtggatttcactgtatcagacttttacagtctagacgcgacctgttgggtcagtgattttttttttaatctgatcacagttatggattgaatttttgtcctgcaaaaatttatatgttgaagtcctgaccccctgtacctcagagcgtgaccctatttgaaaagaaggtctttgcagacatgtttagttgaaatgaaactgtactggagtagtgtgggctcttactttgttatgactagtgcccttataaaaagaaatttggacacagacacacacacacagtgagactgccatgtgaagattggctgccccaagccaaggaacgaccagaggctagaagagtgacctggaaaagatctttagtggtgagcatggcactgccagcactgtgatctcaaacttctagcctccagaactgtgagacaatatatttttgttgtttaagcctcatagtttctggtactttatgacagccctagcacactatcgcaatcacatccatgaaaataagtttgagatgcagtttggcttttggtttgtttcagtttgttttttaacacctgggcacattcaaatgcagtgtctgcagcaaaagtaactatcatcagagtgaacaggcaacctacagaatgggagaaaatttttgcaatctacccatctgacaaagggctatatccagaatctacaaagaactcaaacaaatttacaagaaaaaaacaaccccatcaacatgtgggcgaaggatatgaagagacacttctcaaaagaagacatttacgcagccagcagacacatgaaaaactgctcatcatcactggccatcagagaaatgcaaatcaaaaccacaatgagataccatctcacaccagttagaattttagtatatgtgctgccgaagcgagcacgctctcacaccagttagaatggcaatcactaaaaagtcaggaaacaacaggtgctggagaggatgtgaagaaacaggaacacttttacactgttggtgggactgtaaactagttcaaccattggggcgattcctcaaggatctagaactagaaataccatttgaccgagcaatcccattactgggtatatacccaaaggattataaatcatgctgctctgaagacacatgcacatatatgtttactgcagcactattcacaatagcaaagacttgaaaccaacccaaatgtccatcaatgatagactggattaaggaaatgtggcacatatacaccatggaatactatgcagccataaaacaggatgagttcatgtcctttgtagggacatggatgaagctggaaaccatcattctcagcaaactgtcgcaaggacaaaaaacccaaacaccgcatgttctcactcataggtgggaattgaacaatgagaacatttggacacaggaaggggaacatcacacaccagggcctgttgtggggtggggggagggatagcattaggagatatacctaatgctaaatgacgagttaatgggtgcagcacaccaacatggcacatgtatacatatgtaacaaacctgcacgttgtgtacatgcaccctagaacttaaagtataattttaaaaaaaaagaagaaaagaaaacaaatgcagcgtctgtagaggacgatcaacagatcctgcagctcttagtgtttccttttgataaatctttgttctggacgttaatattttaaagcatggctttttctaagtttaaaaactatcaaatgtaagcagtatcttataactccctactgactcacgtatttttctttgtcagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctgtaagtaaacaaagctaatttctaaaaatagatcactaccattcaggattttaaaactagttgttaaattacatattcagtattacaatgaaaatctgaggagtgtaataaaaactttacgcgtttgaaaatgcatgatgccttgggtagtgaaagtctttttaagagatatgtttatccatctgcactgtttgcagtttcacttgaaagcaatacaaagaatcttcatagaaatgtttacattgaaatttcataagagaaggaagacagacaattctttctcaaataatatagctattagagtcaaatatattttatagacttttagttgaggctttttatttctgatatgcattttaaaaatcatcgagagatgaataagttcaaaagagctattgtataacatgatgactgtagttaatatatttttgaacaatgttaaaagaatggatgtaaagttttcttaccacaaaaatggtaactatgaggtaatgtgtatgctacacattaaacagacagtcaatatatataaatttctctctcaattaaaaataaataaaaattttttaaaataacccccccaagaaaatttttttaatgaaatcatcaaaagaacatactaaaattcatattcctaggtcttatttccagatgccctctgaatatacattttgacccagctccccagtgattctcatgaaggggatctgtaggctaccctttcagaaacactgctatgtatccttttagccttcacccaggtttcatagtgtgaataacattttcaagtagaaagaatcattgtgtttttttgcttgtttgtttgtttgtttgtttgtttttgagatggagtttcgcccttattgcccaagctggagcgcaatggcgtgatctcggctcactacaacctccacctcttgggttcaagcgattcttctgcctcagcctcccaagtagctgggattacaggcatgcaccaccatgcccagctaattttttgtatttttagtagaaatggcgtttcaccatgttagccaggctggtctcaaactcttgacctcgtgatccgcccacctcagcctcccaaaatgctgggattacaggcatgagccaccacacccagccatagaaagaatcattgtttagtaaatgaatacattgtgagattttttggttttgtcttgtttttaagagagaaagaacatttaattctaatcatcataccttttggacatgattttaagtcttgaaactttaggattgttttcttcgcgactgaaagaactaggttgagtgtattgctaacatactatgtaggataatcatgcccattctatccatagctgttcaggacttgtacaaaattctgattatatgaaataattgtaataatcacctaggatgatgattctttggcaatttttattggtattttacagacatttatatacttaatttccattattttgaaaccttacattgcctatattgccatggaagtatatattatttcctctctgagaaacttggcatttagaaggcacattgctgaattgtattgtcacattttgtgttatatgctttctcagttttgtacccattaattaaaacaaattatcttcatcaatttattcagcgaataggtcatggtgataaaaaccacaccgatgctgaccgttctcctatttttctccagtttattgattgtgtgtggcaaatgtcaaaacaggtaaggaatatgagggatgaaaatacattcaactcattgtttaaattaaacattttaatataatgattgggatttgaccccaaaataatacagggtagagctagagatgaagcaagactgggcatgtgtgaatacttgcagaagccaggtacatgagcgttcacctttttattcctgctactattgatatatctgggattttccctaataaagttttaaaaattaagtatttaactctgatgtctctactagtggaattgacaataccaagtcgtcgtttatatacattttacactgacccttatatatagctgtgtctgctatctcataatagcttaaataactaaactacactgtacctgcaggagaacccagaaaatcagcctgtttatctcattttcctctttattgctttatttaacacttaaagtgctcagacctatataaactgctaaaaaaagaacaactgtagtgtgtgtgcagattacagcctctgctgtccttcctagagccctacaatgtggcagcatttgtttacttctacagtgtatctttctaattttataaagtttcagtcccagtttttcatgctttgtttgcttgtttttgtttagttccctacagcttttgaattcaatgaacaatttttgattataattttggatcatctgtatagttgccgatttggtactttcttattcaactgtgaatctgctcgagaaagacaggtgagttaaaatgctattttttttgatacattaggcttgccaaaatgtatgtagtctaccatgaaatataaaaaatatgatagcttgtaagacactgtctttgacctcaaagagtaggaattacattaaaggtatgcattttgtgttatataaaggaatacctgaggctgggtaacttacaaagaaaagaggtttaattagctcacagttctgcaggctgtacaaggagcatagtgccggcatctgcttagtttctggtgagagcctcaggctgcttccactcatggcagaaggtgaaggggagccagtgtgtagagatcatatggtggaagaggaagcaagagagaggggagagggtgccaggctctttgtaacaactcagctgtcttggtaactaatatagagtgacaacaaacacctaagagagagcattaatctgttcatgagggacctgtcctcatgacccaaacacctcccactaggtcccacctccaaaattggggatcagatttctttttctttatttttttgtttgtttgttgttgttgttgttgtttgagacagggtttcactgtcgcccaggctggagtacagtggcacaatcttggctcactgcaacctctgccttcctggcttaagcaagattctcccacctcagcctcctgagtaggtgggaccacaggtgcacaccaccacagctagctaatttttgtagttttagtagtgatggggttttgccatgttacctgggctggtctcgaactcctgagctcaagtgatccacccgcctcaccctcccaaagtgctgggattgcaggtgtgaaccactgcgcccagcctggcgatcagatttcaacatgaggtttggagagaacaaatattcaaactatgacagaggttcccccaaaagtaaaaatatagctaccatacgatccagcactcccactattgggtacatatctaaaggaaatgaaatcatcatgtcaaagaggttatctgcaatctcatgtatattgcagcagtattcacagtagccaagatatggactcaacctgtgtccatcaacagatgaataaagaaaacgtagtacctatatacagtagactactactcagccataaaaaatgaaatcctaccatttgcaacaacataagtaaatctggaggacattatgctaagcgaaataaaccaggcacagaaagacaaataccacatgatttcccttatgtgtggaatctaagaaaacttgaacctatagtaacagagagtagaagggtagttaccaggggctggggaaggggtaagggaaagaggaacatagtggtcaaaagatacaaaccttcagttataagtactaaagacctaatgtgcagtatggtaattatagttaataataatgtatatttgaaatttgctaaaataatagatctcaagtgttctcactgcaaaaaaaattggtaactatatgaggtgacagatgttaattagcttgattgaggtgattatttcataatgtatacatatatcaaaatatcacatcgtataccttaaatatatacagtttttatttgtcagttgtaaataatactgggggaaaaacacaattgtttctgggaaaagaggtgagagagagcactttttttcataaccttgtcaaactatttgactttttaaactatgtgcatatataaaaataaaaagagtaacatgcaaataaatacaatgtggtatatagattttggcatcaaaaaggtacaactgaggttttaggtggattcagagaaaggcaaaattatgctgtcgttattcatgaaatgaaatacatatgtttaagacatttcttttatttttcttttgagatggagtttcgctcttgtcacccaggctggagtgctgtggcgcgatcacggctcactgcaacctctgccccccaggttcaagcaattctcctgcctcagcctcccaagtagctgggactacaggcgcctgccaccactcccagctaatttttgtatttttggtagagacggggcttcaccatgttggccaggctggtctcaaactcctgacctcaggtgatccgcctgcctcagcctcccaaagtgctgcaattacaggcgtgagccaccacacccggccacgaaatttctttagtcacttattttgggatgttctttttggtttccagttttagcttattgctcttttcttattaaagtcattactaggaaaagtttcagattctacctttggtaattttaattcttgtatttttatttccctagctttgatgttttttttttttcttcctctctctagtttatggtcaaaattttgtaaacgcctgcaataaaaagcaatgaaaatgtgaatatctttatgagatggcaacactaggctgaaaagcttagacttcgtgtagtcagttatccagatgttttcaaagatatggatgttgacatgatgtagattaaacatctggatggttgattaaaataactgtgtccagatgcctactgtcaagtagacacagattaagatttcatagttccaacaaatggaaaagttttaaaagtcattgggatcttaggataatttttcttttcactgaattaaaaagagtataccacccatctgttcataaatgttttacctagctgggaatactcttctttggtcagtgaattgcatttaatggtacagtatcctgcgcccctgtcttcaggcagaaatagtggctctcaagctaggccattacctatgcaaatatcgataagtggctgccaagcactcactggcccatgaggctttttgagctattatgaggataatgtaaatgtgtgattcaatttgatgctgaactgtattgctacaggctgcaaaatggtttgtggatttatgtgtgtttttacttaggctctccactttctctctctgtctctctgtagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaagtaagtgaagtagcactgttaaaagatagcaatgtcaactgcttgccttagataatgttatttggtatggattttttttaacagcatgaagaaaaatatcagactctaaaaacacacttattgttaaactcaaccttaatttaaattttttttaattactaaaccatgtgttttgatgttaagctgcaattcttctgccaatgtgatataattgtttactataatgcaagctgatttaaagctctagaaaatttgagttttcatagccagagatttcctttgatcacttgaagtagttattcattatatagacattgtttgaaaattctttacattgactagacttagatgatcctgttaagaaaatgtttgctactctcattcaggtgtatgcactagatcagctaacatcagattgcttttcactgagggtatttacttctaaaataaagataattactctgtcaatggtagtaaattcagttggccatttatcaaacaaaaatggaaacaatgagtttgaagtgaaagactctacattttgttaaagacacacttgggctttccattctcccacctccactccatccataatcagaaggaaaaacagcctgcagtacttcagtttattgatttgttctaagcattataaatattcagtatttgtgatggttctttgtaaaggtttgcacattttcctgcagtgtgggtggtcgactacctgttctcacagttcagtcttgcataagcaccagctttaatgccagaaataggctggccacagcagggtcccatagctgtggcctctctctcagattgttcattcctctcaggcagttggctgcatgccagtctgtgccctacctcctcactggagaagtgcccatttcaagctggcaccctcatttcaaggtctgtgctactcacgtgaaaggcttttgcaatttggtaatggttgaaatgtgtattcttttggaaagtgacagattccagggcttgagaacattcacttgtttagtttggaatttgagaagcacatgggaggaatttatttaacagtagttctagcattttggaatatcaagtaaagaataaataataatccttacagaattctaactgcttttacaagagatgtgttccttattaaaaaatgtttttatagatgagcactgtgtttgtcctataaaataagccttttccatatttgtcatggcttgtttttaaaatattggcaatgagaaagtacggacagtttttgtgtaagtcctgtaatctcttctcacccatttgtacttggagaaattcttgaaattcaaggaatttggagcagttcatttctgaattcctaaaggtaataatgataattgtgtgacaggtcaagtttgagggtacatcattagaagaacttcttagaatgtatttatcccccttagtctcacagatcttggcaaaatggaactggcctggagaggagtgctcattctctggtaggggtttttacttcgagacaggaattggcctatattatgatctattggcatgaattcagaaaagaaataacttatcctttctatgtggattttctgaatatgaaggatcctacacacatctttatctccctaggcactttgtgttttcatctaccaaatattgaatgttctcatgcgtcaggcactagggggatgcagagattaagaagaaatggtctccgcccatgagtagctcccaagctggtaggggcggccagaaacataagccaatggttataatgcacagggataagtgtaagaataaaagtatgaattaagtacattaggtttgcttaaagatctgcttatgtagaacattatttcatacagaaatagattaaatcgcataggacttttaaaagtacataatataaacctaaaagaatgtacttaaccacttaaaagttaaattgttattcagttgtgtgagccagaaggtattcaaacaattactggccacctgtagtattcacagcactatggtggtatactatcaatgttgaaagatacaaaagaatatacagcctcataatgagctgttagcctcaaagaaggcaggattagtgtgcttttaaaagcaaaagccaccaacccttgctgacataaaatctcagcagagtttatggaaagaccaatgcttacatttgaaaagctatcaataagcagatctggtacttttatttaatacaaggaaattactcatgtcaaaagcatagtcatattacaaacctgagtaggaattttggctgccagtgaccatcatacggtactctaggaaccactgcattccatgtagctgttaatcagggttacactggatgtactgaaattttatatagtggtaactgaaggatgagattcaggacaaatattagcaggttgacctgtgtggcatttgtttcagtcatttttgatagaaaaatttaaagggatatgaatatgaaaattgtttgaagcctacaatacttccataatgagctgattgcctatcttcttttccatgccaagctgagacatactttataattcatttcccaagtgagaagttgaggtataatattttgtcacttggcttgaagttttcatttcttgttgtctttgtattctatcacaaatggactcttctcttcttttacctgctctaagtggtttgtgtttgtctgtagcccaataacttctatatattttatacccattacttgactgaattatctttttatttctaacagtttttctgtttactcttttcagttttctgatgatacagtcatgccatctgcaaaaattactgttacccgatttctttttcttatctaattgcacatgctcattgtaatattcaagctgattctaaattctaatactcatatttcaaagggaggttttaaaaatagccacagttttggaggagaatatcaaggaagaacctgccctgctatatagcaagacttatttggaacagagtagagcccagaaacagacctgcgtcaatgtggagacttggaatagtaagaaggtggcaatgtaacacatccctatgagtggaatgttcagtaaatggtgctgggactggaaatgaaagttaacatgtcaaaacagaactcctcatgtttcccccaaaacctcctcctcctgccatcttccccatttcagttcgtggtagcgccagcctagtcgccctggtcaggaaccttagagtcatccttgacacctttctctcccacaccccatgtccaatcaatctgtcaggagagcttcttgggctctgccttcaaaacacagctagagtccaagcacttctcactgagctcccaccaccatgctggtgtgtgctgcctgccatctcccgtgtgtggcagcgataaccttctagctggaccccctgatgctacctttacttctttctactcttctcagcatggcagccaaagcagatcatgccactcgcctgctagaaactggccaggtagctgctcacctcacccagagtcaaggcgcaagtccttacaatggtctctgaaacctcgtgtgactgccaccccaccccttacctctgtgacctcctggcatcctcaccaacaacctttctcacatgctcagcttcagccagactggcctctgctcttcttcaggcactcaggtatccacttgacgccctccttcatctcccttaagtctttccccaaaagtcacctcttcagtgcagctcactctgaccatccagtttagagtggaatcctgttaccctgctctagtcttctgtagaattgatcaccttcaaacattctgtgaaactcccaggatcgttatgttcgttgtttgtccgtctccccctgctagaagataaaggccataaaaataggtatttgggcctcctttgttcactgctggatcctgagcacctagaacagtgtctggccctcagttgaattttaagagaaaaatgggcaaaggatattagcaagcatcccacagcacttactgggtgttaggcattctaccaagcgtaatgctatatatgcatttttgaaaagcttccactgccaggccacacactaaaagtcacagtgatcatagggagaatgggattaagaggcttctgcaatcctatgggcctttgtaaccagagcactaatgaaagcagcaatcgcagtagaaatgtgggcacggttccatgtctgctgcatttgtacctggctttagctgattcacgccttggctgcctgtagtgggtagaatggtgtgtcccccaaaggacagcgacccacagcctgtgaatgtgaccatatttgggaaaaggatctttgcagttgtgattaagtttaggatctcaagatgagatcattctagatttagggtgggtgggccctaaatccaatgacagatgtcctcctaagagaaaggaggggaagatttgagacccagacatagaggagagaaggccatgtgaaaacaggcagagattgcagcgatgctgccataagccaaggaacacctggagccactagaagctggaagaggtgaaaaagaattctcccctaaagcctccagagggtgtatggccctgctgacaccctaatttggggcatctgccctgcagaaccatcagagagtaaatttctgttgttttaaaagccacgcaagtttgtgttaaattttttagggcaacctcatggctcatgctcccttctctaggatacaggttctagaaagtgtctgcttctaatagagaccattctcctgaacattaaaaattggatccaggccagatacagtggctcacatctgcaatctctgcactttggtaggctaaggcaggaggatcacctgagcccagaaattcgagaccagcctaggcaacatagtgagaccccctcctccatctctacaaaaaaaaaaaaaaaaatgttttaagtagccaggcatggcagtgcatgcttgcagtcctagctacttggccagctgaggcaggaggatcgcctgagcccaggagttcgaggttacagtgttcaagattttgctgagctacgattgcactgcactccagcctggcaacaaagtgagaccctgtctctttaaaaaaaaaacagaaacgtaatactaaaccgcagcattcttcatcagtgcattgtcttcacagcttccttgttggtgtgcacagcttcagcaaatagttcaacacagtagaaagcaggatggttctggaaaccactacatgtggaaggcacttctgtagacgtttggcttttttctttttttttcttttctttcttctaaaaaaaagggtggggggatacatgtgcagaacgtgcaggtttgttacataggtatacgtgtgccatagtggtttgctgcacctattgatccatcctctaagttccctcccctcaccccccactccccaacaggccctggtgtgtgtgttcccctctctgtgtccatgtgttctcaatgttcacctcccacttatgagtgagaacatgcagtgtttggttttctgttgctgtgttagtttgatgaggatgatggcttccagctgcatccatgtccctgcaaaggacatgatctcattcctttttatggctgcatagtattccatggtgtatatgtactgcattttctttatccagtctatcactgatgggcatttgggttggttctatgtctttgctattgtaaatagtgctgcagtaaacatgtgtgcatgtgtctttatagtagaatgatttatattcctttgagtataatgggattgctgggtctaacggtatgtctggttctagatccttgaggaatcgccacactgtcttccacaatggttgaactaatttacactcccaccaacagtgtaaaagtgttcctgtttctccacagcctcgccagcatctatcatttcctgactttttaataatcgccattctgactggcatgagatggtatctcactgcggttttgatttgcatttctctgatgatcagtgatgatgagctttttttcatatctttgttggccgcattgtgtgtcttcttttgagaagtgtctgttcatatcctttgcctactttctgatggggttgtttatcttttatttttataaatatgtttaagttccttgtaaattctgaatattagacctttgtcagatgagtagattgcaaaaattttctcttattctatagattgcctgttcactctgatgctagtttcttttgctgtgcagaagctctttagtttaattagatcccatttgtcaattttggcttttgttgcaattgtttttggtgtttttgtcatgaagtctttccccatgcctatgtcctgaatggtattgcctaggttttcttctagggttttcatggttttgggttttacattaaggtcttcatatattgcttaagctttctagaaagtgcttgcccctgatcccttcaaaacattaactttctggagtactgttctgttgtatatcttgacctgggtgtgattacctaaatgtatacgtatgtcaagattcactgagctgaacatctgaagattttgcactgtgtgtggtttatatctcagtacaaaacttttaaaacttaacatgctgggagagtcacgttatgctccagcctgacttctgcctttgtatcaacatcaatcccttgtttactcatcaaagtagtcaccattgtagcaaaacagatgctattaactcacttcactcacacaatgccatgtgagggctatgctgttttgattcccattttacagatagggaaatggaggcacacagaaggtgagggggcaaacccagcattcatacccaaggcggagcattgcagagccgctatggctgtcagccatgtattcagatgggcaataagcacatgaaaagatgttctagcagagcaatacaaacgaaaactaccgtgacataccatgtcacagccctcaaattggaaaaaagaataataatcgtatgctcccaagttctagtgagaatgcagaacaatgggaactgccaggtatcaccagcaggagcctctctgcaggcaatttggcagcatctggtgaggttgaaaagaccatattctacttctcagcagttccacccctaggaaaattccttagagaaacactcgcatatgtgcttgaggagatgtgtacaaggatactcagtacagcattgaacacactaccgaggagccctggaaatcactgattacccatcagcctgggaaggggtggagaaactggtttattccttcaatgcaacttaacaaggatgaaattcagaaaacatgttgggtcaaaatgtcaattgataaataccagatggtaccagtgatgtaaactttgataaaacacaaagtaatactgtattttgttgctggatactcacaggaaaagtgtcacaaatctgcacaaaaaggaaggtcacatggcaacttgagaagagttgtccctcagagtgaaagaggacagtgggtctgggacgggcaacacgggagactggagctgtgtctcggctgacacattttcaaagatagtgacacgtgtgaggaaatgtgtacattaggtatttcttggtgaacaaatacttagtacttgggtgtttagtactctgtgttgtactttcctgtatgtgtcaatgaggcagtagttaaggaaagtatgtattatggtaaactttgagtaaagggcttatttacaaatcagcagtcacagcagatgggtggaacacgtgagttctcatgacgtgcgtggcataaagtgtaactcaagtctctggttctctccagcagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagacaaaatttagatttaatttacgtcttgagaaatactatatatacaatatatattttgtgggcttaattgaaacaacattattttaaaatcaaaggggatatatgtttgtggaatggattttcctgaagctgcttaacagttgctttggattctctaagatgaatccaaatgtgaaagatgcatgttactgccaaaaccaaattgagctcagcttcctaggcattacccaaaagcaaggtgtttaagtaattgccagcttttataccatcatgagtggtgacttaaggagaaatagctgtatagatgagtttttcattatttggaaatttaggggtagaaaatgttttcccctaattttccagagaagcctatttttatatttttaaaaaactgacagggcccagttaaatatgatttgcattttttaaatttgccagttttattttctaaattctttcatgagcttgcctaaaattcggaatggttttcgggttgtggcaaaccccaaagagagcactgtccaaggatgtcgggagcatcctgctgcttaggggaatgttttcgcaaatgttgctctagtcagtccagctcatctgccaaaatgtagggctaccgtcttggatgcatgagctattgctagagcatcatccttagaaatcagtgccccagatgtacatgtgttgagcgtattcttgaaagtattgtgtttatgcatttcaatttcaatggtgttggcttcccctccccaccccacgcgtgcataaaaactggttctacaaatttttacttgaagtaccaggccgtttgctttttcaggttgttttgttttatagtattaagtgaaattttaaatgcacagttctatttgctatctgaactaattcatttattaagtatatttgtaaaagctaaggctcgagttaaaacaatgaagtgttttacaatgatttgtaaaggactatttataactaatatggttttgttttcaatgaattaagaaagattaaatatatctttgtaaattattttatgtcatagtttaattggtctaccaagtaagacatctcaaatacagtagtataatgtatgaattttgtaagtataagaaattttattagacattctcttactttttgtaaatgctgtaaatatttcataaattaacaaagtgtcactccataaaaagaaagctaatactaatagcctaaaagattttgtgaaatttcatgaaaactttttaatggcaataatgactaaagacctgctgtaataaatgtattaactgaaacctaacactgttttcagggctgtgagtgtgcatgtgttggaaatgtgcatggtggccatctgatttctttgcccgggtctgcttcatgtactttttatctcaccggcaaccttgcagggctctcccaaaatttcagcaagattgggcatttaagtgtattaaacagtgcagattttaagagtcacgactgtctatgaggatggcttttgcaaaagtgaacgcgcaaaactccaggctctgaatagggaacacagcagttgatagtaagggatgcgaagatactggttaaataagccatagttgacgtctcattaggtaagaatttttaaaattcttcaaacaatattgccagttggagattatgtcgtttacatatgtacgttctaagaatgctgaatagttgtagcagtaaactaaaattgaccattttttggcaatcagaatagatcacgtggaacagagcttaaagaaaaaaaatcagaataggactcttaaatgactaagtgtatctttcataacgatgagtatttgaagtgctttgtgaagtccttcctcagacattgcctcattgaaccctcactaggaccttatgagctagggggcattctgttacccctatttttcgactgaggagaatgctgttgttgcaggcgttcactgacatgccccacgtcctacagcaccaccacaagtttcatactggtgttagcctgaagtctacatttgagttcccactgaatggcctgagctctgccttcttcattgaaattgaaagaacctctcttcctgggacaactcttcaaataattcggaatcatatactttttagtataggttttgtttctaaatatagtcatagcactttctgacctgtttttgataatgcagcaaagcttatccttttgctttcttggagggaataatattcaaaaagtctcagaataagctgagtagtatcttgtcacttgcataatgcagctctatggtgtcattcagacaactcttgtggcatttgggtacattaggcaaaagcaggactgtctaaaaggaaattcttaatgtgggaatgtattaaagagtgtatacagctgttactggaggatgcacccactggtggccattaaagcaaaaggggacacccgagagaaatgggaaatgtatgcagtgcgcaccccacaaacaagaataatggcatatttgcagaaaagcgttacatggttgaactacatttcagttgaattttttaggtttacagaaccactaccagtatgaagctagaataccaatatttgaagtagtctgacatgccaaacttcattggtagatttaaagttaaggggttgttatcaaggtcttccttccatattgaacatacttggaagaggaaagggtagtaaaatgcagtattctcactttcttatgaggcttagattcagacatggattagttcttatttgcaatttctcctttaaaatcgaaggtgataacatattttaaacacataaagtggttcaatgcttagacacgaccattaagccttagcagtttgtttctccggcttttgagagcgctgcttattcatttacagtggttctgaaattgtttcacagtggcttccatgcaaattataaaagttgcttacattttatgaactctgtatcacaaagctatattagaatcctggatgggatgtgtggaaaccagggttctcatcggcaccagcactgacttgtggccctatttcctgaaggaaagatgtgagtgaagtcctcctagctcccagatgctacagatatggagaaggcctcagcctccatctgctcagtgagggtgtgggctgcacgttctcaaagtttccttacaactgaaacacagcccttctcagaaatgcatttttaatgacatttcatgcagagattcacctttttaatttttttaaaatttataactgacacattgtaattgtacgtacttatgaggtaaaatgtgatgtttcaatgtat

SEQ ID NO: 16367 - DNA, 9544 bp, Human
taagctccctatgagtggaggtatgcaagcagaaggcaggcaaccactaagctggttctaacaggacagagggatggatgaggtggccttaagatctctgaactcctgagtctgtagtggggacctgggttagtgacacaatacctgcctgctcttgtcaaaagcagcactatctctgccttttttttttttttttcggagtcttgctctgttgcccaggctggagtgcagtagcatgatcttggctcactgcaacctccacctcccaggttaaagcgattctcctgcctcagcctcctacaggcatgcatcaccacacctggctaatttttttgtatttttagtagagacggggcttcatcagattggccaggctggtcttgaactcctgatctcgtgatccgcctgcctcagcctcccaaagtactggaattacaggcatgagccaccgcgcttggcctctatctttgccttttgatctggattggaaccttgatgatgggagccaacagcaccagcttcaggggctcaggcttggctgggaggctcagaggagttggtaagagggggcgtaggggtgaagaagcaggtgccctgtgaagccagatcctttgcacacctcaaactcagccacggtttctggaagcagcatttggaaaattcatgttctggtggggcttatttctgaatataggactcataaatagctggatctcttggcctttcaaagaaaagaaaaaccaaactcatgacatctcttcctttgcattattttctccaactgtcaatctttaaactgctctttttctcaccctttcattctttccaggcaagggccctcagatactttctttccaaatagggctgatacttgcatttgaagtggagtatttcttccttgcgtgggactgtcctatgcaatgtaggatatttagtatccccggccgttccttcctcttattgaattccagcaacacctgccagtcatccaggcaccggccccacgaatttcagaacatcccttacagaagtgacactgcggctcctatactttgaaaaacattgcctgaatccccaaagaagtgactagctcaaggccataccaccagccaatggcaaagtggagatcaagtcaaatcccattcattcattcattcactcattcattcccgaagctttaattctttgctctagggtgtgtcaggagagcagagggaatgagggccttgaaccgagacagtgaagagggtaagaagaaaagtgttattctttgcccacaaaactacaatttctcacaaattctctgctcttgccaaattttgttttcctcttttagcccgtcggttccgcaatttcgggcgcaaataaagaccttctggcatttagtggaaagagcctagttgagcacgatccgcagaagcggaatcaggtggctttcggataggcagcgagatccgaggactaaatcccgaggtcttggcgagcaagcagctgccctccgccaggcatcgaggagcgagctgccgccgcgtttctgtcgcggcgccgcggccgaaccgggtagaggtggtctaccatcggcccttcgtggtgggcccaggggtgtttccccgggcaggggagctgactgcaggccaggggcgccaaggccgcggtgcggtgggagcagagggcagcgcagcggggctggacttcatcttcccacgccagaggccgaggcctccgggaatcgcagggccacctcttcaaagcccttggcgatcccagttctgttccccgagggggctggcgaggtgggcggggcgggcaggcgagactaggtctttccctgtttggcctccgtagccggcgccggcgggtcgttctgtttgaatgaatgatcccagcagccgcgcccaatgggcgtccacgcctgcttaatatgcatgaggcccgcagccaatggccaggcgaggaggctgttttaaacggcagagcccgctggccaatcaggcggctctcgtggaggcagctagcgcgaggctggggagcgctgagccgcgcgtcgtgccctgcgctgcccagactagcgaacaatacaggtacgtctcgcaccgcccgctcccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgtttgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtgttcagcagtggtaagagttgttgtttttaattgtgttaacagttagcagatgaccagatagtcttaagtcatagatttcaagcttctatcacccccaccaaatgtgtcctctctctacccttcccactttgtgattgtagtttccaaaacatagcagttctgtaaacgtaacactgagtaccctacttgggtcggctccatttggagcacttgatcgcttttgagaagtaactcgcaaaccagcgcgcttcgtgctggtcaaaagttaaatgacaagcgacaatgaagctgatttctttcctactctgccttctgccactggtgtccggcattgggggaaggggacttcctaacagcaagtgtagttttagttttgctctgcctttggtacgtcttgtacttcttgtcaattcctccttgcttttcctcattgtatttctttgtttctcttttatcacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaaggtatttttctttggtacccttcaaactagtcttagttgggtttcttactttggggttacttaccttcagattttctcccagatagctgcttgcttcctcttttacttttacttagaatcatttttgcttgtcttaagaattttgtgtgtgtgcttttatttttttaaggccctgcacaggtttcaggcctttacctacccccttttgcaagtggttctagcaactgctagtttaatcacaagaaactgaataggtatgtgttcactgcatcgagggatttaacgagtcctgttctttgcagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtaagtgactataggattcaagataacaattaataccttttcttctgcttggaggatttggttttttggtcgtcctgtatttcatttcaaaatgaaatattttttaaaagatacttaaaagatggcaatacctctgcaaaccattctgtacttgggctttacgatgcagtgccagcgttgtctgtggttaaggctgaagtgtttgtgggctgtgcttgcacattcacagtggttgtctgttggcctttccattgtgaaggaggcactctagttttggttgtcagggtccttgaagtatgttctttatgcctttcctagtaattgaaagactgggacagcaccatatatatatgcgcgtatatatacgcatatgtattatatatgcatacacacacacagagcaccatatatatatgcgcgtatatatacgcatatattttatatatgcatacacacacacacgcatacatatttgagatggagtttcgctcttgaccaggctggagtgcaaggtgtgatcttggctcactgcaacctccacctcctgggttcaagtgattctcctgcctcagcctcctgagtagctgggattacagacatgcaccaccatgcccggctaattttttttatatttttagtagagacggggtttctccatgttggtcaggctggtctgaaactcccaacctcaggtgatccgcctgcctcggcctcccaaagtgctggaattacaggcgtgagccgcgcaccacatatttttctaaccttatatattttagaacctacaactttgtagcattgtatatggtatcatagattacttcactttagggagaagtcatagtggtaggagggagatgcttctcaggaatgtgggatttcaactttaactcaaattttttgtggtttctcatgtaatgtatgtaattcttccaaggtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggtaaggtggggctggaagcctggactggtgaacaggcagtggttctgctatcagtaggttgcagggcatgtggcagctttgctgggctgagtacttagcatagcgctcaagggcccatccccctgcaaggtagctacgggtgctggtgttcatgcttttttttgacaggtctttgttttggggacaacttcaggcttgaaaaattttccttactctttaaggaaaaaaaaatgttaacagaggatttgatagtcctactaatgtgacttgaaggacacttgaacacccactaacttttaaattcgaatggctaagaaccaaattcatatatggaaacacttcagatatatatgatagcagcactgtcttacttgatttcaattcctgtcctcttacctgagatgaggactgcatgtttctactttgtgttaaaacagccgcatactcatttgaaatgtgtccctgttcctctaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatatttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaatcagtgggctgtctgcgatctgtctgagatactgaacctctgtacttttggttgattatcatcaaggttttagaagtgcaaacttt

SEQ ID NO: 16368 - DNA, 23652 bp, Human
  misc_feature (1)...(23652): n = A,T,C or G
caaatgaagagatatgtgatgattgtcagaattaatatgagtacataagaaagaagttttaaaattttaagaatatggttacttatgaaagtgaggatagttctttgtgataaactcagtaatgaagatcatttaatgctgagatgggttttatattctagcacagaggtttgcaaacttctataaagggccaaatagtacatattttagtctttgttgcatccaccactgtggcttgaaagaagccatagacagagagtaaatgaatgggtgtgactgttttccaataaaactttatttataaacacaaaaatgagaattttatataattttcacaggacaaaatattcttgttttgaagtattttcaaccactttaaaaatgtaaaaatcattcctagcttaagggtcatataaaattaagtggcaggctagatttggcccaccagttgtaatttgccaacttctgttctagcttgatgcatattttcctaagcttttaattgactggaaatgtgtatgtatgttgggggccagctgctggtgaacaaaactggctgtagctactgagcatactcagtgtcacttagaaatccccagaagtttcagaatatatatcacttttgtaagatttcagtagataccacaagcagaagagcaagcagaaagggagatttccgagaattttaatgagatggggggcggggacagtgaagagcaaaaaaaatggtttttccatatccaaaaatatactcagccctgacttaaaaaatgctcttggctgggcgtggtggcccacgtctataatccgagcactttgggaggctaaggcaggtggatcacttgaggccaggaggttgagaccagcctggcaaacatggcaaaacccatctctactaaaactacagaaattagccaagtatggtaggcgcaccctcgtaatcccagctactcgggctgctgaggcaccaacctgggaggtggaggctgcagtgagctgagatcgtgccactgcactccagcctgggtgacagagaaagactctgtctcataaaaaaaaaaaaaaaaaaaaaaaaaaaaaagctttttacattttcaaaaatatgcagaattgtccttgactgttgaacaatttaaatcctccattatggatgtgaagaattttaagactcttagtttttatcaaataaccaaatggaaataggaagtagccagtagattatctctacagctaaacaaaacaaacaaagcagaaacctgcaaaagacaaagcattcttgaaaaatgaagtaaggtcctagagaagctatttccaccatccaacaccagctgaattcccaaatggttaaactttcactataagtgctaccccactccaagtaaaaactacctaacacatgggagtagtaaacatgaaacattgctctcatttatttaatagtcgtcaccttgtaaataaatatgagtacatcagatctccagttatggggctggaagatttttagcataaggacaagtaggatgcagaggaaaaagggagaatggctagaggcatagcaaataattattttctgtaacacggaagacttttatcctatttatttacaagggaaaccctcgattacaacttgtctattaggttctgagaccttttgtgaaatcagacccccaaaaaagccggggggatctgtgaaaaacagatccaagtgtatttgatatttggcattctccggtgtccctcccacttgtcactttcttttctgatccgtttcagattcattccatatccttttcatattcattttatgttgatcctcttgtccctcctccctcattttcgtggttccttctccctcctcgtctcattaaaactcttgcaaatctccctttctgcttgctcttctgtttgcggtagctgctgaaatcttaccgaagtgatgtatattctgaaacttctgcgggtttctaagtgacattgagcatgctcagtagctagggccggttttgttcgcttggaaatctccctttctgcttgctcttctgtttgcggtatctactgaaatcttaccgaagtgatgtatattctgaaacttctgtgggtttctaagtgacactgagcatgctcagtagctagagccggttttgttcgccagcagatggcctgattcgacctctccaaaaatagacattttaactctctgaactcctgtttaaggaaggatgtaattcgctttgctctctcctcattttcaaggttcaaagggaagctgcgaggattccaaggtcccaccgccctcacagccaatgaggggcctgggagggaggagcttggtgcagcttgagcttctgagagaatcattcccggtagatgcagcggagtctgagctctgctgcatctgtcacagcagaacaaaattaaaaacacaacagtggaagagaaacgctgcagactatgggacgctgtaggactttctaaaacatttgctggggatttctgtgaagcatgatcttttaaaacgaattcttttggaagccggtttgggtaactgggaaaatgacacatatgctaaatgcagcagctgatcgagtgaaatggaccagatcgagtgctgctaagagggctgcctgcctggtggctgcggcatatgctctgaaaaccctctatcccatcattggcaagcgtttaaagcaatctggccacgggaagaaaaaagcagcagcttaccctgctgcagagaacacagaaatactgcattgcaccgagaccatttgtgaaaaaccttcgcctggagtgaatgcagatttcttcaaacagctactagaacttcggaaaattttgtttccaaaacttgtgaccactgaaacagggtggctctgcctgcactcagtggctctaatctcaagaacctttctttctatctatgtggctggtctggatggaaaaatcgtgaaaagcattgtggaaaagaagcctcggactttcatcatcaaattaatcaagtggcttatgattgccatccctgctaccttcgtcaacagtgcaataaggtacctggaatgcaaattggctttggccttcagaactcgcctagtagaccacgcctatgaaacctattttacaaatcagacttattataaagtgatcaatatggatgggaggctggcaaaccctgaccaatctcttacggaggatattatgatgttctcccaatctgtggctcacttgtattccaatctgaccaaacctattttagatgtaatgctgacctcctatacactcattcaaactgctacatccagaggagcaagcccaattgggcccaccctactagcaggacttgtggtgtatgccactgctaaagtgttaaaagcctgttctcccaaatttggcaaactggtggcagaggaagcacatagaaaaggctatttgcggtatgtgcactcgagaattatagccaatgtagaagaaattgccttttacagaggacataaggtaagatagaaattaaggtgatgggtgaaatgtgaaactgttcaagttgccactgcagtgccagataccatctgttgtcctgtcgatggacccacttctttagtgtcttagattcctctgacatctaaacctgaattaaaatatatgcttcattaccccttttaactgtaaccagttaaaggattatagggtgcaaacttttctaaagtttcagaagaataaaatttgcaacactctaaaaaagtctacttagcctcagttactcaaatatgctcagaattatttctaacgcattttcttaaaacttaaatcccaacttggtaggtcatcctaaagcacctaccagaagaaaatatatatttagaaactaagactaaacatatttccactgaaatggaaaatttagaatgatattctttgttgttcctttgttgtccaagaggggggaagagccagggtttcttatagaagacatttttaacaattttgcatgtctgatcaatatggagcatccccattcccaagaagcgtaggagagtgtctcacaaaatggcatttctactactcttagttcatgttcagcactgtactttgacaaaatgaaaagaggaagtgaaatgaaattttgtctagctttgaaaaaaaaaaaaagctgaaattagagaagaaatgaggagtacaaaaggagtttcagaatgtttttaattattaaagattttcaacattaagcagatccctaaaacaattagcccaattatacatactaacagtgcatgaaggtaacttcagaatatgaaatgacagaaattttgaaggcaatgcaatcttaatttaaatgacttggtgaataaaataaagtattctactgttgaagatggcatgtcaatcaccaagcagaattatttaatttttaaagcatctgtaattatcagtgtctttaatagcagtagcaacctgaaaaataatatttaaagtaaatttaggaatcctactcccacttgaaaattgacctcatatattgtattatatcatattgatttgtgattcttcttgaactattgaattcaatgatataaattatagtgtgcttagacttcttgcataaaagacaaaatccaacaaattgagtcagttcaaaagtggagtctatacatatatatgtcatgtgtccattttcagatatttttggtgtaatcaacaaggacaaagctctaataattgtttattcatgtctcatataatatcatttaattttaacatctcatacataaaatttaaatatcataactataaattacttatatgtattttatacctaacattatgtccactgagtagcataaacttttaaaaataatacacatgtgaccaaaactaaataataactaatactggtattaatctgcatttattggttaagatgcatagataatgccatactaaaaaaaaaaagaataatatgtatatatctttaaaaaaagtcctcaactctttttcctctctataggtagaaatgaaacaacttcagaaaagttacaaagctttagcagatcagatgaacctcattttatccaaacgtttgtggtacatcatgatagaacagttcctgatgaagtatgtttggagcagcagtggactaattatggtggctatacctattatcactgcaactggctttgcagatggtggtaatgacatttatgcttaatctcaaatatatttttaacattatttcttttgaagttgtcattgctagttttatgtgagctaaactgtgtacatggtcatattctagttaacaatggtccgaaacaatggcagactttacagcgtccagtgataagaccagcagtatgaaataaggagacagtggttcaaagacgttcccagttctgagctatttcagagatctctgatgcagtgtttctcggagttgaccttgagcaattttaattatattgcctaatataggatgattctttagtttacacttaacctcagaataagttagtaccctcagaaagagtataacacaagcattcctcatgtgttataaacattagttctatacatcccatacatttagtctataaatattctataactgaatttgccctgctttgcgatttgaaaagtccattgactacaatgggcaagcaggaatattgcttcagagaatgcttaagtgccatggaataagggctcctctgcttgtgaataatacagataacctcttatgcagcatgatttggtggttttgtaggaatggtggttgtcaagctgcagctggctaattctatcctaccactgtctcaacagtttttaataacagtttttattctttggaataacaaagaaagataagggcaaggaagaaaagacaatgttaaaatgttgtatcatccttggatgggagcttggatcttaattggttggaacagagaagaattaactgaagaagtattttctactcttttcctaaaataagacatccctccttaaaaatcactggactaaaattggccagaagcataggctttgtagtgaaacagagttttgttcaacttttggttccccctcttcctacgtgtatcctcttagtctgtttaattagagttgattaaactctctataccttagtttcctcatttgtaaaatgagaaccagaaaggctacttcagagaattgttgtgaggatttaactgaataatgtttatgaagtacagagcatgttatacttgatatatggtgacaattattacctagaaaataaaaggtgacaattattacctagaaaactaagaatattgttacagaatctgcactgttttatagttattttgtacagaattaaggatgaatagttatttgtttgaagtgatctaataaaaacaataattataatatgccttaatgttttgaaacagtgcttcaatgttttaaccagtccttacaaaaacacttgtcaaagttgagttattcttaacataaatatgttcatttcagtaagttagtatttgtcagcctttctttgtggcaagtgttatgcatatatcaattatacttcacaaatgaactgtgtaatagacactatttgtagaccactgagaaaattgaattttatctggttttatgtttcaaaatttactaaaaagaatttaattttaaaaagtttatattgaaaaaggtattgttagtaatagtattttagacataatcctttcataatgaaataaaattactttttcaaaagagtattagcgagagtgacactttaaaatctatggtgttaatattagttttaccaaaaaaagtcaaaattatcagatattcacttaaaaagtcatttcttaaaataacgatactcatttaaaaagtttaatatataatgtatattagagacaactctatagacaagattatgatgtagttttgttagtcagtgcttggacacactggtgttattaaaaaaccctggagtattcaacatagaacagcaaaaatgcagctattaaatggtgacaaattaaccccacagagaccagtaagaagtaaacaatgtatacaaagaatctaacaagcttatttaacaagatgtaataatatatttaaaaataaatcccacaaatcctgaaaataccatattaaattaaagaaacattaaaattttagattgaaatataataaccacattgaggcaagtgaaacaaagtatttcttaaagcttctttcaaaagaaaatttttatatagagaaaagtaatgtaagaatttcatagacagaaaaatgaattcatatgacagactattaattgagaatgttcttcaaaatctgtaatatcaagggttactatctgtgcctgtaatgtttgcaggtatatgtatgtatttactaaatatatttgtcatacaaagacttaacacatgaaaataccgagtgactttacttagccaaaagaatttttttaagataatagtatatctttaaggttttagttcttggaattacataccatgtattctaatctaatcttcagtcatagtttacacgtatgcctttagtttgtcccttatgttagaggtaaagtgcatgatgctttatatattttaaggcaaaaaaaaaaggtagaaaaataggtgagtcagaaagaaatggcaaggggaaaatgtgaagtagaggggggaaaaagaggataaaatgaagaaaaaagaaggctgctgttcaaatgttggctctgctatttgatagttgtcctttcctgggaaagttacatacactttatgtacatcagttttcctatcttaactatagagataattatacacatctttcaaaatttttacgaagttacatgtaacatacttaatgtgttttgaaacagtccttggctaagtaagaacctaggtagaagcaattgttaatatttatcatattcttaccctgtggctcctgagtcagatattctggatcatatgctggcttctttgctttctagactgtgaccctgggcaaatcatgtaaccttttgtccttcaatttccacatttccaaaatgagagaaatgatagcagcgttgttacaagcattaaataagatcagatatgtgaaacttagaacaaggcctggctcacagatattcagtagatgtttgctaacatgatcactgctgtagcttaaaggagcacgttcaaaagtgattaggaattcagaggtgaaaatggagaaaggaagaacccgcataatttttgttggaagggaaaggaaaaataattctattgcagatttgctgtactatccacctaaaactttaagtgaaatcttatggtaaagacaggattatgtttgtattcaaattcacataataaaatcacatatacaacatggcattttcacatcaaaagaggagcttaaaggccatctggtctagagccccagctttgcctaaagtcacacagttagttagcggaagctctaaggatggagggcgttatataactccagatgcactgctttcttctactgcatcatgctgccaccatattagctacattggaacttattctataaggaagatgggtaagtttgaggcagagtaaccatgggaccaaatggttggcaaagaggcattgaagtgttagttatgtagagtttctattatactatttttaaagactatcacccctttctttacttagtattaagagaatgactgaaattatgtgaagaaaatagttacctgaggtctacaacctcaattcttttttttttttttttttttttttttttttttgagacggagtactcgctctgtcgcccaggctggagtgcagtggcgggatctcggctcactgcaagctccgnnnnnnnnnnnnnnnnnnnncggggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccggcgcccggcccacaacctcaattctttaacattagtaggctgcctttcttctcttgatatcaaaagctgttctgggcaaggaggccagtgaaagctatgaggttactctgtcaatatcttatcacagacacctaacaggcaggaaaaaagagtgtctaagctactagcactgccagtaatgtcaacatgtttgtgatctgtgagtgtgaagcaggatatcaggagtaactgaaaggcactgcatgcactccagtagcatgggtgatgcttttattcctaaaatgtactgccaataagattataaccatagcttcagtttctgctgcattattgtctcatattccaatgccaaatcgttgaaatgttattttatattgtgggccaatttggatataattgtactctttttgaccaatgaacatagcagtattatcaatacatatcaaaggcgtactttaaaactctaattaggtatgcataaaagtgactacaattgtttaaagtatagcatatatgccaatatgggcataatcattagtgtaccagttaatgagttgtcacaaagtataatgacctcactatcaagtagtatttgctagtttgaaaatttcataaatagtattatataatacatactcttttatgactagcttctttgactcagtattatgcttatgagcttcatcagtgttactgagtataaccatagcatatttattgactttgctatatagcatcctgttgtatgactataccattttatttaaccattctgttgttagcagacattagattgtatccagtttgctgggtattagtaatagcgctgttaagaacatttttgtccagatcttttggtgtatgtatatacatatctgtgagtacttaactagaagtaaaactgctagattacaggctatgcataggttcagctttagcagattttgtaaaacagttttccaaaaaaagttctttcaatttacattcccaacagcaatgtgtaagggttctatttcctccatatctttgtctggctttttcattttagacattctcatgagtgtatagtggtacttcactgtggtcttactttgcatttctctaatgactattgaggttaagcacttttatttactcattggacgtttggatagcctttgttatgacgtgcctgtaagtcttttgctcatttttacattggtttatcagttttttcttactgatttgtaaaagcttttatgtattatgtaatgagtcatttgttggatatatcatatacatgcacaccacacacacacacatacacatacacacacacacatttaatctcaaatatattttcccaccctacatctggccttttcactctcttaatggtgtctaatagaaattcatacttttactatagtttaattcaccaataattttctttatggttagtggttttatgtcctatttaagaaatatctgcctaactcaacataataaagttattccttattttatcttctagaaatttccttggtttttcatttcacatttagatcttcagtcacttagaatggatgtttatatatggtggaggataggcgcaggttataaattttgtcaagcatttgtcaagcatgacaaagagaaagataaatgaagagaaactcagatgataagcttgaaaaaagtagaagaataaacttactttttattttttaaaaataatacaccttatttctttaggtaagttttaggtttacaaaaactgatcagaaggtacagtggtcttaaataccctctccccccatagtttcccctatgccttatatcttgtattagtgtggaactttcattacaactgatgaaccaatatctattccttattaaccaaagttcataatttacattaggcttcactctttgtgatgtacatttgcaagggttatggtaaatatataaggcataaccttaagtttaaaattcttccccatcttttctgtgaaataacaagacatgtgaccaattttcaatatgtactctttactatcagagctccaaattagcagtaaaatgaacaggtatagtgttaaatatgaaatccttaaatgaggaacttttgacaaaatagctaaaatattcagtgaggacaaaaagaatgtattgacctagaataaaaactgcttagtattttaggtcatggatttatatctctggcactaaggaatctggccctgtcttagaggtcaggcagttggctgttgtgtgcatgacaaaatactactggcaatgctctcacagtacctgccaaagaacaactagtagaataaaaagccacataaaatctgatctggaggaagcttttattattttattgctaaaaacatgaagaagacccaataagcattaatctgccaaagcaagacagaaattatcatgccatatgaaatgccagtccatctgtgcaaatgttttttcctcttaacagaagctgtcgatgaaaactactatttgaatcccttttaacccaaattcataaaattccataattattttagattgtcagccagattttctatgagccaaaactattcttagcattttaactgatataagaatttactattttggtaccccttttgtggctatctaaattgtatcacacatttacatgtctttaagaatatctatattctgttcccagtctatttatgtaatcacatcttttgcttctccctcataccaatgctcatcagcctttttgttttccttctttaggtaaactaactaattaacttcaaggggactaacagtagttctctagaggagtgattatcagtaaggctaggagaggacacattggactatggtaaaacatctccatgaactcatggtgattctgatagtccatgaaatcagtgcttgacgtcaacccatactgtaaacttaaccagtttgtcattcaattagcattactcgacatgttccttctctgtgctattgcttatgccatacttttaatctattaaaattttatgccatcttcaagacgtctctcaaaatctactcctccatgaagcattttctgtctcttgcagcaagtaataatttttgccctctccaaacaccttgcattaactcatccaggcttccctacataattgtttaggaatttgacatctctcttctaccaagctgtaagctctctcaggaaaaaaaatctgaaaatcatattttttcctgtatcttgcctaatttcttgcacatctaagtgtctagtaaatacatgctgggtgaattttacctcatattgtgcaggtatccctttcaaaataagttgagctgtctatgtgcaaaaaaagtaaaaatatctggtaattacagcaaggcataaagtatatatttgcactgaaatcctttgagataaattagagtgaactaaatatcaaaatgggcctatggctatctatatcactgctactttcctccttagcttataatatctagtttggaaatttgaagataatgtatagaaggaccagctagagaatcaaattgatgaaaagattaaagtaacaacctggagaatgtaattttgaatactaaaactaaaattgagtggatatacaataatagcaacgacaactacaaaaaataataactgctgatatttagagcacttactgtgggccatgtattgcactaacgctttattcggttttcaccaataacccttagaaccctaaaagatagggctgtttgagatagttatgtacctcattttacaggtgagaaaatagatgtggagaggtaagtgtcttgccctacttaccttactacttgcttataaggaataaaacctagattcaaacctagtctgattcctaactcttaaccataattctccattgacagtaatttaggatgttcatccatccatccatccgtccatccactcatccatccattcaatgcacattaaggagtactatgtgttagacactgtgctgaatactaggaataaagaataaaacacacagtcttgaccttcaaagaaattatagtccactgaaagagacaaggattcttagcaaaacctttagtaaagtgttaactcttaaagaaggagaaaaagttaagcaagaaagaaaggaaagtatattaaagtccagagaaatcacatatacaaatgccagaggattaacagagtatgccatgtatggggtgctgctggagcgtagggtgaaggatggttgagaaaggtagacagaggctagattatgagaatcagctaatttgcatttctattaaagaaaccacaccataaatgtttgtttattagtagtattaatatttaattaccagatcaatactattttattgcccagtaggtattttattttatattttattattttattttatttattttattttatttgaggcagggtctcactctgtcacccaggctggagtgtagtggtgtgatctccgctcactgcaaccttcacctcctgggttcaagcgattcttgtgcctcagcctcccaagtagctgggattgcaggaatctgccatcatgcccggctaatcttcgttttttttggtagagatggggtttcaccatgttggccaggctggtctcaaactcctggtctcaagtgatctgcctgccttggcctcccagagtgccaggactacaggcatgagccaccgcacctggccgcccagtagtacattattgctccctcctaagggcagggagtccaagtggaaagggttgaaagaatgctaaatgaaaatagttttagttccttttgatttatttgtcccaactctcattttggaaaaaataataaaacaagaggaactttaaacaaaatctgatacaaacacttatttctcttctctcctctcctctctcttcttttcatttctttttttcctttcctttcttcttttgagaagaggtctcactctgtggcccaggctggagtccagtggcatgatctctgttcactgcaacctccacctcccaggttcaagtgatcctcctgcctcagcctcccaaggagctgggactacaagcatgcgccaccacatctggcttatttttgtaattttagtagcgacaaggtttcaccatactggccaagctagtctcaaattcctgacctcaagtgatccgcccacccaggcctctcaaagtgctgggattataggcatgagccactgcacccagcccaaacactgaattttcaatgattcattatatttctagaaaattgctactactaatgaaaaattaatatgtggttgttttagccacaatttagtttgtataatataaaacattaagttactaaaaaaaaaaaaaaaaaaaactcaagttttgtaatttgtttttatatctagaggatggccaaaagcaagttatggttagtgaacggacagaagcctttaccactgctcgaaatttactggcctctggagctgatgctattgaaaggattatgtcttcatacaaagaggtacttgcatttcttattgtcaattcaattaaaataaaatttatgaaaatcaagcaaaatgtcaattaccaagtatacttagtattttggaaacatatcttttctctgccaaaaattgctgcgtataatcaagattaagggcagcaattcacaagtgtaatgctgctaatatcctttgttttataatactatcaattgttatctctctttttccctctatagtatgatatctttgttttcacattttaaagaaacccttaggtatgaactctggagccagagtgcctaaattttcattttatgaatttacaaattatgtgaccttgggtcaaggtcgctacagcgtctgtgtctctgtttcttcatctataaaatggggatatgataacactgacttgtggggttgttgtgagttgatacatgtagaaaatttaaaacagcacatattaaacactcaataaatgttagctaataacatttcttatatatctcgcaaacttttacctttccttcattaaatgggtaatactttcttaccattccgcattcttcctgcagagtttgggtcatcctgttttgtgtccatctcagtgtatgtctgatgttttaccacattatagctgtgtatattgcctgcatcacaccactcagctccttgaagcaggaactgtcttactcatctttacatttctaatatccattttcatacttggaatactgtgtggttaataaatatttgttgacaaaatagtaataagacctgcagataccacagggccaaggttaaaattacttaatttaattcagatattacacaatgttcccataaaattattctcactaccagttagtcttatggctatcatatcaatataaattctaaagcatctttgtaaatttagctgcatattaagtcagccttgaataaactatataaaagaattacaaagggctagcaagcaactcaatttttttaaaaagttcaaatagtaattttgataatctggagacacagtctttgggatagatttgttgatgtaataaattacttaaaattaaatgacaaatcaaaattttatttatctcacattaaaatattgtgctatctaggttagagaaatgataacaattagtttttctaaactgtctccaactcaacgaatgattgcattttgctttatttttgcctgaatttacttttaatcataaaatgttcacttctaaaaattcttgtactgctgtgacggcacatgaaagcacccaccatgccttctctgctagcaccagagggaccaagtttcctttgtagagttagggttctaagacaaattccctgtcttgtaccccagagtaatttgtctaccggcacattcttagtttttgtcagacacttcctaccgtcttcacattccatcctgatccactgactcattgcctcctgcctttcttgaattgacctctacttgtggttttggaattcttttctacccaaatatttatatttgcccaggtttcacttgaatccctattttgttgatctttaaatttgttttcctctacttgacaactcaagaggttcttccagataacattagaaatcatcatttaaatagctataacattaacatatagaaatgaaataacagtgtaattacagatctctcagtagagatgtgtttcagaaggcttttataataatacatactcatttactgcttatgttttgcatacacagaaattttacacaaatgtcagcattgttgtatttttccgcaatttattaagaaacatttatttctgagataccttgcttattcttgtgtattcttgtgcaagaactatccttagttcttgtgcattctgtttcattgagaaacatgttcttgataggaaatgagtcacctttcagagtaccctgatagcaaggtgttctcttaatagaaaaacagcaggaggttaaccaaaatgaacagctgagagaataggaacaaggcaccattccattgagctttgtggactaaagtagagatttagctcatcttataatcttacctagaaaaaaaaatatatttaatgtttttctttgggcatataaatcatgtttggcttcaaaagaagctggattgggggaattatactgaaaaggatttgaagcttttcattgagcttgctctcaatattggtatcctgccaaatagaggaattttgacaatcaatttggctcagaaacattcatttcataataggacaaaaaggtacttttctcctacttaaaatcttctattttaaatagaaaaaggtaccaaaaataaaagattataatttcattgaatgaccttaagctttccacaaaatttataatttattggaaatgaatttcatcatgtaaacagaggtcaaatcagaaatttgactgaaagatccttaagtgtcattaatattctgaaatctgtatattatgttttataatttcaatcaaacatattattgtgttatagtgctcttttgtactgtcatgtgttttagttttcagatgtattatatatatctcatgtataatgcaatataatcttttacattaagtcaagaagcttatctgattacatatttatttaaaatattgtcttggatatagtaactctattttatatctctgtgttgcttttaggtcactgaattagcaggctacactgctcgagtgtacaatatgttttgggtctttgatgaagtaaaaagaggcatttataagagaactgctgtcattcaagaatctgaaagccatagcaagaatggagctaaggtagaattacctctcagtgacacattggcaattaaaggtattaaactcaagtgcttttatattttcctatatttaagtatttatcaacagaaccaaagtttaagaaggtagcttttagtagttacaaagtaccaacatttaaataaccaacattatttaaacagcaatccctaatattagtattgcaatttgaggggtggtgactaacattaccacaaaaacacagtgttatgctacttttatttaggacacaattttccaaattatttttggaaactgcacatatggcataatgaatcgtttgcttttaaaattcatctaacaaatagaattcgagctaatgtcatgttgttcttcattatactgtttctaaacttaaatttggttacatattttttaaaattgcattattctatgtcttatttcccttttttgcagcactgtggttttttttctataggatatgttaatttagggaaatagagtagtagtaaaaattaaggctgggttatttcagattgtatagctttgctattgtaatgatgttgacattcaattattataaaatgtttctcagaaagatttttcaagtagatgtgtcaatatgtacaaatttgcattacattaaactttgcttcaggtctggatatctatatttacatttgtttctgtgatttattactgtgaattatctttataattgaaattacctgttatactgcataataatttacgttatttaatcagaaacctgtgataatgtttgtatcttacactttttcttaattacaggaaaaagttattgatgtggatcacggaattatttgtgaaaatgttcccataattacaccagcaggagaagtggtggcttccaggctaaacttcaaagtaagatgatattcaagaatcttctgattgttgccatcacactaatacaaaacaactcagaattcatgtaccttatgttaaatacttggaggagcatttggaaaggggaaatcaagaaaggtatgcacagtggctcaattacagaagcagttattcctcagaaagcagagagaaaagagaaatttgatttctactgctttattgccaggttgaaaatcaaaattatagtgtacaaggtaattttggggaacaataggaaatttcatgagaaatttgtacctggaaataaattttaattttttgccttatagaaattattttttaaaaagccaatactgtaatatatttactaaaatatgaatagaagtcattagcaagtttaattttgtcaatatacattatgtgacttaaatttttaaaataattacatgtactaatgtactattataaaataatcagaagatttatggattggaatttagtttttaattctgttgacaataatttcttatttaatatcttatgtattaattacaaaaactaaaaagtaaaagtatctaataaacctgactctctgacttaaggcattataaaattcaaacacatgttttgggattcaagtacaaaataatttgctgacaagcattaatgacataatatagcaagttgagcttagttcaaacaaagaaatgatttgacttgataaaagaattacaaacatgataacacatatgctaattaatgattttagtatggactttagtcaaggtttaattattaaagatgtatttgcaaatattttgggttactgagagttgagaggatgagtagcattgaacagggtaaaatcctgtgtcagtaaatttaaagaaattgtatttttagctgcaatttggtcagactttatttttccacatatagacctataggatgatctaattactaggatctgaccacaagcaccaattaggtactcatggcatacacagagtatttaactatttattaatggtttcataatttataatttatgattttatagagagggtgttttggtctggatacattttataatattgattcttgttgctctatttatttaataaatagtgtacatggcttgagctttgcttactaactacattagtgtgggcatatcacactctttctgcagaaaaatttagagccatttcttttacatagaataaactaaactaaaaatactcagtctagtgaaagtatcttagaaggtctgaagttgtacaaagatatgcattagtaaagtatactttcttcataattatttatttctaactcagacagaaaattatatttaaattctcaggtccctaaaatataataggaagttctgtttcctctgcatagattgaaaaataagtttctagaggaaaggatctcatacctttgttagccttcaggattaaaaaaccatttgcaggctgggcgcggtggctcatacctgtaatctcagccctttgagaggctgaggtgggcagatcacctgaggtcaggagttcgagaccagcctggccaacatggtgaaaccctgtctctactaaaaaatacaaaaattagccgggcattgtggtgggcacctgtaatcccagttactcgggagtctgaggcacaagaatcgcttgaacccaggaagcagaggttgtagtgagccaagatcatgccactgcactccaacctgagacagaataagactcagtataaaaaataaataaataaataaataaataaataaataaataaataaaatttttaaaaaattaaaaattatttgcagaagaaaagttagtgtgagacaaaaagaattctaagcatcagagacctttatgctgagaaaaatattaatattaatgtagaaagtctccaattacccctcaaaatgtgttaaatttctgagaatgcctaatagagaatggccctattgaaatattttgccaatgtgcttttcaccatgatatatatgattttttaaaaatcatttggaaaatatttacgcttctacaaaattaaacccttagccttttctctagtgaaagagcacaggcagataacaaattaattttttctagcttcttcctgagattttcttggtgtgctagcaatataataatactctttcatctttgaggtccagtatgatgtattccacattattgatacttgaatattggtatcctttctatacaaagctagatctacagacatcctgtaaatttctgatatttattttttgggtatcactgattataaaatttcatttgctcttggtagaagtagataaaaattttaaatggtgtttctgttgattgttgttcacaataccctttaaataccataataagacaacttcttcatcctattgtgtggaataggaactcatgaaattaaacagtttaaatgtcaataataggatagaaaataaagggaagcatccaatagataagaaataaataacctgttttatttatgaatattatatatatatattattcacatatatgtaatattctatgtgtgtatgtattttaattcatccctagacatgagactaaaatacaatcctcttgctttcctctatccttggtttgttaaacatattttctctatttgtgaataaagcagaatttgaatcatcttctctctctgattatgggcttttgtgatttttgtagcatttcagactgctgaagtgtaaaattaaacagcccagctgactccttggataactgtgctttgtagctattaattgcagttaattttcagttgtatttgaattcaatgtaaatttaatccaatattaatatcaaaatataatgtaatatatttttagttaaatttttatgatttgtcttatttcccaggcagctgtttttctctatgtgtatgtggtatctgataacaaattacaattttggaaagccagtgcccatttcaagaagatccattttctttggaattgaattattttatgatgcttttagcttcagagaatagtcaaaagccaaacttgttctcaaccctgaaatatttttccttgatcttttgcccaacctaggttatcatgttttcgaacattttaaaaaaataatttacttttaggtgctgccaaaataaatcattttaaactattgcagtttgtaattttatttcttactttaggtagaagaaggaatgcatcttttgataactggtcccaatggttgtgggaaaagttctctcttcagaattctaagtgggctctggcctgtgtatgaaggagtcctctataaaccacctcctcaacatatgttttatattccacaaaggtaggtatatctttttatattacaagaaacaatttccttttgctcttgaattgtcttgattcctcaagttcctcagtttatatatctttaagaatgtttttattaagagaaactattaaggaaataaaaattcacttagcccaaaatattttattactgctttgattgtaatactctgtaggacaataccactttttttcattttcacatctgtctagatggaataaatactcaaagactgcagatgttagtctcaaggaataacaagcaggctgtttcagagaatgattagattgcctgagatgtcagattatttcttctcacagaaaaataataacacccggataagtatacagctctctccatcaagctgcatacattcatatattctaaaattgttcatttatatttgaggatccataaaatagactttacaattatgctatatgattatttagcgatttgtaactttcttaagtaaatttttttactgtaagaatgagtatcatgtaaacatagaaaaagaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16369 - DNA, 136917 bp, Human
aggtgcccagattctgaggtaggtgccataggaatattcctcatagcacaagcattatgtcggacaatgttctgcttatctattactgagtaacaaacctctctaaaacttagaggcttaaaataacataaatcataatttatgaaaaattataaataattcatcacttaagggttaaatgataaatgagttatttcttaggattttggataagtcacagttaggaaagacctgttactgttgtaggtaacatggaacagcccagacggttggaataacccaacccagatagcttcttcactcaatgactgatcccttagctaggatggctccaccagctgagcggcccagctctccctctccaagtccaagtggtctctgcacatggtttctctccagcaaggtggctaacggggtgcagctcatgaccaccaacagctcaaaatcaaggctgccaggtctttttttttttttgagacagagtctcgctctgtcccccaggctggagtgcagtggcgcgatcacgactctctgcaacctctgcctcctggattcaagcgactctcctgagtagctgggattacaggtgtgtgccaccacgcccggctaatttttgtattttttgtagagacagggtttcaccacgtcgatcagggtggtctcgaacttctgacctcgtgatctgcccgcctcggcctcccaaggtgctgggattacagacgtgagccaccgtgcccggccaaggctgccaggtcttttttaagctcagagctagaaacaagacattgctactcctaccaacttcttctattggtgaaattgagtcatggtttctcatggtctcaatcatgacccagcccagattccagggtcaaggaccataaaaggctacattgatggaagacatgtctcattgagggacaccagagtaacaactaccagacaagaaggggcaggtctgtgtgagcgccatttcctaattctatattgcccactcttcagagaagatggttggagggcaaattgtggggagcaaggtaactccaaacttttacaaaattaaaggtagggggtctggtcagctacagtccatctgttatcaagaggcctggctgtgtgtcttcattcagtttattaggcatttactgagcacagcctacatgccaggttcttcattttttgacacagggtcttgtgttgcccaggctggagtgcagtgctgcgactgcggctcactgcagccttgacctctccagactcaagcgatcctcctgcctcagcctctggagtagctggggatacaggcgcgcaccaccatgctcggctaatttttgtatttttagtagagacagtgtctcaccctgttggccaggctggtctcggatcccagagatcaagtgatccgcctgcctcagtttcccaaagtgctgggattacaggcgtaagcctccgcgcccggcctatgccaggttctacatgtgttctttcttgactcttgtgttacagaggctcgaatgaagcctggcttctacagtaccgcacccagcacctcgctgcgatgcagcctcctgtaccctttccgtccggcagctggagttagggcagagtgccgggtctctaggagggcaacactcaacgcagtcggctcctaggcatccagtggggctgcaaccccgccgccggggacgaaaggcgaagggggaaaactagagctttcgccggccgggacagcgcagccgggtttcagctcgttctacggtccacgtcagaagatcgcctccggcgccgcggacgccggagaccactgtctgcgcccccgcacgcacgcacccacgtactcgcgcacgcgcgcgccggccccgcccaccgccccgctgtggcccctttggaccgcacgagccaccgtccgcacagccccgccccgcacggccaggcgaagcggagccggccgtgcggtgtgtgtgtatgtgttcgcggggcgccgtctcagccccgggaagatggtggctgcagcggcggcaactgaggcaaggctgaggaggaggacggcggcgacggcagcgctcgcgggcaggagcggcgggccgcactgggactgggacgtgaccagggctgggaggccggggctgggggccgggctgcgcctcccgcggctgctgtctccaccgctgcggccacggctgctgctgctgctgttgttgctctcgccgccgctgctgctgctgctgctgccctgtgaggccgaggccgcggcggcggcggcggcggtgtcgggctcagccgcagccgaggccaaggaatgtgaccggccctgtgtcaacggcggtcgctgcaaccctggcaccggccagtgcgtctgccccgccggctgggtgggcgagcaatgccagcactgcgggggccgcttcaggtgagtggcgggtggtgtcggagggtcgggtccaaccagaggctggggctgaggggcgttcgagacggctccaggtcagagggagatgctggacagaaagtggagagggtagggccgccctatggggtttgagggccatttgcttccggggagatcatcgtctctggcctggggtctttctctgttggaaggtgaaaaggtgtggggcaagggtgggggcaccccgacggtatttgggtgcttaggttagttagatgggaagaatgctgagggacccaaagaacatcaaagccgatcgctctaaaactcggcgtgtttcagctaaacgaggtatccaaggaaaggtggtcgagccaggtttgcttgaacacttccttttaacatccacatgtgccctaggacccgatgagttccccgatgcactggagatgtggggtgctctgaagaaacagggccctggaaatgctttgttggctggagataaaagggaaagggtagcattgtaagatattagggatagaaggaccagtggtccttctaaaggaaagtgaggaaactagccttttggcaaaagctccctggaggtggcaaattggaatagggtctgtggtgaagagggaatggaaggagattcctatttgccttggtttctggacaatatgaagttctgaattggcttagtttggggcagttcctcttggagaaatcaataaattaattagcagttatcgttatttgcttcagttgtgcaatgattttccagataatacagacagattagccagactttggccttgtccacagggagtttggaatatagcaagagaaagataatgtgcgcacataaccctagtcataagggttacagagtcattcacgcctttgacaggtatttagcttactgaacacatgtctgatgtgggggagtggggaaatgtgaacaagacagacagggcctctgctctcattgaccttaacattctagtgggagcaacaggcacttaacaagtaaataaatgagagaaatgaacatggtaatttcaggtaatggtaaatgctatcaagaaaataaaaacagcgtggtctgatagagaattataaccggtggtgactcttggagaaggttctcatttgaaatgacatttgatctgagacctgaatgaggcaacagggaacttgtgggaattcagggatggagaggttgtggctagctggagggatgcaaggaggactttgaggaggcggtaacattggatttgagcatgtaaggttaagtaggatttggaaatgtggagctggaaaaaaattacagatggaaagaagggtgcaaacaaagttgtggaggctggaaagtaaagttttgctgctgcctatgtggaagagagttgtgagagaggagtttggaatagcaaaattgtagacttaggtaatattaggtcttctgaggaactcagagaacgttgagcagatgagctctttagttttatggatggagaaaccaagttacttcaggaccactgatgcagtgaagctgcttttgtaacttagggtgttctgatttatgaattccattaacctacatgtatttgttgagggctcctatgttttaggttgtgagatacagtggtatacaagacaggcacagtcctgctcttacggagctcacatttcagcttgggagtaaaaaaatccaacaaaaattttattgtaattttgtttaaggctgtggaggtaaagagcaggagacaaacagaggacttgacttagtctaggggtaaggtaagtcactgaggaagcgatgtgaagtctgaggggtgagatggtactacctgcgtgaggggtggggtgctgaggggccagcaggtacagaggcttggggttgaagcggatggaaggccaggtggcaggagcagagagagcaaaggggagcttggcaagactggagagaaaggcgggaagccaggccaagtggagatctgtgggttggattgagaattttgacctttagcccaagagctgtgaaatggcgtagttcacgcctattttcatgacattataggcttttagattggagccagaatacaaatggccttgaaggtgaggccagggcattttccatttgagaagcttccaaggtcaggtgaatggatggttgagtcagacgaggatccttcaagttctgaaaacctgggacactgtggtaggcagtggggaccagcggtgtgggaaggggacttcatagcaagatcaatctgtaatgttcagagtaggtacactcactttgggcatgagagatagggggcagctaggtgggatctgttggcatgggtcagagcagtggtaatgagagcttgtagaggtgaaatggacaagtcttccgtgtaaactggtttgctcttggaaaggtgggggatggtgagggaaagaaaactagatcctgtcttgggtggttgagaggacagtgataccattaacagacacagggacacaggagcaggtgttagacatttaattgcatgcatgctgagtttggggtgctctcagagtacacacctggcagatgttaagtttggagtcatcgacctatgagggagattgccagggagctctctctgagagtccacatggaaagcccagaggattggataagagctacttgttgcagggaacaggcagtcctgacactggttgtctcaaatagtgtcacaggtgagtgaagggactcccctgcttattgtggacattccctttgagctgattctaggtgatgtcagtgctgtttcctgggtagacaattatgactttggtcctgatgataccattatattttgtgggctttgggattttgcatttttaaaaatgaaagtaggaggaacttatgactctggtcttttaaaaaaaactcagtaggccaggcgtggtggctaacacctgtaatcccagcactttgggaggccgaggcggtgtatcacgaggtcaggagatcgagaccatcctggctaacttggtgaaaccccgtctccactaaaaatacaaaaaattagccgggcgtggtggcgggcacctgtagtcccagctactcgggaggctgaggcaggagaatggcgtgaacccgggaggcagagcttgcagtgagccgagatcgcaccactgcactccagcctgggtgacagagcgagagtccatctcaaaacaacaacaacaacaacaaaaactcaataaaattttagtcgaggccaagcgcggtgactcacgcctgtaatcccagcactttgggaggctgaggcgggcagatcaagaggttaggagttgagaccagcctggccaacatagtgaatccccgtctctactaaaaatacaaaaaattacctgggcatggtggcaggcgcctgtgatcccagctactcgggaggctgaggcaggagaattgcttgaacccgggaagcggaggttgcagagagccgagattgcgccattgcactccagaccaggcgagggtgtgagactccatctcaaaaaaaaaaaaaaaaaaaaaaatttagtccaagtattcttttgggggcaagagtgaaatgttggttttgattgcagtggcttgtatcttgattgaacttacaaacctctttgttattaaaagacattaaatgaatacctttctgatttagaatggcatcaagttggagtgttttttgagctttttagtcctgtaaatcctgtgttataattgccgttatagggttttttcattaattgaagggaacgtaggctaacgaggagtggatttccctaaggttatcactgagtgcagactatgtgccacagagcattttcatgtacattgtattatttaatcctcaggacaactctgagggtgttatataaaatttagattattgaattattgtagttagtaacattttttctaaataaaagatgacatagaaatgactgattttaaaggataagttaaaggatgtcagtttaataaaaatacctatagaatctttggtgtgtgatttctaaggcagtaccactttcgttcattcttatgtgaatcttcataattcagtgatcatttttttctacttgtaaggtcaccagtgtaatttttcttcgaaggataaatatgcccataggataaattaagctcatttttgaatttaatattcattcaattcttttaagttcctgctgtagaaaatgtttgggagaattgaatagaataatctggtgaattggattgagcctgataatgttaagatgtaccttctgtagaaaaaaaaagaaaggaactaagcacttatcagacatctgttttgtgcccagcacatacagtaataatagtgggtgggtgtagtagctcacacctgtaatcccaacactttgggaggcagaggcagaagaatcacttgagcccaggagtttgagaccaacctgggcaacaaagtgagagctcctcactaccaaaaaaaagaaagttagctgggtgtgttggcatgtgcctgtggtcccagctacatgggaggctgatgcaggaggatggcttgagcccaggaggttgaggctgcagtgagccataatcatgccactgcattccatcctgggcaacaaagcgagacccttgtcacaaaaaaacaaagcaaaacaaaaaatatgtatatagtgccaactgcctattagaaataactcccttttagtccttagagtgaagttattcccatttcacagatgagtaaacttggatgtactgaataacttgtccaaggtcacagaagttgtgcaaaattgagatttgaactcagggttgtctaatgcccaaacctgtgttctttttattataccatttggcgtctcatttttttctgagtccagtcactctttatggacgttctttgaaggactgacctaattccaacaaacattttgagaaataaaggaaggaaaatagatttttacaataggaaagctaacattttaaaaatcttaaattcacttcagtctctctggctgacgatctgaggacataaatacctttttaactaatgaaatgaaaattcttgcctgggcgcagtggctcacgcctgtaatcccagcactttgggaggctgaggcgggcggatcgcctgaggtcaggagttcgagactagcctgaccaacatggtgaaaccccgtctccactaaaaattcaaaaaattagccaggcatggtggcgagcgcctgtaatcccagctactcaggaggctgaggcaggagaatcgctcaaatccaggaggcagaggttgcagtgagccgagattgtgccattgcactccagcctggacaacaaaagcaaaactctgtctcgaaagaaagaaagaaaattcttgaaaacaaaatgtgaagaagtgaaaagttaaaacttttttcttatagtaattactaagtgatgtcaacctcaagccctaaatttatgttcacaagtccagtttaggctgatctgctttccccagtgcaatgtaagttccatgagggcaggggcctggagcatagttcacaagtccagtttaggctgatctgctttccccagtgcaatgtaagttccatgagggcaggggcctggagcatagttcacaagtccagtttaggctgatctgctttccccagtgcaatgtaagttccatgagggcaggggcctggagcatagttcacaagtccagtttaggctgatctgttttccccagtgcaatgtaagttccatgagggcaggggcctggagcatagttcacaagtccagtttaggctgatctgctttccccagtgcaatgtaagttccatgagggcaggggcctggagcatagttcacaagtccagtttaggctgatctgctttccccagtacaatgtaagttccatgagggcaggggcctggagcatagttcacaagtccagtttaggctgatctgctttccccagtgcaatgtaagttccatgagggcaggggcctggagcatagtgagcagtaaatatctgttgaatgaaggaataaaattctgtaatttacttcttatgacttttaaaaaagtcgtctttacccacatgactgccatatatgtcttctgtccttatattgctcctgaacttctctgtcatccactgtttggtgggcatcttttattgtcacctcatactgaatcatgtataacaccaaacttctatcctcattgaaaaaaatagtctttttctttgtacttccttatttgttttagctaaatccaaatttagctaaccaaaggtcaaaacttagcagtaatctttggctctttctacctgtttgtttttttctgctctcacactgtataaatttgtttctttccatttcttctgctgccattctaatgtacctaacccttcacctcattgctgacctgcttctgttgcacttttactgttttcttacacctgcagagtctgcttcacactttgtcatatcagtcttctaaaaaacatgtgtctctatgcacacgtatgtttattgcagcactattcacaatagcaaagacttggaaccaaccactgatgggctatccagcccatcagtgatagactggataaagaaaatgtggcacatatacaccgtggaatactgtgcagccataaaaaatggtgagttcatgttctttgcagggacatggatgaagctggaaaccatcattcttagcaaactaacacaggaacagaaaaccaaacaccgcatgttctcactcgtaagtgggagcagggaggggaacatcacacactggggctttcggtgggtagggggataggggagggatagcattaggagaaatagctaatgtagagtatgggttgatgggtgcagtaaaccactgtggcacgtgtatgtctgtgtaacaaatctgcacgttctgcacatatatcccagaacttaaagtgtaataaaaaacaaaaacatgtgtctcttattttgcttcttttattacctctaaaatgatcctcagcagaaggatcccattcctttcacatccctttttttcctaaccaaatctttctacttcgtagtttttctgtgtttgctaaattcagcacctccctcctcactgctcccccattctttcttttcatctctacttaccaaggcccaccttcagttctctataatctataattcatacccttttttttttttttttttttgagagacaaggtcttattctgtcatctaggctggagggcagtgctcctgggctcaagtgatcctgccacctcagcctcccaagtggctgggatcacaggccagtgtgcccagccaatttttaaattttttgtagagatgaggtctcactatgttgcccaggccaatctggaactcctgtccccaagagatcatctcgtcttgacctcccaaagtgctgggattacaggcatgagccactgcacctgacccctattatcttcttttgaaatgagtcatctgctaattcacttcataaatatctgctgaatattgtgtgttaggtactgtgcccttccttgaggatatgaaggtgtgtaagaatcaggccttgctttcccctaagagaagttataactatgaagggaagacagctacgtacacagcaattagaatttcataataaaaatacaggcaatatgtggtgctggactaagatgtgattgacttaactcttttgggggttctggtggaagacatcacagaagagaggacatttgggcaggtctgagaggtttagtgtgagtagaccatctgggggagaaagacattccagaaggaatgaagagttgatgtgcaaaggcaaagaattatggattatcatacttagtgtattaatttccaagggctgttacagtgaagtgccacaaactcatggcataaaacaacagaaatttattctttcatagttctggggactagaagcctgcaatcaaggtactggcagggccacgatctctctgaagactctcagggaggatctgttccatgcctttctcttcgcttctggagttgccagcagtccttggcattttggcttgtagatgcatcacttcagcctctgcctccgtcccttcaatctcatgtgatactctccctccctttgtgtctctgtcttttctcttaagggtaccagtcatagtggatgaacgagtatgacatcatcgtaactttgttgcatctgccaagaccctgtttccaaataaggtcacattcacagggacccagggttaggactttgacatatctttttggggaacacagtacaacccacagcacctggagaactgaatgtaggtgcctgttgttggaacataacttgtgaggggtgtaatggaaggaagggggtgaggttgtaaggttataatggcctctttttgtcccttcccaacaatctccagcttctgggtttatgcttgacctaggataagccctcagggcattccagtttctggccgtgctgattgttttgaaatgggtttatgattgattttaatggactcaatcagagtgaatctcaggacttttgtcggagatccctttcctctgtgggcgtttagaaggacatgtgttgccttcttttctgtgtggcgaggccataatgcctagaactgttaagagttagcgttgctgctgtaaggaattcacctcaggtcagaacaactcccagaagatggaggatggcagagaaatggagccggagacctgataactttctgaatctctggatcaaaacttgcctgaaggtgtagtttttggtttgtgaagtactgcagtccatgtttttcttaagccggttagagttggatttccttccacttacagtagaacaattcctaacatacagagggagggaggtagagccagctgactagggttagtcagttagggcttctgtaacaaattaccatagactttacctcgatgaaaggttcccaagatgggcagatgctttttatttaccgcagtatagaggacaggtatgtacgcaggagaaaaaggagagtgtgtgtttatgatcagaacagttttgatcatataaatgtgattaagtgatttaatacatttgtaggttatttttatcttaagaaatacagaagtgagtacctagtgttatgattgaacagaaatcttacactggtttttcttgttaatacaatcatatttccaaaactgaaatgaaactatagttgtactttttgaaatacttgtgtctggaaattggccattaacttactatgatacttgtttcccacttaaatagtactctcctattttctgtgaattcccaaatgcattttggcaagtgacttccatctatatactatatactgttctcatctttcatttttactttgttccttccattttcccttttctttctatacttcaaactgctctgttattattaacgtgacttccttcttatgagggctttcttatatttgtcttgcttttttcccacttttcattttctttatgtcatatctctttaactgcttttcttttatcactgagaccatggttcgatatcctttcaattaaaacattgaaaaagttttttttctttttctgctagtggattgatcttcgagtgtttgagacaggggcttaccctgtcacccgtgctgaagtgcggtggtgcaatcactgctcactgcagccttgaccaccttgagcctctgggctcaagtgcctcccacctcagcgtcctgagtagctagaactgcaggtgcgcaccaccatgcctggctaattttttaattttgtggagatgaggtctcactatgtcgcccaggctgatctcgaactcctgggttcaagcaatcctctcatctgcgcctgccaaagtgctgggattacagatgagagccaccatgcttggaccctttaaatttttaattaagttttcagtttttttcagtttgcgttttgggtggacttcagttctagctgtttatttacatgcttacctattgagaattttctgtttttcacttagagaagttaattttagtaatgggtgaatttccttttttttttttttttttttttagaatttgacattaaaagtatacaattattaaatgaatgaattttccaattaatttctcttggtcctttttgtattttaagaattttttgattggtttactaataagccagtaaacattaggggctggaattctgtcagttgctgttaagagtcacataagtaacctcccttgacctgtgttttctaaatttttaaattcacagatcctttcacaaaaatgtataatcttatggactcccgtaggaattaaaaaataataatcttttaaaaaatgtatcctgtttttaagataattttaaataaagtaaaagtagtttgttaataaagattataatgtctattttaaatataatttataatgatattcaaaggaaaatttgaccttactctatttaaaacgtggtgcatatattgtttcatgtactttaattatgtaaggaaaagcatgagttgtagacaaaaaaaaaagacattacattttgggataaaatgtatattaacatagagattgaatttaactgtgttttgtgctattaaaaatagttttcctgtcctaatgtttgatattcataaatatgtgctttcacaattattttttagaatttttttgcgtgttttgattctgaatgataaaatgatagcgattttcagctatttgtaagcatttctctgcaaataacacatttcctgtttggatagtttttctctaaattgaatgaaaaggccaacctggctataattgtcactcagttttcccttttgaacactgtttttgaagtactggagatatcaaggattttgatcagaaggtttggcaaagatgatcttgagacagatctgcagaattagattcattttatgccttctcagaacttatatataaatatcattgtgtcttatgcttctcttttgatagatgacatgactgtcttttaatgggagcagtatttggacaactctttgagaaacactgaccaatactgacaaaatgtataactcatttttttaaagtgatgatatgtttagtgctggttcagtctctgaactaactataacttcctattaatatgaaatatttgaagcctatggaagagatgcgaggaatatctctttgtacttgcaacctggtttttctgaattttcttcatattaatgttattctaaaaagtaaaatgttacagatactgaccaaggtccccatgttaccaccccttcttaatcctcttcaccgtaccctttccccagaggtaactagtatggtgaagttgatgtttattatttctcttgcatgtttctactcttattacagagagtacagagagatatttctgcaaacaatatcttattcccaaaaacatgtagcattttttaatcttgagatgagatatgctggagatttatctgttgataaatgtagttctagtggattcatagttaatattaattacagaaggattccagtttacttacccattttcctgctgatgggcatttagagttttccaacttttgctgttacaaatagtactacaattacattctttttttttgtgacagggtctcactctatgaaccaggctagagtgcagtgatgtaatcaccgctcactgcagccctgaccttcagggcttaggtgatcctcccacctcagcctctggaatagctgagactacaggcatgtgccaccacacccagctaattttttgtgtttttagtagagaccaggcttcactatgttgcccgggctgatcttgaactcctggcctaagcaatttgcctgcctggggctctcagagtgctgggattgcaggtgtgagccaccatgcccggcccaattagcattctttacctatctctttttgcatacatgtgtgatttttctctagggtagtgatcttcagtcttttgaaacacctccaaaataactgaaattctttttacttccttgctttcaggttgacatgcagttgacacatattatttttcaaaaaaaaacagatttatagagttgaagagatacaatttctgtatattataaatagagctgctgaaaaaattccccattatacagtattactttaaaaatatttattgagtagaatccaaattccatagcagtttaataacctttctcattttaaaaaatacatgaggccgggcatgatgactcacaccataatcccagcactttgggaggctgaggtgagaggattgcttaagcccaggagtttgagaccagtctgggcaacatagggagaccccatctctataaaaaaatttaaaaatttgcagggcatgatagcacataactgtagtcttagctacttgggaagttgaggtgggagggtcacttgagcccagcagtttgaggctgcagtgagctaagatcacactactgcattctatcctggatgacagagagggaccttgtctttaaaaaaaaaaaaacaacaaagaaaccaaaacccacatgtagtaaatgttattattcttttcctttatggcttgtcctttttgtgttatattataaaattcctttcctgtactgaccttgtaaatatactcttctatattttacttcctcaaaatttaaaatttttgctttattccattctgatcttttatccacctgtaacttgtttctgtgaatgatttgttatattgacctaatttaattatctttatatggtaagcggttgttgcagttccatttatagaacagttttgcccctgctccccgtttgtattgaattgtgctataatcatttaaaacttcagacttgtcttgattgttcttaactcttggctcccctaatttcaacaaaaatccctgttgatattttgttggaatttcacctgatgttgagataagcctggggaaatctgtcatctttattatagagggtctttccatccttcgcatccttctggaaagatgctttatatttccagtttaggtctcatatctttcagtaaattcttatagcttttttcaaatgatctgacacacttttattagatttactactcgatagagaattttgttattactagaaactaattgattactatagtacctaggaatggattttaaaattattattattatatattattattattattattattattgcactgagtaatatttagctcatgagtatctgtatttatctgggcacctctctgaagtctggtaaacttattcacctgtctggatctaggcaggaggttgactgggctcagctggtggggatgggggtgtcacagctgtcacatctctttgtaccagaggctggctgagcctcaccatcatggtgatggcagaagtgcaaaggcagaatttatttcctcgtattttgaatttttatatctatgaatccttcctaagctcttgtagtactggtagcttgtgtgtggattctcctgttccccatgttgatagtcatgctgccaataagttgtgacagtttacttctaaactgtatacaccttctttctttttcttgtgtaattaatgagctagttcatgttgttgaatattatcaatgtaggacattgttgaatggtcttgatcctgactttaaaaagaatcctatggaatagttccctgcacatagaaggtggcctgtgattatattgatttttgtcttttcatctgttaatgtggtaaattacacttacatactttttaattgttagaccatctttgtattcctgagttgaacccattttggccatgatatgttttttaatacagatttttagatttggtttgccaatacatttttttgaggttttttttttttttttttttttttttttgagttggagtcttgccctgtcgtccaggctggagtgcaatggtgcgatcttggctcactgcaacctctgcctcctgggttcaagcaattctcctgcctcagcctcccaagtagctgggattacaggtgcctgccaccatgcctggcttatttttgtatttttagtagagacggggtttcaccatgtcggtcaggctggtctcaaactcctgacctcataatcctcctgcctcagcctcccaaagtgctgggattacaggcataagccaccccgcccagcctgaatttttgaactgtgcttgtgagcttttcttttggcaagcatgtcagattttgtctgttgttttattttgtcttcacccttgaatgctcatatagctgggtctggaatttaagattgatcattattttctttgagcaatttgaatgtttttttccaatgtcttctgatttttattactgatgtttcaaagtcagctgtcagtctaattcattcataggtaattttttttctttctctcttttttagcttcttactctggaaaatttcaaataaacaaaaatggaaggtataacaagtgtgacgtgtctgtcaccagcttcaacatttgcaactcatagccagtctttttcacttttaccactgccccattcccatgccttcccctcctcccaccagccagcatagattattttgaagtaaatctcaggtgccattttgtttccttctggttgtttttcttttcctttttctttttttcctttttatttttatttttatttttttgagacagagtcttgctctttcactcatgctggattgcagtggtgtgatcttgactcactgcaacctctgtttcccgagttcaagcgattctggtgcttcaccttcctgagtagttgaaattacagttgtgtgccacttttttatttttagtagatatggggtttcactgttgtctcgaattcctggcctcaagtaatctgtccgccttggcctcccaaagtgctgggattacaggtgtgagccaccacaccaaaccattctggttttttataagtgctcttgcttttactcatagtctatctctgttatttttttctttccctttctcttttggttgattgtattaacgtagtattactatgatgtgcccaaatgtggatttatttttattttgctcagtgtatgtgcattctttatctgaggattcaagtctgttatcatttctgggaaattctcaggtattatcttttgaaagcttcctttacattttatttgttattatctcttagtacgacttttagacagacacatgttgcctattctttttattctgtttactttctacttctcataatttttatctatttccctctgttgcattcaggataatttcctcagatctgttctctagttcacaaattctcactttaactgtatctaatttgtggtgtaacttgttaaattttcattttcagtgactgtatttttaatttctagaggttttatcttttattaataaaactggctgcttattttcatagtgttattttttgatacttttgatcctattgtgcctttaagcaattttaattaattaattaattttttgagaccgagtcttcttgttgcccaggctggagtgcagtggcatgatctcggctcactgcaacctccgcctcccaggtttaagcagttctctaccttagcctcgcgagtagctgggattacagatgcgtgccaccacacccagctaatttttgtatttttagtagagacagggtttcaccatcttggccaggctggtcttgaactcctgatcttgtgatccacccgcgttggcctcccaaagttaaatttattttatgttctttattggattgttctagtaactgaactttatagggtctaatgctgttgttagtttgctgatttttgttcatggtacattgcttcaattttgtcaaaaatttgagttcctcttcagtgagactttatcaatggacatatgtctctagagagagtttgtgattacttcttctagatatctttgggggtattctgacctggggctactttctatgttaattttattttcttatgggtacctagaacccaagtgagggtggtatgtattagaactcaaatgggtgtgggactcgttatgaagtcattgggagggattttcccctgccttggtccatgctgaaactgctttcttgttgcttttctgtgcctaagagctgggtttggtttttaaaagctctttaagggttccacccttcttgaagggctctcggttccaattccctgccttacatggacctaggcctcagtgtcttccttttgagcatttagatccagattattttatagaagatgatatgctcttggatcatggggattgacagcctctcacaggacactatggagttggctaacatgttccctgctctgattttcaggtctctatttttggcctttactgatttctcttactttttttcaggttcagctggcagttaaaatgatgttatattgcagattgcatttacttcttgattttaacgtagtgaaatgtattgatttttttccctttttgtgtcttgttgaaatctttccctattccaagatcgtggagatattcttctgtattgtcttctggacatttcattgttttgtctttcacacttaaatctacagtccacctagagaaagagtgtgtgtgtgtggtgcgaggttagagacacatttatttgctttatgcatattcagattcacatttattagagccacatttatttgctttatgcatatccaatcccattttttgagaagacctttcttttcccagtgctctgtagtgctgcgtctgttatcaatcaggtgtttatgtatatatgatctgtttctggactttctgttctattcctttggtccgtttgtctatccttatgccagtaatactgcactatcttaattagtatggatttatgttaagtcaccttaccttattcttgttctttttcaggtttattttggctcttcttggtccatggcatttccatatagattttagaatcaccttgttcatttttgacaagaagaatatcttgagaatatgattaggttggtaatgaacctataactcagtttggagtgaattgacagcttttataatgttgagtcttccgaaccacaaacatggtatatacctttatttatttaaatcttttctaatttgtcttaatgctttataattttctatgcagaggtcttgtagatctctttccaagatatttgatgtttgtttgtttgtttgtttgtttgttttttgagacggagtctcactctgttgcccaggctggagtgcagtggcgtgatcttggctcactgcaacctccgcctcctgggttcaagcaattctcctgcctcagcctcccaagtagctgggattacggttgtgcgccaccatgccagactaatttttgtatttttattagagatggggtttcaccatgttggccaggttggtcttgaactcctgacctcaagtgatctgcttgcctcggcctcccaatgtgctggcattacaggtgtgagccacagatatttgatgttttttatacttttgtaaattgtatctttaaatttttttttgaacaaggtctggttttattttctggcagaatcttttaaaatataaaacagataaaacacatctcagccctgcaatctgccagcatgccttgtttctacaggatgcatgctagaccatgagactacgtagcaaagggtctttaagagaatttggttgggagaaatagaaaaaacagatctcagggaagcctgggctagcccaaaagctgagctacatccctgagcactagagcagtccttgtcttttcagatcctcatatgtcttcttattcacaacattcccacttgagtcttcatattcttcctccagtgtcaggctgccatcattctgaagccttctgcaatttgaatttggcccacaaggagacagcatcttcaatctgcgtcacattagcaaagtgagcagtgtttgggatgcccaaacacctcatgccatgagcatgatgctattcagcaaagtgtcactggaaggctttgcgcccttggtaggtgtagtttccacaaatctcacagttatagttgatatttaggccatgaagcttatatagccagtagggaatgcgtttgccatcccagccaagtggcaggtttttggggttgtaaatgatctcgttcttttcatcttcactctcactcttactgatctgctcttcttgctcttctcctgtccttgcttgcttgcactgtgcattttcatgagtgagatgttgctgttccctgagagtcagagtattcatagatctgggcttctagaaaagcaatgtctttgttctctcaatgtctcgcttggtgccctttgatttgggatttttggcaaacaaagagttatcaagtgactccagggactttcctttggtactgaatagtctctgggcttgctcttctacggtccgccacatttcaagcctaaagctaagagagcagatttcaatctgtccaaacccagagaggccaactcctcccaggaggagaaggcggagaggtcaagatgggctccagcatgggtcagagcgctgcttgtctctttcgcccatccaggaaggtcacattctcccatttcttctcaaactcagcctgaatcttcccaaaaagttcattctgatcttggagaggctttactctatctgtgtaatcctgaagttactcaagcagcatctctaggtatctcttatactctgcattcttcctttctttaggaatgtcaaataattggtcagagatggacaggtatgtgatataatccagcttctcagatgccttcacgttaatgtacttgaggtaacagtcacggagatcgaggtaacgaccatatccctcttcatctgtgaactccaccaagttttgtgcctcttcacttggattctctgagccttcaggagctcctcaaatttcactgacattggcacacagatctcatttgggtgcttctggtggaattcctttatttactcgagtctattatagaattcagcaaactcactgggtcctgaaatggcattgagttcctcctttcataatccatctttatcatcatacagatccctcaggttcccactgacctccatatacctatcttgcatggcctgagtgcggtgatcagaattgagcgtggacttcttagtgagcatctctttggccatgacgtccatgagcctttccttctcctcatgatagcgccgctgctgctccagtattgtctccatcttcctttagccgcagcctctcttaaaaattttatgattagttgtttgctgctggttaaaggaaatgcagtggactttttgcacctttcctaaagtattttattgattctaataattatctgcagattattagctctctgggggaaaaaaatcaaaaaaaacccttctttgatcccccgtgtcttctccaaatgtggcctcatttctgtgtttcattttacaacaaaactcctgcaaatgaaattgttctcttgttaacatctcctacttcctcacttccaattttctcattaacttatggctgctagagatcataggggcagcagtgtccacagcttgtcaaatccagtggttaattctctggccttgtcttactaaacttcataacgtttcactgcttcctttttgaaaacttgcttctggatttctgggactccatgctctctctcttttttgccatgcttgactgactgctcatttgcagactttgtcttcttctggcttctaaaagttagagttcttctgggtacttgctgtgcatctgcactcaatcgtcttctgtatctgtacctgaaactcagatgttcttctcagtctggggactttgaatactgtaacattgaacttttgatttttattccaagcctgtttgaccctcagttttcttagcatttgtatgagaccactcaggctagaaacctgggtgttttctttattcccatttactcacttgcaaactattattaaatcttgtctgttcaacccccaaaacttatctaagtatctgctggtattcttttttcttcatttgtgggtagaagcaagattgtgtaggtctttgtagtcttaaataaccataaaaaatttctggaaagtgtaaggttgtatgcaaataaaaggtatcagatggctaagaggagtggagttaaatatcaggatccttaaacttcttttctttatcttgcccattgccttttcttttctttcattgctatatatttacgtggactctttcaaagagattatagttacagagacctgatagccaacaggttgaatgtaagccttatttgtgcttatttttgcctaatattcagggccctgtgagagattctggttgttgaatatacaagaagggttgagagcatattctagataggggagtgtgtgtgtgtgtgtgtgtgtgtgtgtgtgtgtgtgtgtgtgtgtatccgttctctgggcagggaggggaatatggtaggagcaaaagcacaagagaggtaggagtgggcactgagtgtctgggggaccatgagaattggcttcgcaggtgagaggagaaggattgacattcttaatagttagaatgtcaggaacaggaggagttcagacttcattccacagtctgtgcagagttattctaaatattgacaagggtagtgacatggtgacattggtgctttaggaatgttgttctgctgtagggtgcttagtaggctttgtggtctcagaagctgctgaaggtagccagaggtgttagcaataagactaccatgaattgtttttgagcttggggtagagtgggaatggagatgaaggaatacacctaaggaagtctttgatggcagttatatcataaattgttcatacatgtgatgaatgggatatcaagtacaggaagaaactaacaaaactcataccaacgttttgcgcatgggagaagctattttatcatttcgggtggactgtagttgaatgggaagagataattctgccataagatcagggttgaattttgttggttctggaactcagtttttgctgctgtactgtccagagagagagagaaatagaaagggagagagagagagagagaggcgcgcgcgcgcgtgcgcgcgcacacacacacacacacacataactaatatatataaatacatatatatgtgggtatatattatttatttatgtatatataatataatatactatatagataatatataattatctataattatgtaaaatataattgtatattatctataattatataaaatatataattatatatgtattatagattatatattatatataatttaatatatataatatatatacatatgtaggtacgtttgtttgtgtgtgtgtgtgtgtgtgtgtgtataattaaaaaaaatttttttagagacaggttctcactctgccaccaggctggagtgcagtggcatgatctatagctcactgcagccttgacttcctgaactcagataatccttccacctcagcctcctgagtagctaggactgcaggtgtgtgccataccacacctggctaaattttttttttttttttggtagagatggggtctcacgatgatgcctaggctagttttgaactactagcctcaagcgatccatctgcatcggcctcccatagtgtttgggattacaggtgtgagtcactgtgcccaacctatttttatttttttgtagagatagggtctcacagtgttgcctaggctggtctcaagctcctggcctcaagcgatcctcccagctcagcctcccaaagtgctgggattacaggcatgagccagtctggctagcctgagtttttatttagaaaaacatgaacaacctgtatatggctgctgtaaaccaatggactttctttgttcttgaaccaagctaggcatccacacggcacctattcatctgaggggatagagtcagtgttcagatgtctttgaaagaaaggtccacctgcagttctttagcttctgaaatgtttttttcttttcccatactgtcatggatacacacgagattgttctggacttcctttatagtaaactttgctcttaataagagcttgaaaatttttgttgttgcaaaactgtgttagagttgatactgttatttattaggcaacaaatgttacatgaatatctatgatgttttaggcactggcgaaaaagaggtgaatgagatatgttcttgagaaagtcttggtagtgtagtgggcagagattattctctataacagtaataatcaaaccacatgataagtttaccacggagaaggcattaattagctcagcactgaaaacttggggcacaggttcccagagctccaagggacatttgaagtgagatctgaaaggttggttaggaaaaaataagttattctagacagagaagtcaggctgtgctgagccacgaagacttaatgcaggtgagttgaggaagaaatacatagtcaatattgccacaatatggtctgctcagtctggggagcagtggctagtgatggagcagtaggggtaagttggggttggattgtcacagaccttgcatgttgtgctaaggcatgcagaggtttccaggcaagttttgacatgatcagattgcccttggtaacattataaagaagatgacaggtggctctgcaaagaactgtccagacgggggagctggactgagccacagttaagagactgttgcagtagactagactaggaggaggagaatttgaattagagcattggccttagcaaggggatcaaagagggaaaaagatgagattggtttgtaggctgaatgaatggaggtgaaggtaaagaaagagtcaataatttttggaagatagggtagatgacaaagttgtttaaagaaagcataaaagaaggggatttaatgacttaaatttttgatatagggaatataagtctgaaacatgggtctagccttgagctggaaatacagcttgggcagttagcaacatagagatggtagatgaagccacggatgcagatgtaattacctgtaggagtatcatggagaccttgatctagccaggacaatttcagggacagcccaggatttgagcaaaggacttgtccattgcttttattgagtctttcaaggttgatgatttattattgtttaaaaatatgagggagccatattatggttgttttaattatccttgtggatgggtatagtagaatgtcctaaatattaaaacatatagaattcatttataatgttatatcatttataatggttgtagctttattattatttttaataattaggacaaatgcttaatattttacattttagatcatagtatgagtcaatattcatgatgaatctttttctttgtatttctttcgaatttaagaaattagatcaaaattttctgatagagacgaaactttggaatgcagaaatatttttagtattggtgccaaaaatttaagtcacttactttaacacttagaaattacaagatcatatatggaaagtttgttattggtttggtgtattagaatcatttgtggagcttttaaggacaccaatgcagtgctggattccactcaagaggggtttgtgttagggccacatcatctgtattttttaaagctttgtggatattttgatgttaatctgagaaccctgtatcaggggtttgggtaggggctttgttagcatattttgtgtcttgcttatttagttaacctttttgtttaaagctgttaaagcaaaggccagaataccagcaggttagcgatttggtcatcacagtgaaaccatttgaattttcatgtgaatttaaactataaaacaaaattcaatagcagttcagtctgggcttgtatcattagagggctggttaaataaaatatgacttgttcacagagcagagtactatgtagctataaaagggaaggaggaatagctatgtactactgtgggggagaatatattgttaaatgaaaaaaaaaacaaaacccactgtagcagaacagtggtattgtacactgtcattttttaaagaaaggggatctataaatctataaatatatatttttgtgcatatatataaacacaccaatggaatgataaaccaaaaactaataaaaatgattaaggagagagagagaatggggtggataaaacagggatggaggctagacttctgaatgtactttattttgtggattacatttagaaccatgccaatgctttaccatattataaaataaaaataaattaaaatgagagaaaaaggcaatctctaaaaatcaagtgcatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgagagtcttaatcctggagttctagtttgattgcactgtggtctgagagatagtttgttataatttctgttcttttacatttgctgaggagagctttacttccaagtatgtggtcaattttggaataggtgtggtgtggtgctggaaaaaaatgtatattctgttgatttggggtagagagttctgtagatgtctattaggtccgcttggtgcagagctgagttcaattcctgtgtatccttgttgactttctgtctcgttgatctaatgttggtctaatgttgacagtggggtgttaaagtctcccattattaatgtgtgggagtgtaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagaggctaggattgcaacccctgccttttattgttttccatttgcttggtagatcttccaccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagcacttccttcaggagctcttttagggcaggcctggtggtgacagaatctctcagcatttgcttgtctgtgaaggattttatttctccttcacttatgaagcttagtttggctggatatgaaattctggattgaaaattcttttctttaagattgttgaatattggcccccactctcttctggcttgtagagtttctgctgagagatcagctgttagtctgatgggcttccctttgtgggtaacccgacctttctctctggctgcccttaacattttttccttcatttcaactttggtgaatctgacaattatgtgtcttggagttgctcttttcgaggagtatctttgtggcgttctctgtatttcctgaatctgaatgttggcctgccttgctagattggggaagttctcctggataatatcctgcagagtgttttccaatttggttccattctccccgtcactttcaggtacaccaatcagacgtagacttggtcttttcacatagtcccatatttcttggaggctttgctcgtttctttttattcttttttctctaaacttcccttctcgcttcatttcattcatttcatcaacaaaattgataaactgctagcaagactaataaagaaaaaaagaagaatcaaagagacgcaataaaaaatcataaaggggatatcaccaccgatcccacagaaatacaaactaccatcagagaatactacaaacacctctacgcaaataaactagaaaatctagaacaaatggataaattcctcgacacatacaccctcccaagactaaaccaggaagaagttgaatctctgaatagaccaataacaggatctgaaattgtggcaataatcaatagcttaccaaccaaaaagagtccaggaccagatgaattcacagctgaattctaccagaggtacaaggaggaactggtaccattccttctgaaactattccagtcaatagaaaaagagggaatcctctctaactcattttatgaggccagcatcatcctgataccaaagccaggcagagacacaaccaaaaaagagaattttagaccaatatccttgataaacattgatgcagaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacagctcttcatgctaaaaactctcagtaaattaggtattgatgggacgtatttcaaaataataagagctatctatgacaaacccacagctaatatcatactgaataggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagcccaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctgtaggcatcacactacctgacttcaaactatactacaaggctacagtaaccaaaacagcatggtactggtaccaaaacagagatatagatcaatggaacagaacagagccctcagaaataacacctcatatctacaactatctgatctttgacaaacctgagaaaaacaagcattggagaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacgtaggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaaggaaaaacaaacaaccccatcaaaaagtgggcgaaggacatgaacagacacttctcaaaagaagacatttatgcagccaaaaaacacatgaaaaaatgctcaccatccctggccatcagagaaatgcaaatcaaaaccacaatgagataccatctcacaccagttagaatggcaatcattcaaaagtcaggaaacaacaggtgctggagaggatgtggagaaataggaacgcttttacactgttgatgggactgtaaactagttcaaccattgtggaagtcagtatggtgattcctcagggatctagaactagaaataccatttgacccagccatcccattactgggtatatacccaaaggactatataaatcatgctgctataaagacacatgcacacgtatgtttatagtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacagtgagaactcatgtacacaggaaggggaacatcacactctggggactgttgtggggtggggggaggggggagggatagcattgggagacatacctaatgctagatgacgagttagtgggtgcagcgcaccagcatggcacatgtatacatatgtaactaacttgcacattgtgcacatgtaccctaaaacttaaagtataatgataataaatttttaaaaaaatttaaaaaaataaaaataaaaatcaagtgcatatggaataagtgaatgtatattaagttatatataactaaacgtatatttacatttagttatatataactaaatgtatattaagtttgaggctgaagcacatgatctttcaaatgactttgaaacatagtaatttgattatacatttctagagggacatatcctcaaggacaaagaactgcaaaaatattgtaaactgtttttagtaatcgtataactggtattattggtattgttctggaagcatgcattgttaagtaaaacaaatggataattatattggattggtgctctggattttggtgtggaaaagaggagatacaaaggtagaaacagagaagttgttgattaaggatattgggaccataaatttgagttggagatgtccgtatgaactcatggtattttttctttattgaaaatgtattttctgtttttctctgctggaaaatcccagaaagcaacctaggtagcattgagcacttctaatgccagactctgttctgtaaatactaattcccactacaaggaacttagggtaccttagaaaaatggcttatttcatgttggggtcaagaatgctataagatgatcctgggacatctttttatatcacaaaacaggctactagggagattttcatttctatcagtggtagaatagctttttctaagccagtgctccaactgagaacaactagtagagaagctgggaaatattgttttaaaaatctgcttgaaggctttggaaagtgagcaaggcaaagaaagggactagagagaccaaaattttggagagaaggtaaactcaggggcgagggccaacttttggtacagcttttcccttggggggactggccgatttgagatgtgcggctaagagattgagcacaaagtaatggcagagagactgagattctaagcagagttttggtggttatgcagcatcgggggacacagttggatttcaggggctgcaaagaaagaaggggcgctggaaaatacctcaggcttttagttgggaaccctgaaggatgggctacaccctgtgcttaagggtgaactcaaaatagatcagctcttacaaaggctgaagcccagctttcacattacctcaatccctgattggattaaagagtctgctcctagctttattgtttgctagaagcaaatgtaaatctgtggaggaagacagcatcaagcattgcctcaagttattattataattactatgtataatattttacaacatgtaataaatatttacatagttatacaacttagtctggaattcaattaaaaaaagacctgaaaatttaaaaattggctgaaaatgaagagagaaaacagataattgaaacagactcatagggaggcttttattacaaataagatggtatagactcagttttcctgctcttccctgctaagtacaactctaaatcttggaattggtacaaaagacacccaaaggagaattcttgaagtttataagaagaaagtgaactgacttgggatcacagcattggaagaacaacatagtcgtagagcatcttgcatcctcccatccacctagacccggtgtttcctgaccctcccacctagcaacagagtgcaggctaggtaggttggctcattcctcccctgaatcaaatggaagtccccccgaaaacatctgccaaggccgacagcattgacaaaggggatcagttgggaactctagccctaatcttaaccctataagtggtgagaggaagcacattccttccttgcctgtcctgagatgtcccttttccactgaggcaggttggcagaactggtaagagagacccaactatagctagcagtccagtttgagaagactcttcttccctgtggatgtgagattttcctcttcagcccagagacaccagggtgggcactgcttgcaaaaaggacatagccacagcaaatggcctggtctgagagatctttggccatgtgggcctgagccttttctctcctacccagagatatgggcaggtaggtggaactggcaagagcaagtggcccattacagaagacctctttgtctctgtgggttcaaagcttgcctttttcactccagtgatactggggaagctaggagtaacctaggactaccacaccctcttccaccaagagacaactggcagcctggctcagggaacttctttaccctctcaggcagtgccagcagagaccaatgggagctcaaaggcactagataaacaaagcaggctaaataacactgcaaaggctctgtaaattagtctgctattggaacgatagcctagaaaagtagaccaagatactcgtgctaaaactaaacagggtggctaactgttaaaagatttaatagaagcctatgttagagacttctaacataatagacaaaatgttcatgatataatagcaaatcacttgtcataccatcaacaaaggaaaccacaaattgaatcagaaaagacaatcaacagtcaccaatacaagatgaatcagatgttggaattttctgacaaggattttaaagcatccatcataaaaatgcttcaaaatcaattaaaattatcctgaaacaaaagatataaaaatctcagcaaagagccatataaaattaattaaaactaaataaatgaaataaaaaagcaccaaaatggaaattttagaactgaaaaacaacaggaaaaaaaatgcttactggaccggctcaatagagtggcagtgacagaatcagtaaacttgaggaaggaactatagaattcacttaatatattggaagaaagcaaactgcaaaaaaaatgacttgtggggcaataacaaaagacttaatattcacgtaattggatttccagaggaagggagagtaagtaggtctaaaagagtgtttgaaagaaataatagtggaaatcttaccacctttggcaaaagaaacaaacctaaggacccaagaagctatgcgaacttggtacaggataaacccagtgaaacaccaagatacattataattaaactcttgaaacctaaaggcgaagagaaagtcttgaaagcagccagagagaaatgatgcattacctatagggaacaccaattcaaatggcagtagatttctcatctgaaaacatggaggccatctgaaatgttacattacctatagggaacaccagttcaaatgacagtagattttctgtatgaaaacacgaagaaggacaagacatgatatttttcaagtgcggaaataaaaggactgtcaatcgtgaatttctgtatctggtgaaattgtgcctcaggaactagaggaaaatagaaacattctcagataatggatacctaaagaatttgttgctagcagaacaacccttaaaattggctaaaggaagttctttaagccgaaaggaaatgatagtagaaggaatcttggagcattaggaaggaagaaggaacaatggaaaaatagaaatatgggtacataaaataatagactgtcgcaggccgggtgcagtgccaacgcctgtaatcccaacactttaggaggccgaggtgggtggatcacctgaggtcaggagttcaacaccagcctgaccaacatggtgaaacctcgtctctactaaaaaaaaaaaaaaaaaaaaaattagctaggtgtggtggcagatgcctgtaaccccagccacttgggagactgcggcaggagaatcgcttgaagctgggagggggaggttgcagtgagctgagattgtgccattgcactccagcctgggcaataagagtgaaactctgtcttaagataataataataataataataataataataataataataataataatagactgcccctttcctcccaagtttcatcagtcctatttgatgatagaataaaaaatataaaaccatctaacactgaagatgatgatatttaaatcaagacaaaggacttaaatggaagtgaggtttccacactttgttcaaagtggtaaaatgttgttactaataagcagattattataagccgtatgtttatattgcagtaattgaagtaatcacttaaaactatacaaaaagataaactcaaaaacaatataaacaaatcaagctggaatccgtgatgattaattttacatatcaacttgactgggttaaggaggacctagatagcaggtaaagtattctttctgtgtgtatctgtgagggtgtttccagaagaggttggcacctgaatcagtgaactgagtaaagattacccctgcctaatatgggtggccaccatccaattgtttgagggcgtagatagaacaaaaaggcaaatctcatttctcttctggagctgtgacacctgtcttctcctctccttggaaatcggaactccaggctctctggccctcagacttcaggactagcacgagcagtctcccaggttcttggacctttggcctcagactgagttacaccaccagctcccttggttctcaggctttgggcttgtcctgcactgtgccattggcttccctggctctgcagcttgcagatagcctgtcgtgggacttctcagctcctgtaattgtgtgagccaatttccttaataaatcctctcccatatacccaatttgttctgtttttctggagaaccctaatataggactctaaaaaatgttcaagtgacctataagaaggcaagaagagaagaacaaaagaccgaggacttaagccttaatgtattgataattaacttgaacgtaaatggactaaatataccaatcaaaagacagagactggcagagtggatgaagaaacatgacccaactatatattgcttatagaaaagtcacttcaaattgaataatgtaggtagatagaaaaggatactaaattataccatgcaaacattgatttaataaaaaagcagaaatggctgtattaatatttgataaattagacttcagagcaaagacaactaccagagacaaagaagggcataatgataaaatgctacattaagcgttgccagggcacagggataggaggtatgctgattgtaaaagggcaatatggggaatccttatagtgttgaaactattcagtatcttgactgtggaggtagatccttgaatctatacaggtgacagaattgtatagacttgacacactgacacatacacatacacatacacatacacacacacacaaatgagtgcaagtaaaacagtagaaacctgaatgcagttgacttatcaatgtcaatattctggttgtgatactgtactgtagttttttaaaatgttgccatttagggaaactggtcaaagtgtacaaggaatctctctgtattgctccttataactgcatgtgagtctgctattatctcaattaaaatttcagttatttaagaaacagactcaaggagactaagaagacattaaaagtaaatgcactggcctggcatggtggctcatgctggtaatctcagcactttgggaggccgaggcaggtggatcacctgaggtcaggagttcgagaccagcctggccaacatggtgaaaccctgtctctactaaaaatacaaaaattagctgggcgtggtggcaggtgcctgtaatgccagctaattaggaggctgagacaggagaacaatttgaaccgaggaggcggaggctgcagtgagttgagatcattgccactgcactccagcctgggtgaccaagtgagactacatctcaaaaaaaaaaaaaaaagtaaaaatgcactgtggggttctggattggattttggaacagaccagaaaaggccattagtggacacacacacacacacatacacaagtcagtttttagaatgatcagaaatacactttaaaataaatgattagtatctttattagaatgatcagaaatagactttaaaataaatgattagtatctttaagaatttatataacaagatcaataatttcagtagagaaatagaaagtataaaaagaagcattggaaactagaaatacaataattgattttgaagagccttagaagagaattagttaactataagatatgttgggaaaaaatacctgtatagaagcacagagacaaaggaatgaaaaatactaggttggtgcaaaagtaaatgcggtttttgccgggaggttttgtttttttttttttaatggcaaaaaccacaattacttttgcaccaacctaatatttaataattggagttaaaggccgggcacattggctcatgcctgtaatcccagcattttgggaggccgaggtgggtggatcatgaggtcaggagttcaagatcagcctggccaagatagtgaaaccctgtctctactaaaaaatacaaaaaaaatttagccgggcatggtggtgggtgcctgtaatcccagctacttgggaggctgaggcagagaattgtttaaacccgggaggcggaggatgcggtgaaccgagatcgcgccactgcactccagcctgcgacagagcgaaactccgtctcaaaaaaaaaaaaaaaattggagtcaaaaaatggcaaaaactgcaattacttttgcacataccgaaaagagtttgaatgatgtgggacacagttgtaattagaactccaaaaggagaaaaaaagagtggagcagaagcaatacttaatgagataatgtcctagaatgttcacaaagtgataagatgcttaaagctgccaattcaggaaatgcaacaaacaccaaacaggatgaggaaggaaaagcatactcagcatttttgctaacaaccaaagacaaagttaaaaatatttttttttttttttttttttttgagacagagtcttgctctgttgccaggctggatctcggctcactgcaacctccacctcccaggttcaagcaattctcctgcctcagcttcctgaatagctgggactacaggcgcgccaccacgctcagctaatttttgtatttttagtgaaatacgaaaattagttttagcgaaacggggtttcaccatgttggccaggatggtctcgatctcttgacctcgtgatccacccgtctcggcctcccaaagtgctaggattacagacatgagccaccgcgcctggtgaaagttaaaaatcttaaagcaaccagtggattgagacacattatctttacacaagcaagaaaaaggctgggcgtgatggctcatacctgtaatcccagtactttgggaggctgaggcgggatgattccttgagcccaggagttttgagaccagcctggtaacatagtgagaccttgtctcagttttaaaaatttattttcttattaaaaaaaaaaaagcaaggacaagactgaaaactaccttcttattataaacaatggaaacccaaacaatggaatgacagttttaaagtgcagaaaagaaaataaatgccagcatagaattgtataccaagagttgacaaactttctttttaaagggccaggtagtatatatcttagactcctgggccatgtaagatctctgccacagctattctgcattgttgcatgaaagcagtcataaacaatcataagcgaatgggcatggctgtgttccaataaaaccttacttacagaaacaggctactagtccacgggctgtagttccctacccttctatatccagtagaaaatatacttcaaaaatgaagaactaaagatattttcagatgaacaaatacagaggggattaatcaccggcagccttacagtaaagggagttccgtaagcagaggagaatgactgcagaaggaaatacagagattctaagaggaatgaggagcagtggaaagaataaagtgtgggtaaacttaactgaatgttaattgtatgcaataataatgtcctctgggatttagaatatagaattgaaatatacaccaacaaagcacaagcagctggtataggtggatggaagaagtgaagcttaaggtccttgaattgcccaggaaatggtataagtactaatttatattaggccttgataaatcagggatgcaagttataatttctagggtaatcactaatagtagtaaaagtaaaggtaatagcaaaataaaagtaaatagtaaaaggatgcataacataatagtttataaagaaaaaaatggaataataagaatatttaatccaaaaaaaggtaaaacaagataggaaaaggaacatagagtaagtaggcagatagaaaacaaatagcgagacagtagatttaatgccagttatgtcagcactggaatgaaaactgactcaagataccagttcaatgacagatttgtctaagtgggtttaggaaaaccaatgaactatgatacaaaactgtacttaactgtaatgagtcaaaatattgaaagcaaaaggatagagaaaaaggtatatcacactcttaacccacagacagctggtttatgtctatatctgacaaaatagacttaagaaggattgctagaggcaaaatagtaacgtttcataatgatgaaagcacagtctaccagaaaaaatgattctaaatgtgtgtgtacctaataatgtaaccttatgttatataaagtgaaagatgtcagaggtacatgttaacaatttttttttttttttttggagacaagagtcttgctctgtcgcccaggctggagtgcagtggtgtgatctcggctcactgcaacctccagcccctaggttcaagtgattcgtctgcctcagcctcagcctcccgagtagctgggaccacaggtgtgcaccaccatgcccggctaatttttgtatttttagtagaggtggggttttgccacgttggccaggctggtcttgacctcctgacctcaagctatccacctgccttggcctcccaaagtgctgagattacaggtgtgagccaccacgcccagccacaaattttttatttgtaaataattttaagctcacagaaaagtgcaagaataaaaacagtgcaaagcacaactttgtattctacccaaattcattgttaacatctcactacatttgctttatcattcctcacccctccctccacataagcacacatacacagatatgtgtgtgtatacataatttttccctctgaacctttcaagggtaaactatatatatcgtggctcttgacccaaaatactttagtatgtattttctgagaatagtgatagtcttaagagtcttaaggtacagtttttaccttcaatatatttgacattgtacaatgctttaatctactgtttgtgtttcattctgtcagttgacctgcaatgtcctttgtgtaattttcaacgtgcagtacaggatccagtctagggttaggtattgcatttgattgccacactttaatctagaacagaggtcaacaaacattttctttacagggcctgatagtaaatattgttggctttgtctgtgtcatagatctctgtcacatctaatcacctctgctgttgtagagagaagcagccattgactataagtatgtgaaaggatacagctgtgtttcaggaaaactttatctgtataagcagacagcaggcctgatttggcctggcagctgtagtttgccggtccctgatttagaatatttgtactgcctttctttttctttattttttgttttttaatgatattgacattctttgattaatacattccccctcttttaatccagttccttattttgcgtttgttttgttttcccatcattagattcaagttacgaatccttgaccaaaatactgcataggtgaaggggtgttcttcttagatctggaggcatacgttgcccatctgtctgatttttttaatgttgattttattctcctgtttgaggtgctgtcttatttttccactatataattactatttttttcctatttgcaatcaataagcagtctgtggggagatgctttaagaccatgcacatatgctgctgctcatcagaatttccttctactttttagcatccactgctaatgggaaaagtaattttaatactctctcagtagttcgtagaacaaaaagatttgaaaacacttggcctaattgacatatacagaacattgcactatatagtttctgtatacttctaaatattcatgaatcaaagaagaaatcaccttggaaatttgaaaatgttttgagtggaatggcgatgaaagtattatctgtcaaacctttgagatacagctaatggcattctgagaattaaaattgtagctttaaatgcatacattaaaaaagaaaggtgaatatctaagttttcaactccaagtagaaaaagcactgtacaatatgttcctaaagggaagaaaacaataaagataaattagttgaatataaaacaggtacagaagcgaggattaacaaagacaaacattagaaaagactaataaaactgatcaactgctggagagattgataaaggcaaaaagaaaacaaatgactggtatcagtaataggaaaggggagatcacggtagatcttaacagacactgacaaaatcaggaggattttttttagtaggttttttttttaatataagctacattttcagtttgttttgttgtataatttttaaactatatggcacaacacagtaaatactcataggaggtcgagaaactatacaagaaacaattggaataaatctggtagattgtttctatttagacattaactctgtttatcatttgaggaattctccatagttgtaccagaggtgattgattattaaatctattaattagatacaaaatactaatatgttctgttcaaaagaagtcagcaaggcgtagttatcacacagatcaacaacgaagaaagacatgttttaggacatttgaaaaaatcacacgtagcttattttcttgacaatcttaatcatgacaaaacctgggtttcactgactagatatgaaatgtgtggggcatttgtttactacatgtttaagcatggttagaactacaatctgaaaaatgttttaattgtacagccttataattatttcaatctaaatatcagaggagttaataacatcaattaatttcaaaattatgcttctgtttttgtgaggccaagtataaactgtttttggcaaaaagaaaagctagttttacctgacttttttttttttttggaaggcctgcactgggttatgtgttcttttttcttttatatatatatatatatatattttttttttttttattatactttaagttctagggtacatgtgcacaacatgcaggtttgttacatacgtatacatgtgccatgttggtgtgctgcacccattaacttgtcatttaacattaggtatatctcctaatgctatccctcccccctccccccacgccacaacaggccccagggtgtgatgttccccttcctgtgtccaggtgttctcattgttcaattcccacctatgagtgagaacatgctgtgtttggttttttgtccttgcgatagtttgctgagaatgatggtttccagcttcatccatgtccctacaaaggacatgaactcatcattttttatggctgcatagtattccacagtgtatatgtgccacattttcttaatccagtctatcattgttggacatttgggttggttccaagtctttgctattgtgagtagtgcctcaataaacatacgtgtgcatgtgtctttgtagcagcatgatttatattcctttgggtatatacccagtaatgggatggctgggtcaaatggtatttctagttctagatccctgaggaatcgccacactgacttccacaatggttgagctagtttacagtcccaccaacagtataaaagtgttcctatttctccacatcctctccagcacccgttgtttcctgactttttaatgatcgccattctaactggtgtgagatgatatctcatggtggttttgatttgcatttctctgatggccagtgatgatgagcattttttcacgtgtctgttggctgcataaatgtcttcttttgagaagtgtctgttcatatcctttgcccactttttgatggggttgtttgtttttttcttgtaaatttgtttgagttctttgtagattctggatattagccctttgtcagatgagtaggttgcaaaaattttctcccattctgtaggtttcctgttcactctgatggtagtttcttttgctgtgcagaagctctttagtttaattagatcccatttgtcaattttagcttttgttaccattgctttcggtgttttagtcatgaagtccttgcccatgcctgtgtcctgaatggtattgcctaggttctcttctagggtttttatggttttaggtctaacatttaagtctttaatccatcttgaattaatttttgtataaagtgtaaggaagggatccagtttcagctttctacatatggctagccagttttcccagcaccatttgttaaataggaaatcctttccccatttcttgtttttgtcaggtttgtcaaagatcagatagttgtagatgtgtggtattatttctgaaggctctgttctgttccgttggtctaaatctctgttttggtaccagtaccatgctgttttggttactgtagccttgtagtatagtctgaagtcaggtagtgtgatgcctccagctttgttcttttggcttaggattgacttggcgatgtgggctcttttttggttccatatgaactttaaagtagttttttccaattctgtgaagaaagtcattggcagcttgatggggatggtattgaatctataaattacctttttcaccatattgattcttctatccatgagcatggaatgttcttccatttgtttgtgccctcttttatttcgttgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgcacattgattttgtatcctgagagtttgctgaagttgcttatcagcttaaggagattttgggctgagacgatggggttttctagatatacaatcatgtcatctgacaagccccagtgagatgaacctggtacctcagttggaaatgcagaaatcacccatcttctgtgtcgctcatgctgggagctgtagactggagctgttcctattcagccatcttggaaccaccctcaggaggatattattaatgactattccaatacattgaaaattttagatgacatggcaaatttctagaaaaaccaacttataaaaagaaaactccatgtccagaaagcttcaccagtcaattcttcccaactattataggtatttcaccaatgttacagactcttccagagcataggaaaataggtgaaattctattcttgttttcatacagccagcatcattttgttataaaaacctgaaagaaaaggaaaacagcaagtcagtctgtcttatgaacatagatggaaaaaatgtaaacagaatatttgcagactgtgtttagtgaaatactgagataatcatgaccaagtgggtttatttgagaaatttaaggttgatttaatatttgaaaatcagtatcattcgcaacatttacagtataaatgattattttagtagatagataattttaaaaaatagaattcaatacgttaatgataaaaacctttaacaaactaggaatggaaaatacttccttggctgggtgaggtgactcatgcctgtaatcctaacactttgggaggctgaggtgggaagattgcttgaggccaggagtttgagaccaccgtgggcaacatagtgagactgtctctacaaaaatgacaaaattatccaggcatggtggtgtgtgcctctagtcccagctgttggggaggctgaagtgggaggatcgcttgagcccggttggttgaggccgcagtgagccatgatcccaccactgcattccagccttggtgacaaagcaagacactgtctcaaaaaaataaaagaaaaaaagatacttccttaatatattaggagcttgtacaaagaatttaggataactatcacactgtgtggggaaatactgaaagcttttccctgagattgggaataagacaggatacttccatcacaagttcttttcattttcagtattgtaatgaacgtctaaaacagctgcagtaaggcaagaaaagtaataaagtgataaatgttagaaaggaaaaatagaattttttaaacagatgttatgcttgcattattcctagtttttacttggaataatcaggagaatggtgttaccattctagagatgaaaatttggtggttaaaaatgtatataggtggtatgtaaagctttgagacagtgtgagatcacctacctagtgaattaggcagagaaacaggctttaggtagagaagcgaggctactttttagagattgggaaggcaggtagatttactaaagtgaactgagaagaagctgccagggaatccagagtggagggttttggggaccaagtgaaaagggttttaagaagagagttactagctttttgaatgctgtgagatttaccttatgtaccttaataaagggatttcagaggagggtaagggttaaagtccagttggagttggttaagaaatttggtgagagcattgagtcaaagtagacaactttcaacaagattttttatataaaagtgagaagagaagtagacagtagcctgaagaatatgagcagaagggggtttgtttttttagaagagaatgcaacagctcttctgtaagctgatccagcagaaggtaaaagtattgggtgaaagttagaattaggtttggtctggtgatgcccttgattgggtggagtttgagaattctggacccaggtagacgatgcaactctgaatgggcttaaaccatttatcctttgtaactagaggagaggcatagtacgtgcatttagtcatgggaaaaaaatatatagttctctcctcattagttattctttctacaactattcactgagtgccattagaatgccaggcatacttttaggcactggaaatagtcaacagaacaggcaaaaatccatgctgttgtgaagtttacattgcactggaagaaagtagatatgaaacaagtaagatatcagctaattatcagctaaaattgaagagagggaagaaggtttagcaaattgagagaaaataaggtgtaaaaagtgaattgaccagggaaatgaattattgattgacccacagtgcggagagtctgtatgagatgtgtgtttataagtgtgaaaagagaccaaatagcataatattttgtctctagccttatctagctgcttgttggtatataagagtaagcagagagttgggcttctccaggtttagagttgccatacgtataactgcagcttaccaaggtgccattgagtgtaaaatgcactcttattttgtgaactgagaaaaaacactgtcatttaaactgtggcatgccatagattttataatatatcctgatttctgagctattagttttaaaattgttcattttagaattagtaaaataagtagttgggatacttttgattggaaacaacagaaaacccaaactcagatgcactttaataataaggaggagccaagggggatatgaagaaaatggcagcctgaatgaggcctgcttccttgactccctcagctacctactagctctctggttctcttgagccagcctgctgcggggccctacagaaaactgtaggatctggttttctgttcttgtgttagtttgctgagaatgatggtttccagcttcacccatgtccctgcaaaggacatgaactcatccttttttatggctgtgtagcattccatggtgtatatgtgccacattttctttatccagtctatcattgatgggcatttgggttggttccaagtctttgctattgtgaacagtgccataataaacatacatgtgcatgtgcctttacagtagaatgaattataatcctttgggtatatacccagtaatgggattgttgggtcaaatggtatttctggttctagatctttgaggaatcgccacactgtcttccacaacggttgaactaatttacactcccaacagtgtaaaagcgttcctatttctccatgtcctccccagcatctgttgtttcctgtaatctgtctaccttttaagtttaaattccccatgaaaaaagagttttaaaagttatgccatagaaaaagattaatagcacgagaaaaggctaattattaggtttaaaaaataggttacatataatatgtacaatattatctccactttaaaaaaaatctatttatccatgcataggaaaaaactactaagccatacaccaaagtgcatatgtggttatcattaggaatcataagtttaaataatttgagaattctttttactttttctccattttccaaattttctgcactgaccatgcagaaaccattgcaatgaccattgcttttacaatgagaaccagaaaagccttttaaaaattaaacaaaatttttgggaggccaaggagggtggatcacctgaggtcacaagttcgagaccagcctggccaacatggtgaaaccccgtctctactataagtataaaaattagccaggtgtagtggtgggcacctgtaatcccagctacttgggaggctgaggcaagagaattgcttgaacccaggagacggaggttgcagtcagccaacacggtgccactgcactccagcctgggtgatgaagtgagactccgtctcaaacataaaaaaaaaaattaaacaaatttttaacaactcagcaggcttagtctgctttctttcacagtctgcattttttgggccctggagccccaggagtcttcgtagcttcccactcaggttaagatacagcacatatttccagcttctacaggtggcctctttgcacatagaatcgtgacctttattttcaacatctgaagcattgctacttatctatattgattaacttagctgagttctcctctaccatctaattagatttggtttcttcacagtggagcacaggctatcttcagtgtgttctgtacatacaagcaactttataaccatctttgtatccatactttgttagactggtttttgtgttgtgggaatgactgattcactaagatgtccaggatgttggcaatccagttgagggacgtggtataacgggacccagcactgcattcgaatttcatccttggacaagacaagtaacttctctgaccccaaatttctaccggttgctcccctgcctgcaggctccgtgcttggtatctcagaaaaccttcccgaggaaaaagcccataagggacaagtcccggcccaacttaaaatcacattatgctatgtgaaaaaagccaaacacgaaaagacacatggttgtatgattccatttatataaaatgtctggaataagcaaatccatagagatagaaggtagactaatgcttgctggcagggagtgactgctaacgtcccaaattagatagtgcagatgtttgttcaactctgtgaaacatactaaaagtcacttgtacacttcaaaagagtaagtcttacggaatgtgaattaaagctcaataaaactcttattaaaaagtagataaaagggttaataatctctctactgaacaattatcccccataatgaatcctgtttcatctgtactcctacccaccttctcccccatattattttaaagcagcatattatttcatttataaatatttcagtagtttgggtacttaaaaaatacataaccacaatagtattatcatgcctaaaaaatttaacatgtaataaaatattcagtcagtgctcaactttctaatcatgtttttagactgcttagcattttgttgtggagatggatcataatatatttaaccagttcctgttgatgaagcttgaggttatttctaactttccaactgataaatagtgcttcaataaacatccttatatataaaaaaaaaaaaaagaaagaaaactgtaggatctggttctgtagtgatccttccaagcagagagaactggtgtatagctggccattgtagcaagaggcaaggaccatgaagctgcagatcctggaagatgggacatagcacccatttatgtagtgtgtatgtaggccttcttgatctctacaaggccagtgtattgctgaatggttgggcagagtcttaacctgtgcttgaggctgaagcagtactgggagatctgagaacggagaagattcctataggttaacacacagtgtactcagagcctgtctgcttgaatacatccatgtgagactggctttccaaattttaaattaaaaatctagaacatttaaagagagttaaatgtactttttcaaacaaataactttctggagctgaaatctatgatttcctcattaaacaattcagtacatgaattaaaagaggggcagtgcaagaaatttttggagagcaaatgtataaagatagaaatcatgaaagcaaagaaacttggaggagaaatttgagatgtccaaaatttgaataatatgacttccagaaggagagaaagaaacagatggaagaaaagactacgtattgtgtacagtgtacactgcttgaatgatgatgggtgcactaaaatctcagaggtcaccgctaaagaacccatctgtgtaaccagaaactatctgtatctccacaactattgaaatgaaaagaaaagaaaagaaaaaggaaacggatggatgtggcagtaagccacaggagaaaaaaagacaggtatcacatttcaaatttgaacactgtagctaaaaagcagtggattagcatctagagctactgagagaaaaatgactgcaatccaagaataccatatccagccaaggtatttatctgtacaggtaaaagaaagatgtttaaggatctatataaattcagagtataccactcaagtatcctatttgaggcaaataaatgaagcagaacagagactataaaattgaagaagagagtgaagagcggtgaacagtgaacttgtttttatgtttaaaattatatcgtaatggatgaggttgggctgggaatatataagtgctacattagacctctttaatagaatggacataaggaaaagttttgaatgagtattgagctgtctctgcaaaatataggaattaggatgctctgcagaaaaaaatgtgccaaaggtgtcatagagtagagagggaagggaaaggaagaaagggtagatgtatcttaggagtctcatttttggggttgggaataggaaaggagtgggtaagtgtggagtatttttgtaggggaaatgtttgacatcttgtttataaattatagtaaagacatatgctttcaacagtgaaaggcaggaaagggaagataaccattgataagatggaaaagttcagtagtatttccaggtaaagggggaaatgaaatgaatgacaacttttttctttttttctttttgagacagaatcttgctctgtcacccaggctggagtgcagtggtgggatcttggctcagtgttacctccgcctcctgggttcaaatgattcttgtgcctcagactcaagagtacttgggattataggagtgtgccaccatgcccagataattttttggtagttttagtagagatggagtttcgccattttggccaggctggtctcgaactcctggcctcaagtgatctgcctgcctcagcctcccaaagtgctgcgattacaggcatgagccagcgtacctggcctgcacgccaactttatcacactagtaaaataaggaaaaagaaaagagagcaatgtaaataagcaacaaacaaaatatagatggaaagaacaaaattaatatttaggtcatctactaaatgtgaataaattatgtagtctcatgaaaagaaaactggagtggctatattaagatcgaagtcgacttcatgtgaattaacacaggaacagaaaatgaaacaccgcatgttcttgtaagtgggagctaaacaatgaatacatgtggacacaaagatgggaacaatagacagggggtactacttgagaggggaggttgggaggcggggttgggttgaaaaactacctattaggtactatgcgtacacacaggtcaaaggagaaataagggaaatcagaaaaaaacattttggaatgaatgaaggtgtatgcaaagtattaggtactttgcatacaaaggattctttgtacatcaaacctcggcaacacgcaatttacgcatgcaacaaacctgcacacatacccctgaatctaaaataaaagtcaagagaaaaaaaaaacccaaaaacaaagtagatttcacacaaacaaggaatattaacagagatagaaatatttcataaagacaaacatgtaaattcttcaagaagacagaacagtcctgcatttgtaggtgtttagcaacagagttctaaaatacatgaagtacaaatggtcagaactaaaatgggaaatgtgcaaatccacaattatagttgcagatttcaacatttgcctttcaatatcaataaaacaagtatacagaaaaataagaaggttatagaagacttgaataacactgtcaattaacttgacataattggtacttagagaacatgatacatatcaactgcagattacacattgaagtgcccttggaacattcagtaaaatagactatatgctggataatagaacaagtctcaatacatttaaaagatttgaaaccatatgtcatgtgttctgttttgaagacagggtctcgcttgctctgtcacccaggctgaagtgttgggattgtagctcactgcagcctctatctctgggctcaaatgattctctcacctcagcctcctgagtagctgggactacaggtacactctaccacattcagctaattttttttttttttaatttttagtagagatgaggtctcactatgttgcctaggctggtcttaaattcctggcctcaagtgattcatccactttggcctcccaaaatgctagggttatagacgtgagccagagtttctgtggaattgcaatagaaatcattaacaaaaagataactagaaaaattcccccaaacatttggaaattaagcaacatctaaattacacataggtcaaaggagaaataagggaaattagaaaaacattttggaatgaatgaaagtgtaaacacagtctgttacatttgtggaatgcagctaaagcagtatatagagaggaatttgtacctgcaaaagtttttattagaaaagagaaaagatgtaaatgttctaaatttccatagccagactacctctctagattccttctctctgggcagggcatctctgaaagaaaggcagcatccccagtcaggggcttatagataaaactcccatcttcctgggacagagcacctgggggaatgggcatctgtgggcacagcttcagctgacttaaacattcctgcctgccggctctgaagagagcagcagatctcccagcacaccactcgagctctgctaagggacagactgcctcctcaagtgggtccctgacccccgtgcctcctgactaggagacacctcccatcaggggtcgacagacagctcatacaggagagctccagctgacatctggtggatacccctctgggatgaagcttccagaggaaggaacaggtggtaatctttgctgatctgcagcctccagtggtgatacccaggcaaatagggtctggagtggacctccagcaaactccagcagacctgcagcagaggggcctgttagaacaaaaactaacaaacagaaaggaataggatcaccatcaacaaaaaggacgtccatacagaaaccccatccaaaggtcaccaacatcaaagaccaaaggtagataaatccacgaagataaagaaaaaccagcgcaaaaaggctgaaaattccaaaaacaagaacgcctcttcttctccagaggatcacaactcctcgccagcaagggaacaaaactggatggagaatgagtttgatgaattaacagaagtaggcttcagaaggtgggtaataacaaactcctccaagctaaagaagcatgttctaacccaatgcaaggaagctaagaaccttgaaaaaaggttagggcaattgctaactagaataaccagtttagagaagaatgtgaaagagctgatggagctgaaaaacaaagcacaagaactttgtgaagcatacacaagtatcaatagccaaatcgatcaagcagaagaaagcatatcagagattgaagatcaacttaatgaaataaagcatgaagacaagattagagaaaaaagaatgaaaaaggaacaaacaaagcctccaagaaatatgggactatgtgaaaagaccaaacctgcgtttgattggtgtacctgaaagtgatggggagaatggaaccaagttggaaaacactcttcaggatattttccaggagaacttccccaacctagcaagacaggccaacattcaaattcaggaaatacagagaacaccacaaagatactccttgagaagagcaaccccaagacatataatcgtcagattcaccaaggttgaaatgaaggaaaaagtgttaagggcagccagagagaaagactgagttaccctcaaagggtagcctatcagactaacagcagatctctcagcagaaaccctacaagccagaagagagtgggggccaatattcaacattcttaaagaaaagaattttcaacccagaatttcatatccagccaaactaagcttcataagtgaaggagaaataaaattatttacagacaagcaattgctgagatattttgtcatcaccaggcctgccttacaagagctcctgaaggaagctctaaatatggaaaggaaaaccagtaccagccactgtaaaaacataccaaattgtaaagaccattgacactatgaagaaactgcatcaactaatgggcaaaataaccagctagcatcataatgacaagatcagattcacacataacaatattagccttaagtgtaaatgccccaattaaaagacacagactgacaaattggataaagagtcaagacccatcggtgtgctgtatttaggagacccaactcatgtgcaaagacacacataggctcaaaacaaagggatggaggagtatttaccaagcaaatggaagccaaaaaaaaaaaaaaagcaggggttgcaatcctagtatctgataaaacagacttcaaaccaacaaagatcaaaaaagacaaagaaggacattacataatgttaaagagatcaatgcaacaagaagagctagctatgctaaatatatatgcacccaatacaggagcacccagattcgtaaagcaagtctttagagacctacaaagacacttacactcccacgcaataatagtgggagactttaacaccccactgtcaatatcagacagatcaatgagacagaaaattaacaaggatattcaggacttgaactcagctctggaccaacaggacctaatagacatctaccgaactctccacccccaagcaacagaatatacattcttctcagcaccacatggcacttgtcctaaaattgaccacataattggaagtaaaacactcctcagcaaatgcaaaagaatagaaatcataacgtccctcagaccacagtgcaatcaaattagaactcaggattaagaaactcagaactgcacaactacatggaaactgaacaaccttctcctgaatgactactgggtaaataacgaaattaaggcagaaataaataagttctttgaaaccagtgagaacaaagacacgacataccagaatctctgggacgcagccaaagcagtgtttagagggaaatttatagcactaaatgcccacaggagaaagcaggaaagatctaaaatcgacaccctaacatcacagttaaaagaactagagaagcaagagcaaacaaattcaaaagctagcagacaagaaataattaagatcagagcagaactaaaggagatagagacatgaaaaacccttcaaaaaatcagtgaatccaggagctgttttttgaaaagattaagaaaatagactgctagcttgactaacaaagaagaaaagagagaagaatcaaatagacacaataaaaaatgataaaggggatatcaccactgatcccaaagaaatagaaactgccatcagagaatactataaacaactctacgcaaataaactagaaaatctagaagaaatggatacattcctgaacacatacaccctcccaagactaaacgagggaaaagttgaatccctgaacagactaataacgagttctgaaattgaggcagtaattgatagcctatcaaccaaaaaaaagcccaggcccagacagattcacagccgaattctaccagaggtacaaagaggagctggtaccattccttctgaaacaattccaaacgacagaaaaagagggacttccccctaactcatttgatgaggccagcatcatcctgacaccaaaacctggcagagacacaacaaaaaaagaaaatttcaggccaatatccttgataagcatcgatgcgagaatcctcaataaaatactggcacaccgaatccagcagcacatctaaaagcttatccaccacaatcgagttggcttcatccctgggatgcaagatgggttcaacataacggaaatcaataaacgtaatccatcacataaacagaaccaatgacaaaaacacatgattatctcaatagatgcagaaaaggccttcaataaaattcaacagctcttcatgctaaaaactctaaataaactaggtattggtggaacttatctcaagataataagagctatgtatgacagacccacagccaatatcatactgaatgggaaaaagctggaaccattccctttgaaaactggcacaagacaaggatgccctctctcaccactcctattcaacctaatatggaagttttggccagggcaatcagacaagagaaagaaataaagggtattcaagtaggaagagagaaagtcaaattatctctgtttgcagatgacatgattgtatatttagaaagccccatcgtctcagccccaaatctccttaagctgataagcaacttcagcaaagtctcaggatacaaaatcagtgtgcaaaaatcacaagcattcctatacatcaataatagactgtgcaaaaattacaagcactcctatacataataatagacaaactcatgagagccaaataacgagtgaactcccattcacaattgctacaaagagaataaaatacctaggaatccaacttacaagggatgtgaaggacctcttcaagaactacaaaccactgctcaaggaaataagagaggacacaaatggaaaacattccatgctcatggataggaagagtcaatatagtgaaaatggccatattgctgaaagtaatttatagattcaatactatccccatcaagctaccattgactttcttcacagaattagaaaaaactactttaaatttcatatggagccaaaaaagagcccatataaccaagacagccccaagcaaaaagaacaaagctggaggcatcttgctacctgacttcaaactatactacaaggctacagtaaccaaaacagcatgataccaaaacagatatatagaccaatggaacagaacagaggcctcagaaataacgccacacatctgcaaccatctgatctttgagaaacctgacaaaaacaaacaatggggaaaggattccctatttaataaatggtgtcgggaaaactggctagccatatgcagaaaactgaaactggaccccttccttataccttatacaaaaattaattgaagatggattaaagacttaaacgtaagacctaaaaccataaaaaccctagaagaaaacctaggcaataccattcaggagataggtatgggcaaagacttcatgactaaaacaccaaaggcaaaggcaacaaaagccaaaattgacaaatgggatctaattaaactaaagagcttctgcacagcaaaagaaactatcatcagagtgaacaggcaacctacagaatgggagaaaatttttgcaatctatccatctgacaaaggactaatacccagaatctacaaagaccaaatttacaagaaaaaaagcaaacaaccccatcaaaaagtgggcaaaggatatgaacagacacttctcaaaagaagacatttatgcagccaaaaaacatgaaaaaaagttaatcatcactggtcattagagaaatgcaagtcaaaaccacaatgagataccatctcccaccagttagaacggtgatcattaaaaaggcaggaaacaacagatgctggagaggatgtggagaaataggaacgcttttacactgttggtaggagtgtaaataagttcaatcattgtggaagacagtggggtgactcaaggttctagaaccagaaataccatttgacccagcaatcccattactgggtgtatacccaaaggattataaatcattctgctgtaaagacacatgcacacatatgtttattgcagcactactcacaatagcaaagacttggaaccaacccaaatgcccatcgatgatagactggataaagaaaatgtggcacatatacaccatggaatactgtgcagccatagaaacaaatgagttcatgtcctttgcagggacatgatgaggctggaaaccaccattctcagcaaactatcacaggaacaaaaccaaacattgcatgttttcactcataagtgggagttgaacagttagaacacatgaacacagggaggggaacatcgcatactggggcctgttgggagggtggggggctaggggagggacagcattaggagaaatacctaatgtagatgacggcttgatgggtgcggcaaaccaccatggcacgtgtgtacctgtgtaacaaacctacatgttctgcacatgtatcccagaacttaaagtataaaaacaaacaaaaaaaccagaaggccgggcgtggtggctcacacctgtaatcccagcattttgggatgctgaggtgggtagatcacgagatcaggagttcaaaccagcctggccaagatggtgaaaccccgtctctactaaaaatagaaaaattagccgggcatggtggtgggcgcctgtaatcccagctactcaggaggctgaggcagagaattgctggaacccaggaggcggaggttgcagttgaccgagattgcgccattgcactccagcctgggcaacagggcgaaactccgtctcaaaaaaaaaaaatgtggtacatatactccgtggaatactaccacctgtaaaaatgaatgcagttgtgtcctttgagcagcatggatgcagggaggccattattctaagtgaattaatgcagtaacagaaaaccaaataccacatactctcacttacaagtaggaactaatcattgagtacacatggacacaagggagcaacagacaccgggacctgcttgagggtggagagtgggaggagagtaaggattgaaaaactgcctttcaggtattacgctgattacttgggtgatggaattatctgtacatcaaacccctgtgaaacctgcacatggaccccttgaacctaaaataaaagttagaaaaaagggcaaaaataataacaagcacattacaaaataatatgtgcagatgatcagtaaacaccagaaagggtactcagaatcttttttatcttatttttttgagacagtttctccctctgtcatccaagctgcagtacagtggcaccatcttggctcatggcaacctctgcttcctgggctcaagcaatccttctaccttaacctcccaagtagctgggactacaggcgcataccaccacacttggctaagttttttgtgtttttgtagagactaggtttcactatgttgcttaggctggtcttgaactcctgggcttaaatgatccacctgccttggcctcccaaagtgctgagattatagacataagccactgtgcccagcctctgaaaatctttaaatatcagaaaaatacaaatttataccataatgagatagaatagtgcatacctactggaataagcaataaaaagtctgattataccaaatgtgggaactgatgtggaataagtagaactctcatatcttgaaaatgtgattgtaaggtggaaacagtttggcagtttcttaaaaatttaagtgcatatctatactttaatccagtgatttcattttgtatatttattcaagagaaatgtagatacctgtccacagaaagatttatacgtgtcttaacttcatttataaaagcctataattacgtaatccaagtgtccaccaataaacaagttgtgtattttcatacaagagaatactactcagcagtgtgaaggagcaaactattgatacaatacttagaaaagttatgttgataaaaagaagcaagacacaaaagtgtctttgattccattaagtcaaattctgtaaaactgatctatagtgggaaagataagatcaatgtttgaggtggaggttgggagagattacctggagagggatataagagagcttttgggggtgaggaaactgttttatatcctgtttgaggagattacactttgtgtatacatttgtcaaagcttatcaaattgtacacatcagtggctgcattttattatatgtaaattacttttcactaagattgattaaagatttggttggaaggaatcaaattggtatagcagtcactaaactaaatgcaaacagattatatattgtggcagtaaaatactgtcaggttagtttaagaaacaaaacctaaccaagtcctgtttcgaagaagcaaactattgaaaacttgataagtaaagctgaaaataaaagagttgaataaagatgtaagatacaggaaaataaccaaaagatcaataattataataatattagacaaggtgaaatttaaatatcaaactaggtaagtggattgttaacatcataaaaggcatattttatgaaaatccaatagccataatcttgtatggctaaaaagcttaacacataaagcaaaaataatctgagtagtgtggtagagcaggcatggtatgagatttatatatatatataatatatatattaaaaaattatatattatatatatatgtttttttcttttggagacagagttttgctctttctcccaggctggagtgaagtggtgcgatctcagctcactgcagcctctgccccacaggttcaagcgattctcctccctcagcctcccgagtagctgggattataggcacttgccaccatgcctggctaatttttttttcttttttttttttgtatttttagtagagatgggtttttgccacgttggctaggctggtctcaaactcccgacctcgtgatccacccacctcagcctcccaaagtgctggggattacaggtgtgagccactacgcctggccaggatttcagtacatgtttatcagaattaggtctagtagatgaaaatacgagtataaggaattgaatagtgcatttaataatcttaatcatatgtgtatagaaatagtgttttaaattcctggaatagatctttttttaatgtccaaggaactgtggtcaaagtttaatgtccaaggtacttgaccataaagaaaatcttaacagatgagaaaagttgagattttataggctgcgttgtctggtaataatactggtaaagtagaaagaaataactatgagacgagtcctttgaaacctgcctcctgttcccctattctccctatatttgtttccactgcagaattacctcagtattcttgaactaagaaattggtggtggcaaggtctttattcttcatattttagccttacattattgaaatgcctttcagtttgatgcctttgtgtgactgccagtgaactaggttttcctagtgtacaggtgttgcccatgcccacacctagattatcaatgatactgtaaaacttgacctgaaattttaggttgatattcctggcctttctctttcaaattcctttaaacttttagtaaccacttgttggccatttattagaacacagggaattttgaattaaaaactcacataatttaaaagaaacaggaacacctagtgctgagaggatgtggggaatagcatattctcatacattgctggtgcaaatgtgaattgttacagccttttggaaaataatttgacagcttggttaacaattaaaattcatattccttttggcctagtatacctcctcctaagatttctactcttagacataaaagcccaagtaaggccatatgtatagggatatttattgcagtgatgtgcatattgtcagtcaactgaaaacaaaatgaacattagtagggaaaggcaggaaaaagtgatacctccataggtgggatactatgctacataaagaaaaaataaattagactaataccagattagtttgagaaatttccgtaaggttttgttgagtgagcaaagaaagatgcagaaaagtatataataatttgtgtaaccaaaaaataatttaagagaaccatgcctatatcataggctcatgagtatgaagaaaagtatttaagaattcctggtaggtggttaaatgtttaccttggtcaagggtgggtcagagtaactggggaagtgggttaaaacaacaacaacaacaacaacaacaagattcgtctgtgatcatatctatgcattatctgtaaaattatataaatatgtatgtttaaagatactaagtaaacatttaaaataaaactgacctgtttcccagcctggacaacatagcaagactcatctctaaaaaacaaaattaattaaaataaattagctaggcatagtggtgtgtgcctgtagtctcagctactccagaggctttggtaggaggatcacctaagcccaggagtttgaggctggagtgagccattgagcttgccactgcactccagcctgggtgtcagtgtgagattctgtctcaaaaacaaaaaacaaaaaacacaaatatttgttttataaaactgatgctgatttgcaaacctaagtgttcacgtgaagtccactgaaactcttaggagcagaagcagcatagtggagagccataaaaccttttatattaggccccaagacaaagaatcaaggaagtgtgtacacacacacggaataaaacaataaccagtgggaaatttacctaagaaactagaagcctagagtaaggtggtttttgtgggtggttgatactgtttttcagggactttgcattcctttgatttgtcattcttggtgttggctttgtgttcaggcatagcacaggcgttgtgttcaggctgtagtacttccagctgtaaaatccagctatagcaaagtccagatagagaagaatggtctcttcttggatgtttatcataggttgttttttaaaaagcatttgctaaggctgagtttgggttacaacttgattatagtattgtagaggaaggtgttattggaaggaaaagcataattaggcaaaggaagaagttgagctccaatgcaggcctgacaaaggggaactgtgggggcaggattgcttatttgagttgtcccatgttggattgaaatgcttgggcctttatactcttttttttttgagacagagtctcactctgtcgcccaggctggagtgcagtggcgcgatcttggctcactgcaagctctgcctcctgggttcacgctattctcctgcctcaacctcccgagtagctgggactacaggcgcccaccaccacgcccagctaattttttgtaattttagtagagacggggtttcactgtgttagccaggatggtctcgatctcctgacctcgtgatccacccgccttggcctcccaaagtgctgggattacaggcgtaagccaccacgcccggcctatggtatgggcctcttcatggtgtgggctgccatgggaagggcatgacctgtagcaaggcagcccctgaaggaattgatgttctgctgaccacattccctgctgctgctggcagcaagtccttccttgaagaggagatctaggtggcatgtctccctgtccacacactttcctaagaataagaaaatatttcctggaaatcatccatcagatgtgccctcacatctaagtattagattacattctgtgtcagagattcatggttacacatcatagcctttttctacttctctagtaaaaagaattctgattttttgatgggtacatgatcatctgggataacggctgcatttttcagccttcctctacttgtagacatgtcagtaacttctggctaatcgaatgtaagttgaattttcatgtgtgacttaacagagggagagagggtgtacccccccgttttcttttcctccttcctgctgggtagaatttgggtataatagctggagcttgagccgctatcttggattatgaggtagaagccacatgttggggatgacagagcaatagtatagaacagcattaggtccctgatgatcatggaaatgcattgcatgctctggattgcttatctttgggttttttttatcttggtggttagtccattactatttaggtttttctgacagttgcattaaagcctaatcttttttctacatctatatctatatatgatgtatatctatatctatatagatacatattcttttttaaaaatagatatgagggtgttgctgtgttggccagcctgatcttgaactcatggcctcaagcagtcctcctgcctcagcctccaaactgctgtgatttcaggcaagagccaccatgcctggtccacacctaattttaattgatacagatttctaatcagtcagtggcaaggggcatgggaaaacatgattggcttcgactaacattttggggtggaatggattttggggagtagggcatggatacatctctatcaggcaagtacagcagaggaagagaaaggcaagaacatcagggagtttgcaggatatgattctcgtgatggattatggagtcttaactaggtatgtgagaaaatgaaatgtgtggatggtaggtggtgaacagtgaagaaatgatagttcaatggattggtggtctccatggggccaaagtctcattggaaagggggaataaactggagagatgagatagtagtcagaggtcagggtgctttttttgtggtaatgttgttactggtaatagcaagggccagagaaggggatggctaaagaggggtggaggaaaagatagttaatggtgaggttaagaaatggagagactggattttggatggaacatcttagatgttgatgcagatgagtggaagagagtgaacgatttgttaatatctttagtgcattaggagtagctgggagatgactcagaaggtaagggaggcagatccagaagcgagcatgtgttcagagtggctgatgttaatgaaagagggaagaaaaatatctggaaacagccatgatgaaggaaatagcgtccttcttaaatattaaacatttttatatagtaacagatacttgctggtggcagtgctcatgcctgtaaacccagcattttgggaggccaagataggaggattgcttgaggccagaagttcaagcgtgggcaacatcgtgagactctgtttctacaaaaaataaatttaagaaatttatcgctgggtgtgagggctcaagcctgtaattctggtgctttgggaagccgagatgggaggatcttttgaggccaggaatttgagaccagcgtgggcaacatagcgagacctgtctttaccaaaaggaaaaaggatgacataaaattaagataagatttaggtatgttttgttcattcctgttggttttaatatttttctgtcttcttttttaatgtatgcaataagtatttgtttcatctaaatttatgcaatctgaatataactagtcattttctactggttatagtgtttgttaatgtacccattatgtttaatttgtattatattaagaattaagaaatattaatatatgaaaatatataaaatatataaaaatatatgaaattaatatagcagacttaagttttctttcttgatttaaattacagactaactggatcttctgggtttgtgacagatggacctggaaattataaatacaaaacgaagtgcacgtggctcattgaaggacagtaagtagaaatggctgacttaatttttgtttttttagcatagaagtcagtgtgacattagttttcccacaagtaaaattaacaatctgtagcataaagttcttaaaacattacttgataacctttcatttgacaagtgaattttatcttagccttcattaatttaaaagtttcatgttgatttaatgctgcaaatgaattgtacacaccacaaatttgtgtatttccaactgtaatagttcagaaacggttacacacacacacacacacacacacacacacacacacatatatatttatttatttttatgggacagagttttgctcttgtcacccaggctggagtgcagtggcgtgatctccgctcactgcaacctccgcctcccaggttcaagcgattctcctgactcagctcctgagcagctaggattacaggtgcatgccaccacgccaggctaattttgtatttttagtagagaaggggtttcaccatgttaaccaggatggtctcgaactcctgacctcaagtgatccgctcgcctcagccttccaaagtgctgggattacaggtgtgagccactgcgcccagccacggttccatatttttaatggtttgcttaaagcattagaaaattgcaatattgtgttatttttctaagtatctatttttgttgtggataagaaaattgtaataactgttattgcctaaatgatcccttctctggacccactgtgtccctctggctgttggccttttttctccttgtcttcatgggagacttttaaagcagtacttctcagacttttttggtctcaggacctctttacacttttaaactttgaggattccaaataagtttatttattatttatttatttatttattttgagatgtcatctcgctctgtggcccaggctggagtgcagtggtgtgatcttggctcactgcaacgtctgcctcctgggttcaagcgattctcctgcctcagccttccaagtagctgggattacaggcatgtgccaccatgcccagctaagtttttgtatcttgtagtagagacagggtttcaccatgttggccaggctggtctcgaactcctgacctcaagtgatccgcctgccttggccacacaaagtgctgggattacaggagtgagccactgcacccggccccaaataagtttatgtttttctatttgtgttcaccatattagaacttacaaccaagaaatattatttattcatttaaaagcaacaattataagccatgttagtacaaatgatattttaatgaaaaaaaccctatatttaaaaaattgtagtgaaaaaatggcattgttttacatttttgcaaatctctttaatgtgtagcttaataaaagacagctggattgtcatatcttctgcattcactttgttgcagtatgttattgtggttgaagcgtgtcaagaagatgaggcctcacttgaatatgaagtaggaaaaaagagattttaatagtacagtattttaaaattattgtatatagtcttctttgataccatatcaaaacttaacaagtagtaatttcttaaaagtaaattgcagtatggaatctgaaactatgttaaggaacttttggtacttgttaaattaaaatccattggttttcttgcactgaatggatcttttgcccatccatattttggtaacatgatatataggtcatttggaaaacaacaggtcattgaattatgcagatcttccatatgttgatatatttattccattacataatattttaaaaatcacattggttagtatccccatcaatctcctcaaaaagttctaagtatggcagttaacaaattttccaaaattctaattactacttgaaagcttgtattttatctttggcagcaaatactgtcagttgttttctttgaagtggcaggcttgctttcctcatttttaagaaaatgtctgccagatatccaactctgaataaccgtagtttattgattgttctttcaagtaaacatggtaaatggtgttctaagaaaaaagtagctagttcagctagcaacttaaacagttgcaaaagtggttttcattgagaaaaccactgtgcttctattaagcaaaagaagtgttttatatatttttttcttgtttttttttttacatttttttattttatttttttattatacttcaagttctagggtacatgtgcacaacgtgcaggtttgttacatatgtatacatgtgccatgttggtgtgctgcacccattaactcatcatttacattaggtatatcccctaatgctatccctccccactccccccaccccacgacaaaccccggtgtgtgatgttccccttcctatgtccaagtgttctcattgtcctattcccacctataagtgagaacatgtggtgtttggttttctgtccctgcaatagtttgctgagaatgatggtttccagcttcatccatgtccctacaaaggacatgaactcatccttttttatggctgcatagtattccatggtgtatatgtgcctcattttcttttttttattttattttattttatttttttattattatttttttcatttcttttttttattttttaatttttttattatactttaagttttagggtacatgtgcacattgtgcaggttagttacatatgtatacatgtgccatgctggtgcactgcacccactaactcgtcatctagcattaggtatatctcccaatgctatccctcccccctccccccacctatttactctccatcttgtcagaatattaaagagatgtctactaactggtgaggatttaataacattagaagtttttaactgcttaatcaagatatccttaaatgaaactggcagcttttcttttttctatgagtggttcgtggtgaagaatagcagtgatcactagtaccatttgctgctgctgtcttgatttgttctaagatgcccacagtttcacccaccatttctccttgaaccattagtaaatgccagcatggttataaaatatatgctatcttagttttactgtgaatatagttttgacctcctgggacctcccataagggtctcagggcctgtagcattttgtggacttcattttgagaactgctgctctaaggagctctgctgtgtcctatcagttcattgccacctgacaccctcctccactgtttttctgaatgtgctctcaatggttgttcctcctcagtgtaagtgaaaaactaagcaacaaactctcattcccccttttccttattccctacatttagcctgtcagtaagttctgtcagttttccctttggaatgtctccccaatccatcaccagactgcttttcacctccatctctacagctgggagacccaccatcgtctctctcctgggccacttaatagccttgaaattggcctcctgagttctgcttttgccccttgcccacctcccacttctcatctcttaaggttttctctgtttgctgtgtttcagatatgctgattttcttcatgttgcttggacacatcagcctctttctcccttaagactgtgctgttccctccgtctgaaacgtttttcccagcacttttcacatggcttgtctcttgtcattctcacatctccaaagcttactggcctatctccctacgactttttgcactgccacatcaccttcttttaatttcttcacagtactcatcaccatctgagtttacttgtttatgtatttatttagttgtcaacctagagatgttagaaaagtgtggggtataggaaagttctaaactggagaaatagaattaggcatcagcaggatataatgatgttgatattcccagagctttctgagtggagtgttgggctgaagccaggctagagagtgaaggggtgagtgagatagagtcactggaggaagcaaagtcttctgcgaagttttacctttttaggaggagaaagggtagggcaggtatttggtagagggagagttgggatttgaggctttttgtttttatttttgtaaaatatgtgatacttaagcagatttgaatgtggatgcaaaagttccagatgagagggagatgtcaaatacttgagaaacagaaagagaattttggaaaatgggaattttagggtttttttatctggttgctgagcataagcagggaggtgggactgggtggtttgaaatagtcgttgagagtagcagttgtggagagggagagagaattggtaggactgctggcagaatctaagtgccatttgcagttggagagcagagaccattgctggaaccagtctacccagtggtgtggtatagaagtttggctttcttcaatacagcttagttttgttttttttttccctccaccgccccctcccactttttttttcctggttcaatcttagagcagataactggtttcctgtacaacagagcttttgccagccagtgtcctgaaaaatcagaggggctggcaaatttagaggattggcaggcatgtttatgaaatgacgtagtgtggaatctgaagttgaatgaggaagtgcagaaatggaagggctaatgggttggttcagaagctgttaaagagtggccactgaatggactgtaaggcccagaatcatggaccacatcagttttgtttcccattgcatgtttagtagtctcttgtacttggagaatactaaataaatctttgacaaatgaaggaatactggtggggcagttgttagactgtgttacatattattaatttaaaaatctgaatttttatattctcaaatgtctgatagttgtgataactttattataaattactttttttattcttttcaggccaaatagaataatgagacttcgtttcaatcattttgctacagagtgtagttgggaccatttatatgtttatgatggggactcaatttatgcaccgctagttgctgcatttaggtaagctcagtcttacaagccttctttcatcgtttgatttctaaatttaaacatatcttctggattgcattcttactgggttcacctttattatcacttaacacatttatttaatggaaagaatactagttcttcagtcccatcacttgtgtgttagtgctaacttggtttctgtagccctgggtaagtttctaggcatagtacttgacttctcttttcagtgccctgatctgtaaaattgtgatagttctattaagttcacctgctccttgtggtggtggtgaagtttatcattacaaaatgttttgagagtgatatattgaatgatactatttctgtgaaaaatttaaatcaggaataatatccatcatgttccttgtgtattgcccactgcataggccttcaggagttatttgttgaattcaaatataattgtgtgcgtgtgtgtgtgtgtatgtgcatcatgagtgagggaaactttttggaacagtacatataaaatgaacagtggctacctgtggagaaatgaggaacatacttattatatatattttttttcaataagtacatttacattagtagttaaacagaagcagtttaacaccaaatatatggactgttctgaattgtttgggtgttttacttttgattagcagcaagtagctgtgttgtttattatgtttttggccacattggaattcaaaactatctctagttttcttccttttacatgatagaggatttttttttttttttttttgagacggagtctcgctctgtcgcccaggctggaatgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctagaggattttaagatacagtcatgtgtcacttagcagcaggaataggttttgagaaatgtgttattagatgatttcatcattatgtaaacattatagggtatattcatacaaatagatggtatagcctactgtacaccctgcttatatggtacagcctattgtacctaggccacaaatctgtacagcatcttactgtactgaatactgtaggtaattgtaacccaatggtaagtatttgtatatctaaacatatctatacatggaaaggtacagaaaaaatacagtattacaatctcatgcaacctctgtcatatatgtggtccattgttgaccatatgtcattatgtggtgtatgactgtatattttcctaaaatgcatttccccttaggaaaccatagttttcagtttttcacctgcaactggctttctaaatttctttgtctcaaacattttatttcctttactttaaaaagaaatcagttcaacaaatattttttgtgtttctcacatggggctcatctggctgatgtcccatgtggatgagggaggtaacagagagcaaacagtacacaaggacaggagatcaggcgactgttgtgccctcgtgtttttctacccgctttggcttagaaatctctctgacatatctttgaactgagaaccaaggccattttctgtgtttagaggttcacttacaaggccaaagagcagggtggatggctgtgctgagcatttaaaatggcattggccaagtgttggagtgtatatgtttatgccagcatttgaaacataacttgtagcaaaaagcaccccagaccttaatacaagccccaaaactaagtgtgatgttatcataatagtacttgttggggattcacttgttactgtgtttgttaatcagaattcacagagctcttgttgtatgccaggcactttgaatcagcttatcaggagccttgtaggaacatgagccaagcaggtatacatcactctgtggttcacctggactgtgtatttgataaacagtggtagcggtggtagagcagagagagtggttgagaaaattcttcaaaagaacattattccttttagagtttttttttttttttaggaaagttatatgctggtggggcagttgttagactgtgtgatctagaggaacccttccccttcccccttccacctccccttcccctttctccttccccttctcccttccccttcccccttcccccttccccttttccttcccttccccttccccttcccttttccttttctttctcccccaggctggagtgcagaggcaggaacgtagctcactgcagcctcaacctcctgggctcaagagatgctcccacctcagcctccccagtagctgggaccacaaaaatgcaacactatgcccagctaatttttgtattttttttttttttttttgtagagacggggtctcaccatgttgcccgggctggtcttgaactcctgggctcaagcagtcctcccaccttggcctcccaaagtgttgggattacaggtgtgagccactgcacccggccgaagattgcttttgacatacctgtttccaggtggccctgatcttgtcagtacttattccttctgcatttcaagggattctggtgtatataaccagtgaaagcctgatgatggttaacccttcatttacatctccaatcaaatgtcacctcttctaagaggccttcctttcaccctttctaaagtagcaccttctgttctttccctctgctctctttcccttcatagcatttgtctctacctggcattacgtatacacacacctgtgtggggagtatctgggcttatctgttgtttttctaatgtgaactacatgaaggcagggacatagtcttattcactgttgtattcctggtacctagaacagtgactcacatgtagtaagtgcttagtaaatatttgttagttgaatacatagtagaaaatgcatcactgttttgtaactcctggagcaccagagtttcagagttcctagagttctgtcttcatattaaaaattgaagggcgaggcgtggtggctcacacctgtaatcccagcactttgggaggccgaggtgggcggattgcctgaggttaggagttcaagaccagtctggccaacatggtgaaaccccgtctctactaaaaatacaaaaaaaatcatctgggcatggtggggtgcgcctgtaatcctagctactgaggaggctgaggcaggggaattgcttaaaccagggaggtggaggttgcggtgagccgagattgtgccactgcactccagcctaggtgacagaacaagactcggtctcaagaaaaaaaaaaaaaatgaatgaagggccaggcacagtggctcaggcctgtaaccccaacactttgtgaggccgaggcaggagaattacttgatcccaggagttcaagaccagcctgggcaacagggtgagacctcatctgtacaaaaagtcttaaaaattaaccagccatggtggtgtgtgcctgtagtcccagtcactcaggaggctgaggtgggaagatttcttgagcccaggaggtcaagactgcagtgagctgtgatcatgccactgcactctagcttgggctagaccttgggtctagctagaccttgggtgagaccttgtctcaaaacaaagcaaaacaaaaggaacgaaaatcccttcccctcctcattttcattccttgcttatggattcttccagccatttttgtatgcatttatataggtatgtgtaagtgtacacatgtacggtccattgttttgcagcttgcttctcccccatgcccttatcagaatgcctgttgagcttcttgttagtcccgcagacctaggtaatatgcagtgactcatgcagtcagatttctgggcatgagcatttagatgggtttcaacctgttgccatctgaacagtgctgtggttcgcattcttgtatattggtcatcgtgtacatgagcaagtatttcttctacaaagaaatagaattgctaggtcagagtgaatgagcatgaggttgtgtgtctgggacagattgcgtagggcctggcaaggatataggcttttaccaaatgtggtggtggtggtggtggtggtggtgaatcaataatggggcaaaaatcatggacatatgaagaaatgcaacagcaggtagacataagaaaaacaattaacctcaggagtaaaaagaactcagaaccacaatttaaaaattgctttttacttattaaattaacaaaattaaaatagaactagtagtccttgctgttggcagagtgaagtgggatggacccttcattctgtattgatacgatttcaaatcacatatctcttctggaaagcaagttggtattatggctctagagtcttaaaggcatcatttagacccttttactcagtaaggtttttttttttttttttaccagtcacacaacaaacatttagaatctgtcatgtgctgggttgtgagtgaggtcttaagaagaacctagggagcttttaatgatatagaaaatgcgttaagttttatttgtaaaatggaatatacaatgtaaataacatcaattaggctaagaaaatgcatcagaatactaacagtgttggagttatgggtgtttgtttagcttcttcgtattcttatataaatattttatataaaatatcttgggcacaatggctcacgcctgtagtccctacattttgggaggccgaggtgggtggatcacctgaggtcaggagttcaagaccagcctggcctacatgatgaaatgctgtctctactaaaactataaaaaattagctgggcatggtggtgggcacctgtaatcccagctactcaggaggctgatgcaggagaatcgcttgaaccccgggacgcagagattgtactgagattgcaccactgcactccagcctgggcaacaagagcgaaactctgtctcaaaaaaaaaaaaaaaaacaacaaaaacctcatgtctttcagcaatatatgtgtggtattcatcactcataaaatttgttactttatgtgattgtggaggtttattttttcaaagaagcagtataaaaagttttataagaaaaagaatagggccattgatttcaaatctcattagaaatacaactcagaataaaggaagcctagcaaaagattcagatctgttcctcaaggatccagaactgatagggtagcactgtgtgtttatcacaggaatttgcctgtcttcctggatgtggtttttaaattttaaggacggatttgtttttaatttctgtctgctacaatttgacatgtctgtgcttgtgcttccctctataagaagtgtgttttcatttcagtggcctcattgttcctgagagagatggcaatgagactgtccctgaggttgttgccacatcaggttatgccttgctgcatttttttagtgatgctgcttataatttgactggatttaatattacttacaggtaagatacttaagtctagtatttgtgatttcattcaggagactatctactatgttttaacaacaataatggctaacatagattgagagccaggcatagcgtcaggcagtttacatggattttctcatttaaaattcttccataaattcagtgaggtctgggctctgtttttctgcttatttataattgaggaaactggcaggaaaaggttagtagattgtcaaagtaactggtgggaccacaatttaaacccaggtgttgatgctgttgaacttctagaagagagggacttttctgctaatggacaaaaacgttggaattttacaaagtacagctccacaaatattagtagttgtcatgtactcgatagtagaagaaatctatactcattaaagtaccttgatagtccatttatccccccttttaaattctgaattacattgtttcaaagcactgtcagtacaattatattattatgagatgcgttatagttcaactgttttttttttttttttttttgagacggagtctcactctgtcacctgggctggagtgcagtggcatgatctcggatcactgcaacctccacctcctgggttcaagcaattctcctgcctcagcctcttgagtaactgggattacaggcacccaccacttcgcccagctaattttttgcatatttagtagagacggggtttcaccatgttggccaggctggtcttgaactcctgacctcgtgattcgccaacctcggcctcccaaagtgttgagattacagccgtgagccactgcgcctggccatagttcaattcttacattaagttaaactagcctgccttcttccatctgaaatgagtagataaaattactaaggaattttaaatataccaatctgggcagtaaccttaaattctattaaatacaaattttcagagagtgtacagaggaatatgtaccatgaggatggtagtttattgttggcagtttgttttattcttttccttcccagacttccaagcatgaattcagcaactctgtaaagctcatcattaggaggctaccaagaagaataggatagtcctcccacccatgaggagctaacagttctgcacaaatctcctacctcctttaatttctttgactttatgagttatttattcttatcctcttattatgagaatccagcagggttgatttgatttcattacttgtacctcgggctctagctatgcagtgttgagcaaacccatttggactgaatccttaagtactgcagttacacttgtgaatgaactgagacagtgagattcttaaacttgtgtgggaggaagttatgctaagttaatggaagcgttgcgttgtgttaatgtaattttccctgctatttttacagttttgatatgtgtccaaataactgctcaggccgaggagagtgtaagatcagtaatagcagcgatactgttgaatgtgaatgttctgaaaactggaaaggtgaagcatgtgacattcctcactgtacagacaactgtggttttcctcatcgaggcatctgcaattcaagtgatgtcagaggatgctcctgcttctcagactggcagggtaggagcttctttcatttttattttttcttccatttatagaacattcccactaaataaattatagattgactttattcttagcacctatataatttatattaatcaaatacgaggtagcatttaagcttgaaacatccctctatctagctgcttatgaatttcggtttcatacatgtgtggtcatggtctttagaattatggagggttggccattttttgcatcctgtttgtgaaagttggagaacttggactcagtcataaaaggatgtagcagagagccaagctgggagatgggacaagagctgacaataatgatatttcctcagaaacacactctaagttcagagaaaattggtgtcagttatacattagaatcttaaaggagttagctaattatttctacagaaataattaaagaagctttagggaattatttaaggggtgagtgataataactgttattaatttggtgatttttcttgtaaacttaccccttcctcagaacctttttactttgaaaggaaatatgctggtttaaataccttagtttgttgggtttggctgacattttagagttaataattgaagaatttcagtatctaccattgtgcaaatattgcagcagaagccaaacctcccaagaatggagtctgtttcttcaatttgtttaagttttttgatttaccagaagatggatagtttgtatgattgctcccgggtctagttatcaaacttattcctccatatccacaagttctgcatctacaaattcaaacaaccatgtgtagaaaatattcaggaaaaaaacacaataaaagataatacaggctgggtgtggtggctcatgcctgtaatcccagcactttgggaggccaaggcaggcggctcactgaggtcaggagttcgagaccagcttggccaacatggtgaaaccctgtctctactaaaaaatacaaaaattaggtgggcatggtggcaggcacctgtaatcccagctacttgggaggctgaggcaggagaatgtcttgaaccctggaggtggaggttgcagtgagccgagatcataccactgcactccaacatggataacagagccagactccatctcaaaaaaaaaaaaaaaagataatacaaataaaagatacgcatatgaaaacaaccatttacatagcatttacattgtgttaagtattataagtaatctagaggtgagttagagtatatggcaggatgtgtgtaggttatatgcaagtgttacatcactagtttatattagggaccttgagcatctgtggattttggtaccaagggcatcctggaaccagtcccctgtggatattgagggataactgtatattttatccttaagatttttcatgtgagttaattatttatttatctgtgctttctcctgagagttgcttaagcaggtatttcattaccaaaaaaaccctaacctggatatagtcaagtcatcattagaaagtatgtgatttacccttggtcaataccctgaataaattaaaataacaaattaaaggatttgtctgatatttaaatgctaaaggaaagactattatttaaatatttgttacatttagataattaaaacttgaaatgcagtaagctttaaagctgtcttttgtgaagctaattcattatgtttttattaggtcctggatgttcagttcctgtaccagctaaccagtcattttggactcgagaggaatattctaacttaaagctccccagagcatctcataaagctgtggtcaatggaaacattatgtgggttgttggaggatatatgttcaaccactcagattataacatggttctagcgtaagtcgttttaaacatttttgcaagaagcttagttttttattttgaaaatttataaagcacagataagcaaaaataaatcaccagtcattctactacctaaagaaaatccctgttaatattttggtagtagtctttcaaagtgttttgacatatgttgagtttttaaaattgaatgctacaaaaaattcattgtcatgataagcattcacctcttttcaaatactgtctctgatgttttgctttaagtatatgtagtaagttctatataagtaggggattattttatcttttaatttaattaatagttccaaggtcaaatggtttgaatttatagtttgctagtggaaattataccattgtctactatgtcccaggcttcaaggtctatttgctaatctcgtgctgctcattttgaagggagaatatgtgttgtcatagtggaattagctatggaggtggacttgtagaaaaaaatttataaatatttaatcttgctgattttattacctggaacttttttctaggcattttctattaatgaagattgtcaaaaaacccagcatctgttcattaagggattctggaaatatggcagtggtggcctagtttctgcatccccccaaacatagtcattaaaacacatcacacaactagtctagcaaaatcagagaaacatgagcaacatctataataaaacttggtcaggctaggcgcagtggctcacgcctataaccccagcactttcagaggctgaggctggcggatcacttgagatcaggagtttgagaccagcctggccaacatgataaaactccatctctactaaaaatacaaaaattagccaggtgcggtggccggcacctgtagtctcagctgctcaggaggctgagatgggagaattgcttgaacctgggagacagaggttgaagatcagatggttgtaggtgtgaagccttatttctgggctctccattctgttccattggtctatgtatctgtttttgtactagtgccatgctgttactgttactgttactgtagcccaggagtatagtttgaagtcgggtaacctgttgcctccagcttcattctttttgtgtaggattgaactggcccaatctctattcccattgctgctgcctttgttcgagccctttaatttctgatgagactcctgcagtggtcaggtcaggttagtagatttcctccaggttcttttctttccccatacatagattcaaactattttctttgcctggaaaacaaatgctttcctgaatatgaatttaaagtcacatcttattacagtttttaggtacacagattttaggcattttcatgtttttcatcagaagagctgtttgccagccctaggagtggcacaggtggcacccagagatctcgtaggagattggatctctacagagcttttcttacacatcccccttccctctggggggaaagagacctgtcagggtctattctttcttggctggacaacccagaggaagccccagagttgttcaggggctcatgctctttccagactctacctcagcaagtcatttgtgtgggcacctcttagactgtgtcattatcaataactgcagcccctccataatctcatttctaaacgttccacattccaccctgcttcttctgtggtggacactgttggtgccttgcccagatctgtttatctttacctggctggtgcagtgcacccagtcacctgatgctgtgcaatttggctgttgtcagttcatagctgaccctttctctgaagaattctctcagcagattggagctgtcttacccaggaacacctagaatactatgctctatccccaggatgtcccctagtgtagtgaccaaccagtttgcctggaactctcccagttttagcactgagtcttgtatcccaagaaacccctcagtactggacgaaatgggatggtcaccctggcccccagctgctgactggctggatggaggtacatgagtctgaccctgcttctacatgggaaaattcatgttccagggctccccttgggatcaggccaaagctatacttcaactgagaccacctttttacttatcctctccttcctactaccttgcttgtctcacttcctgatgtttgtcaaaagagtattccctcagtaaatcacttgtacaggaatctctatctccagctctgcttgcagggaatcttacctgagacacttttcaatcttttcagatatttctctctaataccctaacagtgtttgatctccacatgggtccataattcattgattctttctctctccctctcctgttctccttcttaactctaatatcttcttttcatttttcagattcctaccacctttccttctgttttcattctcagttaatggccttgcttcctgcttctcttttgaaagataaaggtcagaaaatgatttccacaaactcctaccaccacatttccccttcacctatatctgtgcccctttatggtcatcttttctgtagatcagtgctgtctcatagaagtttcaggcatcattcaaatgttctgtatttaccctgttgtgtcactggccacatgtggttatttcatacctgaaatatggctagtgtgacttaggagctgaattttttattttccattcttagttcttatcttacttgatctggcaccaacatttgatacagttatccttccctcctcttttaaacactttctttagttggcttctaggacaccacatccccttgatattttttttaattccatattccttctcagcctctttagctggtttctcttcagctgactgacttctgaatgatgtcagaccagggcttaacccttggtccattgctgcctgtttattcactcttttggtgacctcatatagtatcttggcctttatacttggtgactctcaaatttgtatttgcagcctagactttttacctgatcccctatctccagctctttaattgacatctcaaccttctggctgtgtactaggcatcttatgctcagcatgtcccacactcatctttttctcaaggctgctcttcccccagatgtccctatctcagttaatggccactccatccttctatttacttaaggcagaaatcttgggtcatctgtgacttcttgtttcttcacaccccgtattggtatatttgtgagttatctcatgctacataacaaattaccacaaacttagcagcttaaaacagtttgcatttattatcaccatttcagttggtcaggagtcctctgtaatcaaggtgtcagctggcctgcattctcatctagaggcctgagtgaggaagaattcatttccaagctcacttaggttgctggcagaatcaatttccttgtagttatagaaccgagggtcccagctttctgctggctattgacttgaggctgtccttaatttacggaggctgccttcagctcctagagcttacctcagttcctagaggccacccagtttcttgtcagctgagcttcaccagtatagctgcttacttcatcaggccacaagaagagtctctagactgagtctgctagcaggatggatgtcacagaaatgatatcctatcatcttcgccatattctgtttgttaaaagcaagtcatagatcctgcttacctcctaggggaggggattgtacatggttatgaataccaggaggtggacatcatgaggactaccccagtgtctgtctgacacgataggtcatatcttgttagctctacctttagaatctgtcccaaatctgatcacctctagtgctgccaccatgagaagagaaggtaaaattaaaggcatgaaagtgattgtgccttctgctgttatactagatgttatgaaagacacatatttaccattatgtgattttaccctaacatcctccctgtctcttgaagcaagaaatctgggaatctttagatatttccatatgttcttctcttcgtaccataatttcatattaagccctctcaactctgtcaccaaatacatgtcatatttattctttttatgtacagcctgctgttatctcttacttagtcttcagcagtaggtttctatcaaatctgttcatttccatttattcctattaatcaaattgctaaacatgaactggggtgccattgaacaatataaataatatcatttactaccttcttaaaacccatcagtgtcttgcctttggacttaatggccctgcatgatgtgaccactgtttaccttcccagactcagtcttttcctctcctgccatcattcacagcactcctgccccaccaacctgctttcttactcaaaacgtacagtgtacatcattaccttaagagcctgtgtgtttgcccttcccttggtctagactgttcctgctattgtgcctcagggctggtgtcttctcaccctttagatctcagtgtggttttcccagagagatcttctctgaccatccagttcagacatttctccctgttcttttttatagtcctcattttctttatggcagtgttagtgattttttgttatgtcagtgcacactgttgtacttgctctttgtctgcctttgccaagttcttcaaggttagggaccttgtttactcactgcactcagagcttagctcatagaaggtactcagataggtatttatcagataaacgggggagtaaatgatttatttccttcacaaacatctgttcctggaaatattaatatcacctattacttttttttgactgacatacttcatgagccacattgttttttagatcataactttttttttctactgatcaaaacatgattttctacagctttatttgtttcacgtaaatattagcatagttccaaataatgaactttcatgaaaagttaatttagtgattcattttagaagtagtgtttctggaacttagattacagatttttatttatttatttatttatttatttatttatttatttatttatttattttgaaatggagtctcgctctgtcgcccaggctggagtgcagtggcacagtctcggctcactgcaggctccgcctcccaggttcacaccattctcctgcctcagcctcccgagtagctgggactacaggggcctgccaccacgcccagttaattttttgtatttttagtagagatgggtttcaccatgttagccaggatggtctcgatctcctgacctcgtgatctgcccgcctcggcctcccaaagtgctgggattacagtcgtgagccactatgcccagccagattacagattttatagtcatttatactcttacatgaaagtattttaggaattgctcttcctgtcattttcctcacagtcctgttaacgcaaaactttttagttgcattaaaaagcaattcccattttgttacccaatggtcctcttgtgaaataagtggtcttggtcccctggattaagattgccagttgaaacttcattaccaaatttccttctcttgagcagaaaagctttttttaagtttaaaaaaaaatagtaagaaatcagtcagcagtcaaccaaataagcaaagtagcatcaccgaatccaataaatgttaaagcaggctcatggaacaccaagtgtgacctgacctcttttttttttttttttttttttttttttttgagacggagtctcgctgtcgcccaggctggagtgcagtggcgtgatctcggctcactgcaggctccgccccctggggttcacgccattctcctgcctcagcctcccgagtagctgggactacaggcgcccgccacctcgcccggctaattttttgtatttttttagtagagacggggtttcaccgtgttagccaggatggtctcgatctcctgacctcgtgatccacccgcctcggcctcccaaagtgctgggattacaggcgtgagccaccgcgcccggccgacctgacctcttacataccccacagaaaccacactcggggagattctgataattctcggtgatagcccaaaatctggaaggaagcaaactgagtgagcattactgtttttgactgtaactgaagagtaggagacatagttgctggggaggatcaggtgaaagggggagaaattgaccaagtggctgattccctacccagaactcagagcttctatttaaattagaatatgatctgagcactgtggtagaccacaaacaaaatctcagaggagaggagagtctgggtattttattctaacagactgcactctcatctgagccccaacatttccttagacttcagaagagtagatagaacataaaataccagccctcacactaaagctatggaaaggatagaaattcgataaacttgtcttagatacagtgggaacagaattgagaaatcacccacactttgcaaataaaatgtctggagagctatgtgtaacctcaaacaagatgaaagaagtggcatcgtagctagtgcaaatattctatgatgaaaaaataaagaggaagaaagactgcagcctgtaaaatctaacaagaacccatcatggaggaaaagcagcttcaaggagcagaaggagattccttccaactgcttcgtgctgcagatcaacttaatgagaatttgagttcagaaaaacaagctagaagacaagatgataataacagaagaattgggaggctgtaggcctaaagaaatacgaataaattagatacagcaaaaattagaatgaaaatttaattactgacaggttgagataattgtagtaatacattgggaaaaaaaccagaaaagcaaaaacacacaaaggacagaaggtgatcaaatagaactataattgcggtcactgaagaaaagaacctaacacacgtaacagacagattgaaacagcacaaggtgtttcagaaaaatttcatagtttcttcatgacaaaacctgatttgatcaagttattgaactttttgtgcttggagtgtatccaagaaaaataaagtcattgaacttttgggataaaggacaaattattatttgggaggcctcaggtagttctgtgctatctgctgtttggggtcatgtctagtctccacagagcctttgccttggtctttaggtggcccgattgggttaccaggccattatggagtttgaaacctgtaccctgtggtacatgatggtcattggcttgccagccatcctagaggggtcgagggaggtgctgtcactctatggaagacatctttttctgaatttctggaatctatctttgcttatttgcttgcttaggtcttagaattagttgttcactattctgttatcttggattcagctcccagaaggtgcatttatctcgtacttttttgtacgagatacttttttatgttttaaaacataaaatttatgttttattgcatcagtatcgttcttgtcttatgtttttttttctctgtgttgagagatgattaacagcatgttgtttaagtgtcttctgatggttcaccttagccagattatggggacctgccagcacctatgtgtctctgacaagctcttggtctgacttgttgacagaagaggagcaaaatacattaagagacagattgggcactctccgtgccctttaacagaaatgtggagacctgtttctgtccttcctctgtttctttcctttcttttaaacatacagaaacaagcctctggcttgaacataaagtctatatgtgtagttggaagctatatgagtccttctcaggaaacacctttcatagccagaattccaaaaaagctttgcagtggtatgcagtccattttataaaaacatattcctggatggatttatttctatttgaagtaaaatacaatatcatgtcataaaaaaaatagaggttgcgggtaggcagagaagaagagagaatgagaatgattcagaattcttcaggcttccaggcagaaaagcaaaccatgaaaaaagagggaaataagctggccacagacttctccgtagcaacattttcagtaccagcagtgttcaagggagcaacatctgcgaagttctggaggaaaaaaaggatggtccaagaatagtgtacccagccaaggtgtcattctgctgtaaagctggcaggcagatattctcaaacaagagtgaattcagggaaagagtactatgagctctacttaaacaaaacaaaacaaaaaccctcttgacagtgaaatccagaggagaattgaagagctcaagaaagagaagttgtggtaaaaggactgtgaggagattgagtcagctaaaattcaggactaaataactatggaattactgttattgaatgtagtgcaaatgttaaggacctggacattgtaaaaattttataacaaaaattggaagaagaaatgagaggcaatgtgagtgctaagatttttcaactttcaaagcaagaagttagtgaattctgtacaaaaataaattgcatataactttaaattcaacctctaaataatttttcatgtatttttaagagtgcaatattccaaaaatatgcaaaataatagttatgtgcaattaatatttaatagttgtcaccatttgttgtatttgcttcagatcttgtataaaatatttaagataaaaggaaaggcttagagaaaattaacatcaatggattcaccaccggcttagaaattaaaacactgctaacacagttgaagtcccttgcatgtccctccaaagtcccagagataacctgtatcctgattttggtgtcagttgttcatactttcatatatatgttatactttacatatatgttatacattacagatatatgaaagtatagtagaattaataaattttctgtttttagtctttatagaaacaatattctgcagtgtgctattttagcttaacattgttttgagatttatgttgacatatgttgctggcgtatatttttcattctgtatacttattctttatgttatctatctggatatattaccatttatttgttgattttcaatggatggacatttatttgtattcttttttgctattgtgataaactttcttatacctttatgcttatatatgataatgtttttcaagattttttaaatacttggaatatccaggtaaacttttatagaaaagaaacatttacttaagatataacaatatcatttctttttgttttttttctattttatgaaaataattaaaatcaacactttattaacagtatcctcatatgcatagaaagatgtctggaatgatgtttacttaatgatatttatttctagatcatggaatgtggcatcttttaaaaaaaacttttagctctttattctttgtattggttacattctttataatgaacatgtatgattttcataaaaacagtagagtttttctcaaaagcaaaaactcaaaagtgagtactttaagatactgaatgtgattattgaataatgcatgaataagtataaattgcatggcaggattataaattattttctttttggcatttttgtattttaaggtctttatattcgtagtacaagtgaaatgctataatggtattctggcttttgaaaatgtatttttagtcaattatataaagaaaaggaaagattagtaattttcttttacttaattatcatcccttttttggtacctatcttcagtttctcatgattaaataaaagaaaagttattgtaataaaattttgagtcccttgagtacaatgcaacctttaaatgatttagactgtgtatagaagaggttttcaggaagtgttagaaccttccagtagctttgtattcctttcttttcccaggattttgtagtccagctcctcttcctgagttatcacttgtccagtgggcccaggtgtcaggtttatttgtgaaggtgacaagtgcccccctacatccatggtggatttagtgagcatctccaaactggattatgtcacaaataaaatagtatgagatgttctgtcttattagttgggtgaaaatatgatctgtttgttttgtaggtatgaccttgcttctagggagtggcttccactaaaccgttctgtgaacaatgtggttgttagatatggtcattctttggcattatacaaggtaaagcatctccactctgtgctaagcaagaaactaagttttcctcagttacttcatgtattacatagttgaaaagctacctcagtgttggtttttaattggggaaaactttttattgggggcattatataattggctaagttataagtagaaattaaaatggaaacttttttaactcaagagattttaatggcttcaaactgtaatggggtattataataatggcactaaatggttaaagatgtagattaaaaagtgtagattagcttttattctcataagcaagtttagccaagaatagccacattgtaatgtggctgaacaaacattttcatttcctcatttttatagatagatggtaggatgaggcaactttatttttccaagtccttttatactataaaagattcatgtgaggaagtccaagaaaactggtgaagtattagagatgtaaaatatgattagttttatttcccttttccctttttttatccttttcctagtaactcactgaaaggcgccttttgctaacccttaaaattttttttaatttattttttactgaggtaaaatatacgtatataatggtaccatctttaccatttttaagtgtacagtttggtggtaataaatatatttacattctttttttccttcttcattctcccccaccagcctgccagcctctggtaaccaccagtctactctctatcttcatgagatccacttttttagctcccacatatgattgataatgtgatatttgtctctgtgcttggcttattttacttaacataatgacctccagttcagtccatgttgctacaaaatgactggatgtcattctttttaacggctgaataatgctccattgtgtatatatacaccacattttctttatctaattatccattgatagacacgttgattccatgttttggctattgtcaattgtgctgcaattaacatgggagtgcagatatctctttgatatgttcatttccattcttttggatatatacccagtatcgaaattgttggatcatagggtagttctatttttagtttcttgactaaccttttttaagctgagaataatattgagcttttgttcttctctgttctcagatttaatcttttcaatgtttttaaaaattttgtttgcatttttttcctaggataaaatttacatgtatggaggaaaaattgattcaactgggaatgtgaccaatgagttgagagtttttcacattcataatgagtcatgggtgttgttgacccctaaggcaaaggagcagtatgcagtggttgggcactctgcacacattgttacactgaagaatggccgagtggtcatgctggtcatctttggtcactgccctctctatggatatataagcaatgtgcaggaatatgatttgggtaggtatattttttccagtagatgccttttgaacatcagatttaaaacctctaagcttattattttgactgtttagaaaggttcaacctaatcttgattcggtactttatcttgaaacatagtaaacactgggcccaggcgtggtggcccactcctgtaatcccagcactttgggaggctgaggcgggcggatcacctaaggtcaggagttcaagaccagcctggcaccaacatggtgaaaccctgtctctactaaaaatacaaaaattagcctgtcctggtggcgggcacctataatcccagcaactcaggaggctgaggcaggagaatcgcttgaacccgggaggtggaggttgcagtgagccaagattgcaccactgcactccagcctgggggacagagtgagactccgtctcaaaacaaacaaacaaacaaacaaacaaaagcaacatagttaacattgatgtattaccagtgaaatgcagattatcgatgctcctatgtagtatgtatttgttactgtcaatttggtaaggagccaaagatgacgcaaagtgctttgggtatttaaaataaataaataaaaatggttcaaaacaataaatattgaagaaaaaaaatatttgcccagccctttagagattggtttagtggagtatgatttacccttaatatgaaatatttcccttggttaaatttcattgtatctgttgttgtgcagtaggaataccaggtataattaacattttgtgaaagtaggcctataaaatatatctgtatattggtcaccaaaggttgtagggaattaaatgttcatttgagtgaacattttatttattgagacaggctcttgctctctcacacaggctggagtgcagtggcacaatcatagctcactgcagccttgatgccctgtcctcaagtgatcctcccaccttagcctccctagtagctgggactacaggtgcgtgccaccactcctggctaattttttaattttagtagagatgggatcttgctatgttgcccaggctggccaacatagcaggcctcaagtgatcctcccactttagcctcccaaagtgctgggattacacatgtaagccacttcgcctggccctgagtgttttaaatttagttaattcttttcctacatggcatattagaacatcagaacatagaacagactggaattgggccacatggctttgttataagttttaggtggctttctttaaaatataaagataaaaaagtatatgtatcaggtctcctgaaatccattctcatgccctaagctctttggacattttcagtagtagagaggaggagcctgccatgcttgcctttaactgtctttcctttccagataagaacacatggagtatattacacacccagggtgcccttgtgcaagggggttacggccatagcagtgtttacgaccataggaccagggccctatacgttcatggtggctacaaggctttcagtgccaataagtaccggcttgcagatgatctctaccgatatgatgtggatacccagatgtggtgggtactttttcttgagctttcactttaaggtgtaaattctgtagaggcaattgtggagaaaatattgtgctatctttttgttttcatgcctggcagataattctgttcggcattatatatagagaaattgggaaataaacagagggtaataaagtagctagtatttattttgttacgttattctgtaattctgtagcaggttggttagaaaatacttagagttttttaacaaatgtaaagcaaatttgagttacgaaataatgtaattataaagcgatggtttctcctctttttcctcacatgtttgataccttgctatgggtactgttttatattctgtcataaaaataatcatttttagtagctgtgcaatactccattttgtgggtatgctgagactatgcaggtgaaagttttggtttctttctagtttttatgtcattaagaaaccattatgcattaagcttctgtcaatatttcacatgatttctgcccagaaactggaattatatagctacggggtatgaagagtttaaggttcttaatatattttgccaaaactcttacaggtctttaaaattatctgtatttattgttgaaaaacttacttttatgtagggaaaactctggaaggatttgtacatttgggtctgaggttaataaagtggttgtgcttgcattagcagatacataaatattctttaaaaactaaccttgtatttattatttctaaataaactcaaaaggaccattcttaaggacagccgatttttccgttacttgcacacagctgtgatagtgagtggaaccatgctggtgtttggaggaaacacacacaatgacacatctatgagccatggcgccaaatgcttctcttcagatttcatggcctatgacattggtaagtttcccaaaaccattttctcttcaggcatctttttgcctatactataagcagcatttaaaaggagactgaaaatattgccagttcaaaatgatcaggccatttgaaagaggtccaaatggtattttttatattcatttgactaatgttacacatctggtaaaaattatttctacattaaattctttttgaaatcactcctgttaattgcttgaatgctaatttttaaggctgagttgaggtgtctagtctctcctttgtcatgttatgcctacctggtagtgttacatagttgcaaccaccagcattgtgttaaaattggttcacgtattagctttatctcattccctagaaaactggtttctcacatggtcttggtgtggcaatataccagaccagaagagggcagtatttgttcatgcaaagcaaatgcataccggatgatctctttcataaaaattgtcagatgttcattttaaacaaattattatttttttgattgtggtaaaatacacataaaatttaccatcctaactatatttaaatgtctagtttagtgatattaaacacattcataatgttataaatccatcaccgccatccatcttcagaactgtcttcatcttgtaagactgaagctgtatacccattaaacaataatgtcccatttcttcctccccacaatgcctggcaaccactattctacagtctgtctctgtgattttgactattccaagtcagacattcgtttttaacagacatttgtgtgccagccactcagtttgtacattgaggagatcagatgaataacttaaagcccttagcctcaaagtagaagaggtagagaaatgagcagacaatagaattgcacttcagggtgtttctggctgaaaagaatgtatgagagcacctctgagtaccctttaagtcatggagggtggagtgataaacagggaacactttcttaaggaggggccatcctctctgggtccttggggacactaggtgtcaggtaggtgaagttaggcagcactctccaggcagaggaaacccactttgcagagacacagaggtggaaaagaccggcacatatttaagggctcaaagagtgagacactgagtgtgaggttggcatggtatagcagcaccagttggtattagatccagaagagaagttgctagtatgggtcacaacaagggaaaattaatcaatctatgggatctaggaaaggactttgtaaaaattaggtgacatttaaattttttgaaatttcattttccacctttatttttccattttagctactaaatttgagcaaatcaatatagaaaagagtggaaaataattatgaaacccatgttttgctgacataagctttgtagaatgtaaaatttgcttgctttaaaaaacattcttggctgggcgtggtggttcatgcctgtaatcccagcactttgggaggcccaggtgggcagatcacgaggtcaggagattgagactatcctggctaacacggtgaaaccccatctctactaaaaataaaaaaaattagccaggcatggtggcaggtgcctataggcccagctacttgggaggatgaggcaggagaatggcgtgaacctgggaggaggagcttgcagtgagctgagatcacaccactgcactccagcctgggtgacagagcgagactctgtctcaattctagtgcatcaaactgataggcagttgggtgagtgatccagatgtcatggatttcgggtgcgtttgctagttagaattgtggtatgatcccgcctttcttccatgccctgttgctctgctgctgcttcattttaacccagaaatgatgttgtaactgagaaaattgagaggcatgttttatgaggttctctttgttgtagtatttttcccaaagaaaatgtcaggtcctgttgattagaaatggtagtccgtttaaaaatatatttttctttctcctagcctgtgaccgctggtcagtgcttcccagacctgatctccaccatgatgtcaacagatttggccattcagcagtcttacacaacaggtaattggagaagtgattgctccttttcttttgtgtttaaaatgaaaataaagggccgggcacggtggctcacgcctgtaattctggcactttgggaggccgaggcgggtggaatacgaggtcaggagatcaagaccatcctggccaacatggtaaagccccatctctactaaaagtacaaaaattagctgggcttggtagtgcgtgcctgtaatcccccctagtttggaggctgaggcaggagaatcgcttgaacgagggatgctgaggcaggagaatcacttgaaccagggagttggaggttgccgtgagacgagatcgcgccacagcactccagcctggcaacagagcaagactctgtctcaaaaaaaaaaaaaaaaaaagagaaaagtaaagtggaattggactcaacatattattcacaagattccctcatcccagtagtttttttacaggattatgtgggtataaattttctgatttatgtttaaaatatttgatgtggaggtgaattactttgaatgccatgtttattgatctggttttgttagcacgcaagagcatgctttttggtgtggtctgagtgcctggggcaacaaaagttacgtgcatgtcattgtcttatgtcctttgttattgttagtggtatttaggttgtcaagttcctagtagttgtatctgaatagtaagaagtttggaaaagaggagagagggcacttcagatggggggataaggtaggagaacagaggtggagagattgtgaagtttaatatagctcaagtctgtaggctctggataatcagaagtctgcagttcattgcattttatcgctcaaaaatgcctggcccaaactaccagagctcttcaaaaaatcggcccttggagaagtctcagtcaaataagggagattcagagtggccactctacttgttccttacagtgtgctttaaagatttttaagaagttaaacagcctaatcacattattaatttttctcattcagtttctgctattactactgctgtctactttcccttttttaaaattctaagccatataaatcctaaggatgtttaagcgttataatgcctgcatcatgttagaattcctttggcttttgaaatttctgttgtaacgatggaagacagatgaggtaatttcacttagattaggaaagatgagaggccgggcacggtggctcacgcctgtaatcccagcactttgggaggccgaggagggccgatcacttgagcccaggagttccagaccaccctggtcaacatggcaaaacccccgtctcttcctaaaatacaaaacaattagccaggtgtggtggtaggcacctgtagtcccagctacttgggaggctgaggcaggagaatcacttgaacccaggaggcggaaattgcagtgagccaagattatgccactgcattccagcctgggcgacagcgagactccatctcaaaaaaaaaaaaaaaaaaaaaaggaaaagtgagaaggtgacatattttggagatgttgtgaaggaagagttgagacaatttaggaactagctactaggaaaaggtgctatcttttataaggtaattatttcgttttttagcaatgtgtatggttttactatgagaacatttgacagctagagactaaaatggaaggatttctggccaccttgctaatttgaaatgttattataaatcataatcttgaacttcctcagtacagaagacccttaaagctttctagcaagtgcctcttgagattttcatctgaaacgcagtgggaccattttgtcattatcatgcctgtgggagcctggcctcaactgtcttcgtttgtgttcctagttctcctagcacaggatttggcacataatagacatttgctaaatggcaggtattagtacagtcataactagcaaacaaatgaattttttataaaacattcttaggttttattcaaactcagagaagttgagactttaccataaaatataatttaaccatgagtcaaaattgggaatgccttgcctgagttgtaatgttttcattttatgtgattccagtggtatgtttgaaccctgatatgtaagtatctgtgtgtgtgagacaggattgggtaggtggcaggagaccctgagggaggccagctactaaaaggccatagttttggtttaattttatgaaataatttactgaaaaagaaacttcgattcacagcatttcttcatgctttaagtggatcaacagcattgggtgagctgtgccttccttggttttcattgaggttttgagggaggcaggaaggaggaggagagatggctgtgacataccaaggcggcaggagatggagctgtgcctctcagttgcctgctccatgtgtctctgagagactctccctaactttgcagagcccctgtgcaaccagatggattcacaattgctgagaacaccaactgtactgggaagaggaggttgcttatttggtttaagcaacaaattaactagttgaatctagcctgcttaatgtggtactgagtaagcctatagcaaggtaaaaaatgaaacctggccgggcgtagtggctcacgcttgtaatcccagcactttgggaggccgaggcgggtggatcacgaggtcaggagatcaagactatcctggctaacactgtgaaactccatctctactaaaagtacaaaaaaattagctgggcgtggtggcgggcgcatgtagtcccagcttctcgggaggctgaggcaggagaatgatgtgaaccccaggaggtggagcttgcagtgagctgagatcgcgccactgcactccagcctgggcaacagagcgagactgtgtcaaaaaaaaaaaaaagagaaagaaaccttatattaattttttagtttttgaaatctaccagtaaatatttcagattaggccaggcatggtggctcatgcctgttatcccagcactttgggaggctaaggcgggaggatcacttgagcccaggagtttgaggctgcagtgagctatgatgacgccactgcactccagcctgggtgacagagtgagaccctaactcaaaaaaatatatatttcagataacaatttgttttcatttttcacaactctataaagtaactataaacactgaattcttgaatattgaattattgctcctaggggaaatacagggttatgtttctataaacctctgatgacattttcatcaaccagtcagcatacataactttcttttatgtgtgtttctatttaaaaacatcttgtcgaatatatattcttgatttattaacattgagctcacagccaacagcactttaactcatgcctgaacaaagcttatgtaacacacgtattttctcagtaaggctcgtcacagccttcttacacttaggaacactagacagcacttcagcactgcatagggggccattttcagcagtgaaagcactaacataaggcacaaaaatgcataaaacatggcactagatacatcatggaagggacacttgtttgtagtatgatagttgaaacaagaagggagagcatctccttgtttgaccttagccggtaatatgcatgtgtgtcaactcaaattttttgccattctttgcacacacatgctggtaaatgaccatgaaactactgcaagtattgattttggaattagaaatagattttataagtacgtgaatttgcaaatatggaatctacaatctgcagatatggtcatgtgtcactgaatgatagggatacattctgagaagtgcatccttaggcaatttcatcattgtgccaacatcacagagtgtacttacataaacttaggctacacatctaggctatatggtatggcttgttgctcctagctacaagcctgtgcagcatgttactatactcaatactgtaggtcattgtaatgcaatgtaagtatttgtgtgtccaagcatatctaaacatagagaaggtacagtaaaaatgcaatataaaagataaaaaaatgtacacctgtacaggccacttactatgaagagagggagcatacaggactggaaattgttctggggaggtctgtgagtgagtagactgtacactactgtagactttgtgaactgtacacttaggctacactaaatttattttaaaattgttttcttcaataataaattaaccttagattactagatgacaaccattgtacatgccatccatcattgatggaaacatcgttacgcaggaccacatacatgactataatgaggattggctgtcttttaaagatgaagacttaatttttaaaacacaacccctatgcagttattacacttttattctttaagccaggggtggtggctcacgcctgtaatcccagcgctttgggaggccaaggcaggaggattgcttgagtccaggagttcaacaccagcctgggcaacacagcaagacctcatctctactagaaatacaaaaattagctggtcatggtggtgcgtgcctgttgtcccaactactcaggaggttgaggtgggaggattgcttgagcccaggaatttgaggttgcactgagctatgatggtgctgttgcactccagtctgggtaatggagcaagactctaactcaaaaaaaaaaaaaaagttgttctttaatatctctcagtgtccattcagtgtttacatctcctaattgtctcaatttttttttaagtttagtttgttcaactcagaatccaaataagatccatatgttacaattggttaaaatgtctctgaagtttctcttgatctgtagggaccccatccatcattttcccccttacttgttaaagagactgggttgtttgtcctgtagagtttcccgtagtccagattttgattattgtatcctgggctttcatataacatattggtctctctcctaaacttcctacaaattaacttgatcagattcacttcagtattttggcaagatcacttcataggtttatttctttccctttgtttaccaatcttcaaaataatgtagtgatttcttagcatagtccaaagatgacaaattaggttgtttttttttttcaggggatgggagatgtgtatcattatgaactcatggatttaaaaatatttcatgtgttttaatctattgtagtttgtgtttttattaaatttcaaacattttccatctttagccagtgagggcatctttacgttagcttttgagtttatctgatactaccctcgttttcttttcttcccagtataacaagatctgctagactcattgtgaacatttcttcatccagacatgaaattaggtttttctctaaaaagttctagtttttaaggggtgacaggagggagaaagaatggtttttaaatacgcacaatctaagcactagttgtattcattgctcctgggttggctgttgtttctaggttttttaagaaggcaggttaaagagaaactgtggtgttcttctttttaaaaaggaaaatgaattatttgtgcacgtttgtgtgtttgaccttctagttccctcaatagataaatggctacattgtttgaatacttttctctgcgttccattttttcccccacatagcagtatatactggtgctcactccatagaagtatgtagaaattttcctcattccttttacatctgcctaatatttcattatgtggatgtattatagtttgtcacatccccaattgatggacatttggggctgtttgagtcttttgctattattaacccatttatgcctagtgttccattattggaacgctaagcttgtgggagttatttatatcctgctgctcaaggtcatccccaaggtctgatttttcacaaaaaaatttgccctctggcataagtgggttaatgctgtagtgaatagcctcatgtacttctttttgtatttttgctattctatctttgtgctagacttctagaaatgtgatttcaggttcaaaaagtaaatgcaaagttttgttagagcttgccaaatccctctgtaggctgcatcattttacatgcccagcagtagtgtgtgagagtgccttttgccccatagtctcaccaatccatatattgtcaactttttgtgcttttttttttttttgctagtcttataggtgagaaatgctacctcagtatagttttaatttgcatttttcttacactgaaattagagcatcttctcatatgtttaaggtcatttgcatttttttctctgcaaactggctgaagccccgctctatgttagggatagtccttttcctataacataacttgtaaatctttttttcatagcatatcatttgtttttttactttgcttatagcattatttccatgtaaaacgtctttttaattcatatgaccagatttttcaatcttcttttcccctaccttctggattttaagtcagttttttttcactcttaggttatagagaaattcacccattcttctactgcttgtgtgttttgtttttctcagaagatgctctaatccatgtggaaattatcccagaatgtagagaaatagattcaattttatttttttccatatgtttagttatcttgataccatttactaaaaagaacatcttttcccactaatgtaagatgccacttttactgtgtactaaatgtacatgtgtgcttttatctgtttatgattgggctcatattcatgtaccagtatgacacaactttaattacagaggcttttacctgtgctttaaatttgtacatttttatttttaatatttaaaaaatgaagatatagaattgctgtttagcattaaaagatgtgagcatatcctgacactaaaattttccagtgactcatggttaaaagtcagcaggctatcatgagaactttttaatacagtagctatgacgaggaggcagattattggaactattctgggtgtgttataggccaggatgaaaggatggaacttggaaaggaagggaatcataatgttttttaagaccttgaaaaataatttcttagaagacttatgatatgtaagatttgtttgaagattgtctgtaaaaagtgtatcatggtagctggatgtggtggtgtgtgcctgtagtcccagctactcaggaggctgaggcgagaggatctcttgagcccaggagtttgagactagcctgggcaacagagtaagaccctgtctcttaaaaaaaaaaaaaaagtatagcatccaattgttatctgagtctctagtaaatttcttctctccctttttcctcttagcaccatgtatgtgttcggtggtttcaatagtctcctcctcagcgacatcctggtattcacctcggaacagtgtgatgcgcatcggagtgaagccgcttgtttagcagcaggacctggtattcggtgtgtgtggaacacagggtcgtctcagtgtatctcgtgggcgctggcaactgatgaacaagaagaaaagttaaaatcagaatgtttttccaaaagaagtatgtttttttttctctacttagattttaatgaatttgagacctcattttatctgaattgtgaaggaacttagcatatgtatactttttatgtttaccttatccaaaattattcagtaataacttgtacaaagtgtttttggatatttgaaaattggtttgtaaacatctcggatgggaacatgccatgtggctcctagaagctgtctgcgagtgatagagacataaccgttttggcattgcataggctttgcatactgaccccagattctggctgcagttgctctgaggcagtgccatccagtagaactttatttttgatgatggaaatgttgtgtgtctggactgtcccgatatggtagccactagccacatgggctatcagatacttgaaatgtagctagtgtgagtgaagaactgaatttttaatttaatttaattttaatttaaaagacatttgtggttactggctaccatattggatgcagatctgacattaaggattaagttaggagagtcagcccagaaaagccatgttgaagtaaatttttttggtggagggagggagagctgctgtccttgcaaagtatttttgtctagcgtctctagttggatacaacagtgatatcaagacagacagttactgaggatgggcgatgatccctgcttctagaacctcccccatgtttttcaagctgtttccttccttctgcctgctttgcttcttgtcctatattgctgtgacatagagcacaatgcggtacagtgaagcgatatattaaaaatttattttttgttttattttattttatttatttatttatttattttgagacagagtctctgtcgctcatgctggagtacagcagcgtgatctcagctcactacaacctccacctcccaggttcaagtgattcttatacagtcacctgccaccatgctcggctagtttttgtatttttagtagagatggggttttaccatgttggccaggctggtctggaactcctgacctcaagtgatctgcccgcctcagcctcgcaaagtgttggaattacaggcgtgagctactgtacatggccagaaagttctttaaaagtaagaatgttgtctctacatcaattaatttaaagtatgttggctgaatttcttactagtaggattggtgttgcagttaacttgagagttatgatggatagaagcagctttcattcctgggatgctgctccaagttaaacttttcacgaatataaattctcagtaagaacacccagggccagccacaggggctcatgccggtaatcccagcactttgggaggctgaggtatggggatcgcttgagcccaggagtctaagactagcctgggcaacatagtgagaccctgtctctaccaaaaacacaaaaattagccaggcatgggcatggtggtgcacgcctatagtcccagctactagggtggctgaggcaagagggcttgagcccaggacgttgaggctgcagtgaggcatgagtgtgccagtgcactccagcctgggtgacagaatgagattctgtctcaaaaacaaaaaaacaggccacccaggcaacccactcaggttcattggtgggctggtgggtgctggagaaccaagattaccagaacttagcagggttagcttgtctcttgaaagggataaaatcagtgaaatagttaatttttaaaccaaattttaaaagttcaaattaaatatgcatgtttataggaaatagtgttgaattaccttaggtgttcatatcaacccatttgctgtcatctcacctgagacttcagttccctgtttcaccccactttctgggtgggcccagtccttgggataatgaccaggacaggaagagcagcctaaggagccgactgctggggtctttgtgagagcggcacctgccttttcctgtttgtgaattcccccatgtgccatgtccatgagatggttgaacagatgagacaacatggttgtgcagcttctctctttttttttttttcagacagagtctcactctgtagcccaggctggagtgcagtggcgcaatttcagctcactgcaacctccgcctcccaggtcctgattcaagcagttctcctgcctcagcctcctgagtagctgggattacaggaacgcgccactatgcccagctaatttttctgggtttagtagagacggggtttcaccatgttgaccaggctggtcttgaattcctgaccttgtgatccgcccgcctcggcctcccgaagtgctgagattacaggcatgagccaccgcatccggccacgcagcttctcttttctagagttaacaggagatgcggcaggtctgtagtagcccagaaattctcagacttgcactcttgaatttacacgcatgtacaaaatgcagctcagcctaatgcctcctgttcagttctgtggtgctgcctacttcctgtgcccaaattagccttgcgtttataactaggaggaatgacttggtgtcctacaatattttggctcctgggcttctttggtgttcattctattactagttgattttttttttcttggaaagaaaagtattcaaagagccagaatttactttcattatatcttacagttgttaaattaacctatccttgttttcactttctgtgtacttctttctttggggtacaaaacagtgtttctttagattgtctatttctaaatattattttaaccagaacataccaaatatattttcctgccagtttcattcttcattttacttcttaaccattgttacgattttttttttaacttcggtctcagattttgctcaattgaagttgtcccagttcatgagattttgttttctttgcagctcttgaccatgacagatgtgaccagcacacagattgttacagctgcacagccaacaccaatgactgccactggtgcaatgaccattgtgtccccaggaaccacagctgctcagaaggccaggtcagaggctgtttcttaaagatttcagaaaaatcccaatttgtcataggtttagcttttatagtgtatatggtataaataatggcccagagttacttttcaaatgggtttctatttggattttattatccctgaggttttcctttaggaagagatgttctgtatatttcaagggtcctactagccctgggaatttgtgtattgtgttttagaagaaggtaggactgttgtccctgggcatggctgtgactaagcactggatccttggtttgaggcatctgatagtgacctcactttaccagtgccaggttttgataaagttagggtttgagagtgagtcaggtgtacagcggcccatattgaactgtggaaatgacagactttgcaaaatctccttgttttatatcttggtttggcataatctcactgctcatcatatatagatttttaaatttaagttataagatgacccaggcttttatagtttttgacagcttacaagacttttttttttgtcagtctcatacagttcataaaatagaaaactttcagacttttgaagtgagcatttgaaaagcaccaagttcaacattcccattttacagatgagcaggttgaggcatggtgtttaaaagagtgggctgcttccttgccagttaaaagcatgtccttgagcagaacattccattgcagtgttccccactgcagagctactgcaacttatctatctatctgtctgtctgtctgtctgtctgtctatctatctatctatctatctatctatctatctatctatctgtctatctatttatttgcagtttgcttcctcaattagattttgttgtctataatatcctgttggtcctcaccataagttctctctgtggatacaaaagaaaagcttttgtccactgtgttctagatctccatttttaggtatgagaattgccccaaggataaccccatgtactactgtaacaagaagaccagctgcaggagctgtgccctggaccagaactgccagtgggagccccggaatcaggagtgcattgccctgcccggtaggccttgcagggtcatcttggtgtgtgtgggtccattacttcagcctgcttcccccaacactgtgcagcctaagttgaacctagcagaggggaagagctaattctgtccattcatcccccacacgagtattatgggcttttttgtttttaactaaaatacagttcttaagtatttgttcctactgtcctttgaaataaagtgaaacatcctttgctgctctgtagaattgagtgacagcttggttctgtatcactgagcctgctccttgtctctttcccatccacctttgataacctgggactagaccatgatgtctcagcagtcagtctgctgagcactttatggagagtacttcttattaaccactgggatttaattgttggcacctgctaatgggccttctctgagaaggagaggatagatacttctgtcagcagcaccttttaggggtgatctccagccctgaaaacctcaatatatcctgcttctgaggttcaggatgatgaactcagggcctgagaccagccagccatgtgatatatttggaccagggtggtccagaaaggggaacttccttgtctgtgcacaacatctgagcttgttcagggaagttggtttggaccaggccctttttgaatgtcccttggaagtttttgattcagcttgcagagtgggactcttttctatatctcagtgtgtctcaaattttaaggtacaggaaaagacctgggaatcttgcgaaaggcatattctggtgcaagtgtggggtggggcctagagtgtgcattttatctagtcgactgctacactgtgaggagcaagtctttgtctgttcttaaatgatctctttcccatggtacctttcttttatctcagtgactgttactgttaatgaacattgttgatgtctccaaagtactttggttctggtgaagttgctttgttctttcattgtcttccaggaagcattcatagcttctgtgcagtaccttgtgtgggttcaggatgatcacaggtagcagattacaagcttgtcttgtatgctatagccatatcacttgggttgtttctcaagaaggaccttctcaccttgcttttgggatgctttgtacacttgattgtaccttccacctgatgatatgaaaacagtgcagcttttggagactatagatttgttaattccttgattcatttccattcttgcagtttttaccccagccctccaatatgcatattcatttgtctgctcttcacttaggattttagttttctaattgttcttcagaaggaagtgtaccagtctaatattggcaccaaactggtgttttcatctaagacataggataagtgacctcagaatatgctttttaggatccgggagatatcaccagtaaacattttaaaattcttgtattctgcatttggtccttaataatgtgtcagaggctcccacatcctaatgaagtacctagaatttaaattagaaaggccatttcggtattcagtaatttgaactcataatacagtagttttgtctgatttctaaaattcttttctttctcttttccccttaatgaaagaaaatatctgtggcattggctggcatttggttggaaactcatgtttgaaaattactactgccaaggagaattatgacaatgctaaattgttctgtaggaaccacaatgcccttttggcttctcttacaacccagaagaaggtagaatttgtccttaagcagctgcgaataatgcagtcatctcagagcatggtgagttaaaatcctcaaaacttaagtttctggttatccacctttctaccaagggcatgactgcagcttgcatgtggaaggctgtggatatgtgtgacgtgcttggcaagaaggggagtgctggtgaacgcagcctgagggactgtgggtttgtgctgtcagagtctcttcctcttaaaatttttaatactttgtatatataagatctatgaataattatatgggggatgaattgtaacatgtatatgtgtacataatctggtgacatcagtagattatttcatacctgttttacctctggattctgctaggggagaaagagaggtcactgataattagctaggttggattaagccacctgagttccttggagttaaggtattataatagtgcataagactgtataattaccactaagaagtgtacatctcagctggatgtggtggctcacacctgtaatcccagcactttgggaggctgaggtgggtggatcgcctgaggtcaggagttcaagaccagcttgaccaatatagtaaaaccccgtctctactaaaaatacaaaaattagccaggcatggtggtgtgcgcctgtaatcccagctactcaggaggccgaggcaggagaattgcttgaacccaggaggtggaggtggcagtgagctgagattgcgccaccgcactccaacctgggtgacagagcgatactccgtctcaaaacaaaaaaagaacagcaaaaaaaagaaatgtacatctccttgggtctttcatagcccagccatctcaaaagaagagagcaccttcttgtcaagagtttctaagcccagaaaggctcaagttctctgcttgtccacccagtgctctcagggggcttatagtcaatattccatgatcacattttgtcatttttagtctggagtcataaattgtgatcctaccgtcagttaagtagactcatagaacaaagctctttcagcagtttcagctgtggtacagaaacgtttagtggaaatgttcttaccaagcagggaggagttgagggcaacacttccttgggtacagcctccttcatgtgaaggtatggaaatgtggcctgggtctcggctgcctgtggcctctgtgtaccacctatagggccattctgagactggtaggaggtgccctgtatttagttttctccaattagtcccttttttcagtgcaacttagatggggtatggacactcaaacattggtgatatattcttagtgtgtttacctcaggctactgtgaccacatttggtatttcataatattttgatagctttttcagatttcagaatctccattggtgactgtctctgttgtttctctttccatgtccaaatgtgggtctcttccagcattccatccttggctggcagctgacctttcccatagttattcactccctcagaaaatggatggcacccagctttgcttattaccctggtgtctctaacaatgactctcaagtccacagaagttaaaagggttcaaccaggtggccacagatatacttctggtaccctttctctcttccttaggttttctaactctaaacgtttctgggtattctaatctgctgtggccacgtttatgaaacagaaattcacagtcttaatgataagactgacagatgagagacaactgaagtgtaatgtccttccacagctatacctctagatgtagcccagttagtagagcccagatttttatggaaaaacaagaaaggacacctagcctaacccttaggacagaggctggctggtagaaagctggaaggaggtgacccctgcaggtgagaaggagtgaattaggatgtcgaagacggaagggctttctgtgatttaattagtgcccccatctgtgagatgtagagggagatgattaagggagtggctctttgagtgagctgcaggtaagtttgcatggttggctgcaggctggatgggaggggatttttatagttgagcctcaggaaggaaccaaggccagaccctgcgaggccatggctacaatagtaatggatttgaattgtatcgtgaaggcaaagaaattattgaagggcctttaaaaagtatttttaattgtctttctttcttttggatctgtttatttttaggtcttttagtaggcatgtgtattttttcctctcaaaaatggaaataggctgggtgtggtggctcctgcctgtaatcccagcattttgggaggccagtgagggaggattgcttgagcccaggagttcaagactagcctgggcaacacagggagacctcgtctctacaaaggaagtttttttaaagaattagccgggcatgatggtggcacatacttgtagttccggctacttgggaggctgaggcaagagggttgcttgagcccaggggtttgaggctgtagtgagccatgatcatgtccctgcactccagcatgggcaacagagcgagaccctgtctcaaaagaaagcaaagggagggaaatacagtatatcttttgttttataactaccaaaattaggaatacttaccatttcttggctaaactttatattttgatttttaaaacttgttaaaaattgcaatgagaaggaaatttcaggagagcagaagacagactgtcccaggtgtcactgtcctattattccctataaaatccagtgccaggatggatgaatggataaagcaaatgtggtataagttgaatatcccttatctaaaatgctttggacgaggagtgtttcgaattttagaatatttgcattatactaaccagttaagcatccctaatctggaaatccaaaatgctctagtgaacattttccttcagcatccatcatgttggcactcaaaaagttttagattttggagtgttttggatttcagattagggatactcagcctgtgtttgggggtagccatctcttcatatagacatttcagaacttaaatattgctttgctataatttctgtgaatttttgatatattatcttctctgagctacatttttatcctttataaaatggccatattgaagtgatgatctatcctaatctaccatggctgagtcaagggataaagaggttttcctgtgtctgtggggtatacttaacttggtggtttttatctagaagcttgttttggtcaagatgttggttatattcaggccaggcatggtggctcatgcctataatctcaacattttgggaggccaaggtgggaggatcacttgagctcaggagtttgaaactagccagggcaacatggcaagactccatctccaaaatttaaattaaaaaaagatactatctgtattcatagttgtgtctcttttgcctttagtccaagctcaccttaaccccatgggtcggccttcggaagatcaatgtgtcctactggtgctgggaagatatgtccccatttacaaatagtttactacagtggatgccgtctgagcccagtgatgctggattctgtggaattttatcagaacccagtactcggggactgaaggctgcaacctgcatcaacccactcaatggtagtgtctgtgaaaggcctggtaagttcacaggtgaattaggtggtattcagagtttattgtgagagaaaccataggaggcatagttcattgctgagatgtgtgaagtagtcatgaaaacagatgaagtattgatttcaagcatgcaaagaagagtataacccagatttcagaagcagaaggaaatattctgggaccctgaatagttttaattataagcaaaactaaaaataactaacactactcgaagaaactgatattctaattaacaatgagattgataggtttattgaccagaaaaagtattgagaattgctctgaaaagcaaatttattggtgttggcagagaaatgctgtggaagaagaaacaaaaaaggaaaataaaaacaaagaaaagattagtaaagcaagcaagtgactgcagggacagtgttcagaaaggtagtgtcaacagggagaaaaatgatgagagcagttctgtaagcgaggacagaagcaacccagaactacgcgagagctgcaggagagtactgagcagacagacactcggagtagcttcccagctttcagtctctctgggctacattttggctaactaaaggcaggcccaggggtagctgctgcagcatgaagacaactcaaaataagcctcctcctcctgcagagggactcacaagcagtcggtggaattgtgggttattttgggaggctggactccatttgcattgtgtccaattttgggaaagtaatttgtctgaggaattacagaggtataggagagaattcatagcattgtagatttctaaatattgatttctaaacttctctaggggagctgcccagcagcctttcagaattctgaatcctttgttgaacttaatgaatgccgtagaccttcttccctccaaaattgcaaacatgagattttacatattcaagtggattgtaaaacccctaaagttcatcctgggtccccaaattctaaggggcttacagccctacttttatggaaagattcactgtttcctcatctttgtccttaatgctctttgaaaagaaaatttattttttccacaagtgtgtaaatacacttgactaaacagtacttgatgacttttattgttttctattttctctcatttaattgatttcatggcacattaatgggtcatcacccacatttgaaaagtcttggctgggcacagtggctcacgcctgtaatcccagcactttaggaggccaagacgggtggatcacaaggtcaagatatcaagaccatcctggctaacatagtgaaaccccatctctactaaaaatacaaaaaattagccagacatgatggcgcacccctgtagtcccagctacttgggaggctgaggcaggagaatcacttgaaccggggaggcggaggttgcagtgagccgaaattgtgccactgcactctagcctggagacagagtgagactccgtctcaaaaaaaaaaaagaaaagaaagaaagaaaagtctttgaccttagcggacatggtgggagctctaagtgtctctcttgggtttcattcccagcaaaccacagtgctaagcagtgccggacaccatgtgccttgaggacagcatgtggagattgcaccagcggcagctctgagtgcatgtggtgcagcaacatgaagcagtgtgtggactccaatgcctatgtggcctccttcccttttggccagtgtatggaatggtatacgatgagcacctgcccccgtaagtgaaaaagggagccctaggcacttatgcatgccctcagtataggcaacaactcagccatgaggctgtgctgtcagcctctgaacattttagaaacaagactggacatgacctctgctcaaacctgaccagagactgccatcgagaccttgctgcctattgagaaccttcatacagaatcaggcacattgacagtaaataaatgtaagatagatcacagagtacagaaataacttgtccaacttcagtgtcatattgctcaatccatgtaatatctccatatctgaatttcctaatttgtaaagtaaatgctttccaatagataatctctaaggtcccttttgccttcaacatcctggaattgagagaggagggaagggtcatctctgttatgtattgggcaaaatactgggctctttacattcattatctcttttaaataatcaagacagaataatatttttgactcaagccagttgaatagtctgttaaaaaaaaagtaaatacagtgaattcagatctacctgtgatagtcaattgcaactttttttttttaatagctgaaaattgttcaggctactgtacctgtagtcattgcttggagcaaccaggctgtggctggtgtactgatcccagcaatactggcaaagggaaatgcatagagggttcctataaaggaccagtgaagatgccttcgcaagcccctacaggaaatttctatccacagcccctgctcaattccagcatgtgtctagaggacagcagatacaactggtctttcattcactgtccaggtaagatgccttgcatatgcaaattcaagtgtttcactactgatttatgaagaataaaaccttgaaagctacgttgtgtatatgtaactccctgccctcagcccctttccttcctcctaatggttggtacaagaaggaatagaccagaagctggtccaaggcctgacctggacctgctgagagtggtggtgggttcctaagaaaccaattctaagaaattggcctttgattcagacttgaagtgaccactcagcaatgtgtctgtgggtttctagaacagttgggagaggctgggctggtgcaaagactcctcagagattagcagtcaagaacttctctaagagcctgccattgacaacagggctgtttgtgaggactttgtaagggaaagtccactgtaaacaaagctaaaagggcagagacagactgggagaaaatacctgcactgcatgtaacaactgatgatcatccagaatatgtaaactcccaccctccagggaaaaaataagaagctaaatgtgaacccaacagaaaaagtggttattggagataaagaagccattctcagaaaaggaaatagaacaggaaaatgtaaactaacaccaggaaccaattttttgtctactaaactggatcaaattttccgtgttcccttttttccatactaagatatgggggacctgcaattctatttttaatctactaggagttaactttttaacgaaatatttaaatctctgctttttcatgaatatcacgaatatatctggtaaaatgacaacccagagaatgggagaaaatatttgcaaagtatatatctaataagaatccaatgtccagaacacgtaactcttaaaactcaacaatagaaagacaacccaattaagaaatggataaaggatttaaatagacatatgtccagagaagaaatacaaatggccaataagcacatgaaaagatactcaatatcattcatcattaccaagaaatgcaagtcaaagccacaatgagataccactttacacccactgagatggctgtaatcaataaaacaggtaataacaagtattggaaggatatgtagaaattggaactctcatgcaggttggcaggtcctcaaaaagttaaatatagagttatcatacggcccagcagttttactcctaggtacatacccaagaaaattgaaaacgtatgttacccaaaaacttgtatataaatgcttatgcttatagcatcattcttcatagcatcatgctcaaagcaacattattcataataagcaaaagtgaaaacaagccaaatacctgttagctggcaaatggatgaacaaagtgttgtatattcatacagtgtaatgttatttggcaataaaaaggaatgaagtactgacatattttctgacatggattaccctaaaaaaacatgctatgtaaaagaagccaggtgcaaaagattatgcgttgcatgatgccatttatatgaaatgtccaaagacagaaagtagatgtttagtggtttcctagggctgggcatggaaatgaagaataataggcatgaggttttctagagtagctgcagcattattttctgacatggattaccctaaaaaaaatgctatgtgaaagaagccaggtacaaaagattatgcattgcatgatgccatttatatgaaatgtccaaaggcagaaagtagatgtttagtggtttcctagggctggggatggaaacaaggaataataggcatgaggttttctagagtagctgcagtattattttctgacatgaattaccctaaaaaaacatgctatgtaaaagaagccaggtacaaaagattatgcattgcatgatgccatttatatgaaatgtccaaaggcagaaagtagatgtttagtggtttcctagggctggggatggaaacaaggaataataggcatgagattttgtagagtagctgcaccattttatgctctcaccaacatcatatgaaggttcatatctttccacatccttgccaatacttgttactatctttttaatgaaaactgttctagtggatgagaaatggcatctcactgttgttttcatttgtattttcctgataactaatgaaattgaacatcaacttcattagttagccttttgtatatcttctttggagaaatatttagtcaaattctttgcccatttttcagttatgttgtcttttttattattgagttgtaagagttctttatgaattctgaagtcccttattggatatattatttgcaaatactttctcccattatatgggtttcttttcactttcttaatatgccttttgaaatcaaaagttttcagttttgattaagttccatgtatcaatgttttattttatcccatgtgctttttggtattgtatctagaaaatcagtgcccaagtaacccaggatcacatagatttgctcctaagttttctttgaaaagtttcatagatttgtgtgttacattaggtccttgatccattttgagttaatttttgtgtatggtgtgaggtaggggtccaaactctctttttgcctgtggatgtggtcctgcaccatttgttgaaaagattttttttttttttaaccattgaattttcatggcacatttgttgcagatcagttgactgtgaatctaggaacttttttctaagctctcatttttgtgcagttgaccaatgtttctccttttgccaatattacactgttttgattactgtggctttgtataagttttaaaattgggaaggctaagtcctccacctttgttcttattttgcaagactgttacagctattctgggtttcttgcatgttcatattaattttaggatgagcttgccattttctgcaacaacaaaaagccaactggtttgataaggtttgcattgaatctactgaccaatttggggtgtattgcctgtttgtttgtttgtttgtttgtttgtttgtttgttgagagagggtctcactctgtcacccaggctggagcgcagtggtgctatcttggctcactgcagcctccgctttcccaggctcaagtgattctccagcctcagcctctcgagtaactggtactacaggcatgagctaccaacacccagctaatttttatatttttttagagacagggtttcgccatgttgcccaggctggtcttgaactcctgagctcaaagcaatcctcctgcctctgcctccctaagttctgggattacaggtgtgagccaccacgcctggcccttgccatcttaacaaggttaaatcttctagcctatgaacctggaatgtctatttatttacctctttactttcttttggcattgttttatagttttcagtgtacatcattgtcttgttcctttttttaggggaaaataattcagtctttattaaatatgatatttgtttagttttttttatacatgccctttattgggttgagaaagtttccttctattctagttttttgagggttttgtaatgaatgagtgctagattttgtcaaacactttttctgtgtctacttagatgatcacgaagttttgttctttattaatactatgtattacattaattaagaatgttaaaccagttttgcattcctgggataaagcccatttagtcatgatgtatacttttttatcatgatgtatatttttaatctgctgttggattctatttgctagttggggattttgtgtgtacattcatgagggggatataagtttgtggttttcttcttttgtgattactatctggttttcatagcagggtagtactggcctcctagagtaagttggaacgtattcctcctcctctatttactggaagagttcgtcaaggattagcattaattcttctttagatgttgattgaattcaccagtgaaaccaaatgggcctggcctttttctttacaggaaaatttttaattattaattcaatctgtttgttatagatctattcagattttctttttctgagtgagtcagttttggtaatctgtttttctaggaatttgtctattctcagtaatcaaatttgttaacatacagttcgtagtattttcttttgttttttttttttttttttttttgagacagagtctcactctttcacccagtctggagtgcagtgacgtgatctctgcttactgcaacctccgcctccagggttcaagtgattctcctgcctcagccccccaagtagctgggactacaggcgcacgccaccactcctagctaattttttattttgttttgttttgctttttttagtagagacagggttttaccatgtagaccaggatggtctcgatctcctgacctcgtgatctgcctgccttggcctcccaaagtgctgggattacaggcgtgagccaccacgcccggccagttcatagtattttcttgcaggttgctctttagcaatatgtagtctcctgtttaacctgttaacgatttttttttctgtctaatttggttttattattcttttacattttgcaagggctctaaatattgtgagggtttttttttttaagagcttgctctcttatattgtggatgcaataatttaagccttattgaatgtactaaaattcgtatttttcattctctcatatttcttgcattaacccttccttcaggatttgttgctgtgcgtgtttatcctggtggtattcggagattgagagttttcttatactggttaatcctcaaggttaatttgtattaataactaaatgtgtagatctgtcaatattggtcagtggttgggtgtgctgagctgttgtgaaagtgtggtatgatgtcctggaaaagctagcaagccagcctcaggacactccagctctggtccacttcgactgttgttgactggtgtgcgcatctccctcattggaagaaggaaggagcaatggacctgggtggctgggtgcaattagcatgttcatgggtgtggcaagtgcctcccagccttgggtggtagggccacctaaagatagctggcacattgccttgagttttctttcattcttgcttgcttgcttgcttttatttttgagatggagtttcactcttgttgcccaggctggagtgcaatggtgctttcttggctcactgcaacctctgcctcccgggttcaagcggttctcctgcctcagcctcccaagtagctgggattacaggcacctgccaccacctctggctaattttttgtatttttagtagagacagggtttcactgtgttggccaggctgatctcgaactcctgacctcaggtgatccacctaccttggcctcccaaagtgatgggattacaggcatgagccaccacacccagctgagttttctttcaaacactcaaatactaacaggtgcataaacagaacaagtacaaggctatggaaggttgccaagatggtgaaaaactgcatcacactgatcaaccaaggcagatctgaagaatcagattttgcttacagtgcaggttgtgcactatgtaaatgtttcccccatcctattcccccctagagttctgcagtgcacagcctgtgcagctgtcctgagcagtcctcagaggtccaagcttcatatacctttctagttgtaaagccctatatccattaggagtcttagtaatcccacttgtggaaatgtttatccgtaaagatggttatttttctaataatgaaaaatgtaaagcaaactaaatattagaatataagggaatggttaaataactgttaagattcatcaaaatcattctaccatttgaagttttgtttataattgatgaaataaggtggtaaaatagttgtgatctaagttaagaaaggtgaatattaatatgaacataattgtgcaaattatgttcttctggtatagaaaaataccagaagaaaatatatcaaatgtgaacagtggtctctgagtggttggattgtatatgatctttccccatccttctattttttaaatatactgtcatgagcatacgttattttttagtgaataacaacaaaaaatattttttaatatcactatgggctttcaccttgctgtgatacattttcaattttcctggactagctcttctttgatattttttatcttatttctcaaattagtttttagtgggccagttttggtgatttatcaaagataaattaactacagagatagttgcagataaatcttattgaacttaactacatgcagttcttccatggtacagaccccttgaaactctttttcttgcagcttgccaatgcaacggccacagtaaatgcatcaatcagagcatctgtgagaagtgtgagaacctgaccacaggcaagcactgcgagacctgcatatctggcttctacggtgatcccaccaatggagggaaatgtcagcgtaagtcaaattggtcaggtttactcatggcaaatcggtgtggaacacagcacttctatttgacttgaatatctaggaggaaaaaagccactttgttttggataccacatttcttattaaatcatactggtcagaagctcagctgagctggaagaaagaaccaaggtttcagtgtagctggttaaagcaacaagccaaaaatgttagagtcaagcctttgaccacattctgcagtggtataagcaagggcccaaaaccagagaaagtgccaacttcccctgtttcctttcctcccattgaacagggcacaggtcaatagtcagagggatcagctcagacatgggagtcttggggctcatctcactgaggcccggacaaaaggttccagcagtatatggacactaaggttgtgggaagggcaaggtgtaagggctaggactgggaaagtcctgggttggagtcagagttaggaaagtgtcttctgaattccccctcctccccccatcaggaggccttggtgcctgaagaagacctcagcccaaggcctcagatagggagcctgggaataaaggctccagggctaggaatgtgaacatgtgaaggagcgtgacccgtgaggtagacctgagtccttaactgcacctctctcagagccccacacttaggcccacctcacaggtcatgctctgccaggtaaagcctgtggcattgcctgtggtcaggcctgaaaaatcacacacgggctttttaaccaggagccagactcctcaatacttatagtgtattttaaaggtttaaatagtcccgtgttggctgggtgtagtggctcacgcctgtaatcccagcactttgggaggccaaggcaggtggatcacttgaggttaggagtttgagaccagcctgaccaacatggtgaaaccccatctctactaaaaatagaaaaattagctgggcatggtggcgggggcctgtaatccaagccactcaggaggctgaggcatgagaattgcttgaacctgggaggcggaggttgcagtgagctaagatcacgccactgcactccagcctgggcaacagagtgagactcagtctcaaaaaaaaaaaaaaagaaaaaaaaaaaagtcctgtgtttccccatttatgtcaaatagaagcctgcaagcaataggacattttattatgagaacaaaaattatgacaagtgatattaatgaactgctttttttattctagtttccagccaaaaaacataatgagtactatagtcgaaagacttttcaaagttctgagcaggaaaagtaaacaacatagggaaatctctacctactccccagatcccaactccaaactctttggcatggcccttcagaatctgatctgatccaagaccagccaggagagaggcagcgttctagctgtgtgtcccttactctccctggggttcagtttcctcctaataatagggtggttgttaagatgaaagcagagcagcacatgacacatgttccacaggatactagtcaatactcagtagatgtgggcaattcttattacccttctaatgccattctccactactcctaagtaaaagttcttgctcagattaaaaggtatttggtgaaaatgttttccccactctttgtgaatagacttaatccgttagacagtaaccagagtacctaacagagtggtggagtgtacaaggcattgtgctgttacccactcaagacacaggtgcttttattatccccaagatcaagtaaactgcccagggtctcacagtgagatgtggccaagctaagaaccacgcccagtctgtgctgaccttaattacttggctggttgtgcttccagatgccatcatacccacatcagcagctgctatctagaagcatcacattttcctctgtgagatctacagggcctgagtacaatttgccttatttttcagagtcctaatccacggtagaaagcgtggtgtttatagaatactgcagatggcaccaagtctttgatgttttcttcttaaaattgtatagtccttaggtaacgatagtagccatgatttcttgaatgcttactgtgtttgagacatcatatacatatcatcacaaacacccctatgagataggtactgttgttatccccatcatatggacaaggaagctgaaactcagaaaggttaagtagcattcccagagtgacagaagagccaagtagaggacgctgaattcaaacccaggcagatggacgtaaggcctttgcttttcactatacattacacaccttcccccagtctcaacagagccaagtgtcagacactcatgattctgacttcagcatccattctgttaatctctgcactattctgttttatagttttctttgggtgattccaaaggatttatttttaaagcatacctctctccagctgaatgcctttcatttattcaccagcaaaacagggtataaagtgaaaaggtgttgaccaaaaaggctttcacttttttcaactggagtataatatttatcacggcttgtattacgttggatgataaaaggagagatgttgagttggccagatgagggagatgggaagagctattttctgtaaaggcaaaggaaaaggtgaagcaagggtggcatgtcctgagggcccctaaagcgctgaccttggcattggatcctggttctgagccctgcggtgattccaaatgtgaccatcgtggagaaggcacctcagccaagaccagccctccttcagaggacagtcacctccagagcacctccctaggggcagcagctatgtctgtgtccccacacccagcacctggcattctagagatgcttcacaaatatttattgaatgaatcaaagaatcatagcagtgaaaaagagagtctattgaaaagatcaaaatagtcattgcttcagaaggtagtgggtaccagcattcactttcctcctgtcctttgtttggttcctttaatgttacctatacattattatcattagctgaaaaatcatgaatcttacccattgaatgctcgtactttaatctgtctttcctactgaactcaattcagataaaattgcttgttttggaaaaagtctccaatagtcagaattttttaagccagttgtgacctctgttcctttttcttctctgcagcatgcaagtgcaatgggcacgcgtctctgtgcaacaccaacacgggcaagtgcttctgcaccaccaagggcgtcaagggggacgagtgccagctgtgagtaccatactccctggaccaccagcgaggaccaagaggctgtgcagctgcctgaaccccaccctgagagccacccacttccctgtgtcttgttgctgtgggctctgagggatccctgggttgattagtttgaaattttgcccattctatttcagacaggtcagtccccaaaatgaggaggtcgtcgagttagcagcaattccttaatggctcttgaattcacatttttgtttaaatgatactgacatttcctgggttgtccatttggagtagtcattttaacttcagcaactacttgatttttgtcatgtcaagagattatactctttcccaaagagtagagatggaagagctggtgttttggtgatggcatttatttggcgtttggttgtctgattgtggaaatgatcctcttacctttaacatttcccattactctagcattttccttgttgaagcatgtcaggcatcttcctggagagggtttgaagtccccatccatgaggatgcaggtgcagcagcatcaggcatgtttaaggtttcagacctggccctgcctccactgagcaaggtgctcttgaggcaaatcactgttccccccatctgtcagtagtgggactagcagtaattgtttttggtgtcctggtaggttgaaacaggaaggatagttcctcaatcaatgtataccgggctgtctcactgggaaacctcataaaatgcatgtatccacatttactcattctcaagaaaaaacttaaaaagtgtttagtgtcaaaacactgagctgattaatcattgtaaacatcattatttcttaaataacagtagtaataatgccaccagtgattgagacatcattgctggtgctactcagcagggtttggtctgtctactttttagtttatatctgcatatatgtttactagcttcatgttgccctaaagccaatatgtgaagaaaagtctaatccaaggttaaatttaacttttaggtccacattcccttaaacagaaaaatgtcatcgagcaaaattaatcactcttaccctcagttagctgatgcaacaaagacatgaggtggcatcaagtaagactttcaagttccttcgagatcgcagatgtaggcaggtgctgctcatcaccctggctaaagcgacacagcatacctgcctgggaaaggccattacccacttcccgccctttcctcttcatgcatagctgttgtgtttacctaaatgcttcatgaagtgggaggctgggttttgctgatgtttatagatgatctgtatggggaaattgttttctgagtagaacatattttttttctacagactggtgaacacttgttccagggtttaaaaaaacagtgattcttggtatttagtcttctctcacttgtgtttaaagaagagaattagtttatccagggaacataggaaagaagtgagaaattagtatttgaaaaatgttttgactgcacttttagaagaatatgtagtccacacaaaattgaaaatgtttttcattatagtaaataggtttattacatttggatttctctcattgctttggcaaatgcttgtcaattgtcctcatatagttggtgtgtgaactgctgagcagtcagtattgaagcgttcatgcatgctcttcctagactgcctgagctgagttatggtgaaggatgcaattataatggctccagactatctgtactttatataaaaggatctgtttggttttaaaatgaattcagtttctgttttaaatagcagtataaaatagtcttttttcccccccagatgtgaggtagaaaatcgataccaaggaaaccctctcagaggaacatgttattgtaagtggttttgcaattcttatttctagaagcaaagtagttcagtaaaacttcattgtttaaacgggtttgagaatagtaagtgctataagactatagcagccaccaatgaagtgttcccagacttgatatgtttacattctgttaagtttactacatataggagcactgttttaagctgttttaattgtgtttggggttaacgttaatgtgtccatagcagatagcaggagagagtagagaggcatgcatctttgtctatccacatttatgttctcttaaaactttatttgccattacctagttggggtcatcatatttcgtgttttaggatgtagatcaaaaacagaattcttacaatatggttgaactttttgtcattctgtctggaactgatttgtgttaaccaccttgaggtgaaaggtgagtctgacaaggtgaccatgtttttatgggtaaatgtgttttctctttatgggagaatccacatggtagaccagagtacgggaccagaaaaaaggagttaatgttatggcatatccattgtaattatatacctgctgtactgggttgaataacatcccttcaaaattcatgtccacttggaacctgtgaatatgacttcatatatatatatatatataaacttctaaaagaaaacaagagaaaaacatcttgaccttgggtggggaaaagttgttagataggattctaaaagcataattcataaataaaaagtagactaatgaaactatataaaaatttaaaacttgtaggaaaaaaccatccaaaacataaaaagccacagactagagaaaatactcgcacatcatcatatatttgataaggagtttatatccagaatacatgaggaactcttacaactgaataagatgacaattccagttaaaaacaggcaaagatttgaaaagacatttcatgaaagaagatattacagtggccaataagcacattaaaaacgacttaacatcattcgttatttggaatggagattttaaaaccacagtcagatacagccctaaagtgattagaatccaacgctaatgccatggctttttagaagacagtggtaatctcatgtctgcttctgcattcagtctgttgcagtacatctttttggttaaacacatgaaaaaaacctggccttaccaggcatgcagttggaaaagggtatagtgatacccttttaatagccttttcagataattatggacgttacttgatattatgctgaaactggacaactggtcatttctttaaagcggtttgatgggttaacccaaataaaatgatactgcccacagacttgattttctttgaggaacctgggtacagctgagttaaagtgctttcctcgttacttaatttataagaaaagcagcctgtatctctaaagacctgttctattttgtgtgtgtttagtttttaaatatgcatttctttctttccatagatactcttcttattgactatcagttcacctttagtctatcccaggaagatgatcgctattacacagctatcaattttgtggctactcctgacgaagtaagattttttaaagtcttcctattttgttttgaatttgtatggatctttttcttggtcattacggatggacgtactgccttaacagtgctctccagactggagtacacgagatgatctctagaggtataggaaagaaatgttagactctacgttatctcctttccacataaaaggcaaaagtgatgttaataagatttaccaggatcttagacacagactgacattgattccacgcatacttactctgcctgtcagcccatcatggcctcatacagaaaggggactccaccatcagagggcagatagcagagcctgggtttactctctcaagagtgaccagaggcttaaagacactgctgattgaaatgccagtgatgcagccccaatcagacagcaagggaggggaccccaatcagacagcaagggaggggaccccaatcagacagcaagggaggggacactctgctcctagagtgagttcttagcctcattaggaggcaaaacagcaaaggcttagtcgggtccattaagaagttagccaggaataatttaaattgttaaaatatgtatgtaaaatgtggatttttttatctgctgtcattaacgatgaagcccaacctgccttaaggtattacctagtggtagaaggaaggccacactgcgggacatttaaaactgaaacatacagaacacgaagatgcacctgtacagtttcttcaatgaaatataaagtcatgcagtacccacttcagtatttaaagaaattttgctaaacataatggtaaattatttaggaacttccttggagatttcttacttctcatgaacatacacaaagccatttaccattacaaaattccattaacaataaatgtgacaaataatacatggaaaacaatatggcagtaagacaaagtatattgctttgttaacaaatgttatctataaacattgctaaatttaattttaaaagtagaacaaagtctatagtgtggtatgtttactatacaagtaaatgaaaataggatttgtttttaatattctatttcaaagataaaattaagaaaaaatgtactagaaaagatacattctcaaaagtaaattgctttttaagtaaaaataataaattactttaaatgaattattttatggaaaaactataggtattaatatatcatttgagtggctgtattgactggaatttttttcttaacgattttagaataagattttaacaaaagtaccatatatgaaatgtattcactgcctcataagcaagcgtttgaagtgctcaaaatctttcaggatatacttcatgccattaatgtcattaaaaaaataaatatagtagaatctttgtaatacttcttaaccaggtgggaagcaaccatgaaagtatttggacctttctggatttcccagtttatcttacgacagaatacttactagagttatccaaatgcatatgttctgtcctctataaaagcacaagcattttaagtttattgattctttctgtggaaagacatatagttgacccttgagcaatacaggttaaaactgtgaggatccacttacacgtagacttttttcaaccaagcgtggaatgaaaatacagtatttgcaagatgtgaaacctgagtatacagagggtggacttttcatatgcaagggttctatgggcagactgcggactggagtatgtgtggatttgggcatgctcagggggtcctggaaccgatgacccacgtataccaaaggatgactgtaattgttagttgtgtgctgccagcaaatactaaatacaaataagtaaacacttgagctgtcctttcaagatgaaggtgaggtcttatcagtaaatgagaaggtaaatgctttgtgagagaaacttctggtttaatgatcacattttaaaaatagctgtttggaaatgtttccattgttgtgattttgtgctattaaaatgatcaaaacaacacccttaaaaatcttattctaacctctcaagatcttttaaaaatgaataatttcagtacagtcggatgcatctgtaaaagataaaaatataacattgattagtttgcaaaaataattgtttgaccccagttaagagatgtactagtcaaatttcagtttgactaattattaatgttataatttacctaacatcaccaacagtacacttcctccactggcttaacagattcctcagcaatatctttattagtcattaagaccaaggatcaaaataaattaagttagattagccctgtgaactgctatatctctaagtggtagacaaggttttcaaaactaagaagccatactcaatcatatttctcttgaaataatatttttagtaagagaaaaatatttttcaaatcatgaatataataaaattattttttaaattaagtacatttcagctctatatgccttttttaaaggctgtttccagttttggagaagttttacactgtatataatctatgagtttagaattatatgggtttcagttataaataaatataattttgggcacttgatcaagtgttttattggtaggagtgaacttcagacatttgaaaacagctgcccagagaatccttaggagggtgattccccagcacaggtcaggagatgcaaatcactgtgctctgataggggtctttttaaaaggcactttctcatgcagttaggcatttgataaagcattaaattatgtatactttaatgggagggaataaaattttattggcatatattgcttgtattaaggaaaattggttagaaattttgctaactcttctgtgagtttctctaaagacatcataaaatgtttgtgattaagaacatttagaggagtaaactttattgctttattttaaaatctagaaattgttttaattaattttctaataatttgtaccgctcatcagcaaaacagggatttggacatgttcatcaatgcctccaagaatttcaacctcaacatcacctgggctgccagtttctcaggtaaagacatacctagagaagaccccgcaaatgaaggtgtggtagattaagaaatgtaatataggaattgagaaagcgagctcaggagacagattggtttgaaacccacccttgccacttactagctatgagaccttgagcaagtatctaaatccctctctaaaccttagcattattttattcatctgtaaagtgaggataatgatacttacctcttagaattgttgtatagattaaattaggttatacctaccagagcttgctgtggtgtcaggctcagtgtgtggttactaccctagcccaccaccaccatttctgttcttgctgtggccactggcactaccatcattgtctacattcgtgcttcggaagtgaaaaattcaaatgattcgtttcaataaatgaaaacattttaaataaaatgagattttagtaggtacagagaaatgtaacttgggaattacatcaagctctaaaagcacagctcttgctgtctgccttactgtgattcactgaagatctactgtatagaaaatctaaagaaataaaggatgaaggccaagtgctgtggctcatgcctttaatctcaacactttgggagactgaggcaggaggattgcttgagctcaggagtttaagaccagcctgggcaacatagtgagaccctgtctacaaaaaaaaaaaaaaaaaaacccaggtgtagtgactcatacctgtaatgccaactactcaggaggctgagatgagaggatcacttgagcccaggggttggagattgcactgagccatgatcgcaccattgtactccagtgtgggcaaacagagcaagatcccatctctttaaaaaaaaaaaaaaaaaaagaaaaaaggataatcactacttaacttgataactcaacaagtagatatgggtttgaaatttgtccattaaatttacttgcaccgtgctgttaggcaagttacttaaggtttctgagccagtttcctcctgtataaagtaggatagtaaaaacaccgtcctggcagggcgtgatagctcatgcctgtaatcccagcactgtgggaagccaaggtgggaagatcacctgaggtcaagagttttgagaccagcctggccaacatggtgaaaccctgtctctactaaaaatacaaaaatcagccaggcgtggaggcacgtgcctgtaatcccagctactcaggaggctgaggtaggagaatcgcttgaaccttgaaggtagaggttgctgtgagccgagatcacgccactgcactccagcttgggtgacagagtgaaactccatctcaaaaaaaaaaaataaaaaaacaccttcccaagtagagtgatgtgagaattaaatgagataataaatgaagtactcaatatagtgcttgaaatgtggtaaatggtaactatattttatcattattactattacaatactgggttttttaaaatcaaaaacacaaagcaatgagattgatgcaaaataagaatattgccttgtgcacgccacttacgtttatcatcttaaaacattgtgtagaatttgagaaaagttcagaaactctcaatgaggagggacttttaagaaaaagtctgaattatcagagtatttggagaaaggcaacatctccaggcatgtgaaagatttgcaatgagccgggcggtggctcatgcctgtaatcctagcactttgggaggctggggcaggtggattacctgaggtcaggagttcaagaccagcctgaccaacatggtgaaatcccgtccctactaaaaatacaaaactagctgggtgtggtggggcgtgcctgtaatcccagctacttgggaggctgaggcaggagaattgcttgaacctgggaggcggaggttgcagtgacccaagattgcatcattgcactccagcctgggcaacaaaagcgaaattccatctcaaaaaaaaaaaaaaaaaaaaaaaaaaaaaaaagatttgccatgagtgtctcaatgaagacgtgataatgtgggctctagtcacagggtctaactcagacatggaaaaaagtccatttcattaatctttatcggcacttgaattcctggctaagggagaatgtggaacattgaaggactctctgggaataggatggagttataccagattagggggacttaaatactgtggtagctggtggtagaagggaggactgagtgaccccttgaacccctcctccctgctacagtgggttaggcagtgagcggtacatcagcattactggcatgggagtctggcgcattgccaaggaggtgtaaaggggaaatgcaaaggaattgaagtggtgtgggcaaagtgaatgccagtgcttgttaataggattctagtggtatctgtattttcatgatcatgtgtgtcacctgtttgggggtggggcaagggtggaagggagttacatggattcctggtaaaaccatttttctttctttctttttttttttttgagacggaatttcgctcttattgcctaggctggagtgcaatggcgcaatcttggctcactgcaacctctgcctcccaggttcaagcgattctcctgcctcagcctgctgagtagctgggattacaggcatgcgccaccacgcctggctaattttgtatttttagtagagacggggtttctccatgtttgtcaggctggtctcaaactccgacctcaggtgatccacccgcctcggtctcccaaagtgctgggattacagatgtgagccaccgcacccggccagtaaaaccattttggttaggggcataggcttgtatatcagcctgcccagctttaaatcttatctccatttcttgttggctgtgtgacttgagggaagttacttaatttctgtgaacctcaatttcccagtctataaatgaagataataatagggcagctgtgaggattaaatgagattgagctcttaaaggctattactggaacacaggaaatgtttgataaatgctattgtccttattattaatgaggccagattctgttctccccctagccccccaaaaaatgtctcttctctttcatgtttttcttttaacagctggaacccaggctggagaagagatgcctgttgtttcaaaaaccaacattaaggagtacaaagatagtttctctaatgagaagtttgattttcgcaaccacccaaatatcactttctttgtttatgtcagtaatttcacctggcccatcaaaattcaggtaagaagaggcttttggtctcatacctgcaaaggtggtgaaatctctttagtaagactaaatttactaatttggagcttgtggtaaatgagatgtgcaatgtggctttgcctttgtaacgtgtatggcagaggagtgctgagcacatgcatgctgcacagaagattggagtggggatggactgtatcactcatgaaagacatttgcaaaagcactgttgaaagcaagttggcatgtaacagatttggtcattataaacgtattcacttcttcagtgagcatttgccatgtgaaagcctgtagggctacacaaagaacttcaattctagagtaaggtggatgtaagtgaaacaaacccacatataacaactgaaagccagagtgtggaaagtgacatgagatgatcccagaaatgctatcaaagtttaaaggaggacaaatggggagactatgttgaagaacatcagccttctagtcagacagaggtggattgattcctggctcctatacaaatcatacagcctttccaagtctccagttctctgtgcatgtgacctgaagggtagttgtaaggggctgtgcagctgctgcagtgtcttgttagcctgctcctttcctctgttcccagggggccagtgtactccctcttgtccgagacccatggccccattttaactttttatactcatgtcacctggggcctttcctcaataccttctgcttcttaccttcttcatttaggtgaatgtggaggttagggataggtgggctttcaaggactggttcacctttaaccatggaagcatggtcactggacggaggctgttgctgtttgccaatgttcagaagcataatcaacctcagaagcaagtcaccacaaacatatgaaaaaagttcaacatcactgatcattagagaaatgcaaatcagaaccacagtgagataccatctcacaccagtcagaatgtctgttattaaaaagtcaaaaaagaacagatgctggcaaggctgtggagaaacaggaacgcttttacactgttggtgggagtgtaaattagttcaaccattgtggaagacagtctggcaattcctcaaagacctagaggcagaaataccatttgacccagccatcccattactgggtgtatatccaaaagaatataaatcattctgtaacaaagatacatgcacatgtatgttcattgcagcactattcacagtagcaaagacatagaatcaacctaaatgcccatcagtgatagactggataaagaaaatgtggtacatatacaccatggaatactatgcagccataaaaaggaatgagatcatgtcctttgcagggacatggatggagctggaggccattatcctcagcaaactaatgcaggaacggaaaaccaggtaccacatgttctcactcgtaagtgggagccgagaacacatggacacatggtggggaacaacacacactggggcctattggagagtgatggggaggaaggagagcatcaggaagaatagctagtggatgctgggcttaatacctaggtgatgagatgatgtgtgtagcaaaccactgtggcacacgtttacctatgtaacaaacctatacatcctgcacatgtacccctgaacttaaaaattaacaataacaaaaaaagcaagttatcactcatcaattaggatgccttgggactgtgactaaagaacagttgatctttccattctggaaatatggaggacaaaaactatgttgtagtttttctcaccaccctctctcctttttcctgtctccatggtctaagatttgttaatcctctcatcagcttctccctttgccctcgcatactccctgtgtccctcctcagccagtcttgtaagcatcagccacgcttcttattcctgttttctcttgtctagtcacacatctgctcacaatggtctggcctcttccctcaccacatcctgaaactgtcctgtcatagtgggccccagtg

SEQ ID NO: 16370 - DNA, 13814 bp, Human
gtatctcattgtggttttgatttgcatttctctgatggccagtgatgatgagcattttttcatgtgttttttgactgtgggatttcaagggattcaatagtataatgcctgccctgccacatacaccctgtgcagatgtatattggctgggtggggggtgggggggatacctgttgtgtttattttgaaaatgcaaatctcggggcagttttttttctggtttttgggctgggtggctttacaaggacacttcccccttccctcctggcactaagggcagtcacatcctcactggaagtagtggctggaggtccagggcataacccctgacccagggaggatgaaccggaaattcagtcttgcagagccctctgcacagcacaggagctgggcaaaatttggagaaaaggaaaggtcacgttcccaccttggccacccctctcaggtggggctggggtcttcccctacccttcagatgcattggcccacccagccccccatcaccaggccctcccttttgccacccccatccaatgcaccttgggtctgggtggctgggactgcacgagaaggggtactcctgccttgctgagctgcagcccgccccccgcaccaccacccgcccagccagaggccacttctaacctggggagacaggatgcgaaagctgctcactacccaccggcttttgggtgcagccttcaggcctcttgttccaggaggcctggaaaacgagcggggctggaaggcatttagataattggaagatgggccgggcacagtggctcgtgcgtgtaatcccagcactttgggaggcctaggtgggtggatcacgaggtcaggagttcgagaccagcctggccaatatggtgaaacccccgtctctactaaaaatacaaacattagctgggcgtggtggcgcgctcctgtagtctcagctactcgggaggctgaggcagaagaatcgctggaacccgggtggcggaggttgtagtgagcagagatggccactgcactccagccgggttgacagagggagactccatcccaaaaaaaacaaaacaaaacaaaaagaaagataattggaagctgctccgcttaaaacgaatgacaaattcagcctccctggtctggtcatcaaagaaacaccaattaaataatatggtgccattggcaccaagttagccaaatcatcaatgggcgtgatacttaattcgcttctctggttgctgacaccctcctcgacccccagccgcggaaatccattcctagttccaccgtttagagcctctcctggggctgccgcgaaaattgggccggttggggtaacatctaacctggggtcccgcgaaagagcccatcagttccgcttgggggccccactgccctcccacctcctacgctgggcgctcctcctgcgaatgacgttttgctgctgctcagggcagccagtcgcggaggcggggaggctgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttcccaggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcaggtaggacaccccaaggaggctgcatatgggggtgagaggctaggtctggagtcctgggcctcctggagaactgggcatggtagtcgaatccaggaggtggagtccggggaggcatcctgagcagtggagaggtacgcccttgttccctcctaggggcccaggacatgggaagtgagacctgggctgtgccccccacacctccaggtgacctgctctcagtctgcacaagcctctccaaatcttctttcccctcactccctcctccctcattgtgcctccaccacgctgcctccgtaatctctgcccggatagccaccattttgccccaggatgggaatctcaagcctggagagggaacttaagggtggcagagccgtggagcactcacacatccatgcccctgctccctccaccccagttctgcccccagaattaagacaattaattaaacactgatcctgctccctaagtctgcaaggggagagctgggttgttccagtaggagaacctggtcttggtccatccttcaggaagggtcctggaaaggtgggggtctgacagtttaggggaaggctctctggggcggctctgctagaccaccaacccttaggctggcctccagccaggcagccttgctcacaccctgggctcaccttgccctgctcctgagaggacctttcctaaaccagtcaacgaagagaagacgctttagggcctctgtagaatgaaccttccttgacctgagaagagggggccctcagggccattgctttcccggtgtagtgtttcgctcagttcttttctcagcaagggagtgggaacgtgggctagccaggccttgagccccacgtttacctttctcctttcccgggtccctgttcccttcccagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtgaggcccaggggagcctggggagatctgcctgtgtcaggagagtttgtgggggctgcctgggcctcccaatttccctgccgatcaaactaacatcctccccacaacctggtgggcccaggagcctctcccccaccctccacagaaatgggaggaagacacacctcttgtggggctcaccacacccaacgcggactggctgagtggatgagagggtggggccctctacggagatgagatcttacctatgtaaaaccacgctccagagttcctaaaccacaaccctacctgggaagcacccagggctgagagttggtctttaaaacattcttagcctataacctcttctttaaaaatctgttgtctcttctagaacaaattattttaaaccagttcaagaaaaatgcttagtgagcattgtggtttaaagacgcatatgaaggaatttccatagtaaacagggagtggagccctgtaccgtctgggggacgatgtgtcagctctcagggtccatggttgggtttttgtttcattttctaatgtgtcaaagtccaaactagaaactgttttttttttttttttttttttcatattgggacatggtgggggaaagaatacagaaagtgccactactttcaaaccaaggtgctctgtcccctcaggtctctgcatggattcccccagccctatggacccccacatggcggagcagacgtgagtagagaagggaatgtgtacttccaagcattcagcacctgtctttaagaatcctagttctaccataaattcacccgggaggcctgggaaagcagacagaccatggggtggcttcaggatccccatggccggggggctcactgactttctcaggccttggcattctgctccctgtctcagagaaggatctgctctcatgggagccaaccgagtgtgggctcagggccagggatagtggggacagtggccactgggagagcagatactagactacagcccatgtcttgcaggaatacaagcccagcgtatgtcccgtttttctttcttgcctatacccatttttttctgtgaaatattacaatttaaaaatatgatccaactaattcaaaactttaactcactctaggccaaacaaaacacagttgcctgcagattgatttggctcttggccgatcagcaacctctgacttcgatgacactttaccctctggccagccctggtctaggccctttctgcaagggaatggagagagagttggtgggctctggcctggacagaccatccccttggctgtgggcatgggtggtgtcttccagagcacagctgttcccatccagttgttaaagcccaagcagcggggcagctgccagccattagtagggacagctgggcatctctggcctgtgctggggactgtggctttgggtttaggatagtgacttgtcttacctcccattgcctttgatcagactgggttgggctgcagattggttcacaaacaggaaatggggagaggattgggtggggttgggggactgcaggttggttttggtggcagcacagagcaatcttgccctacccccaaggcccatgtgcaagccaatgaaattggtcatccctgatgccaggttggctgggcacagcagccccccgggggggcatccccctcatactttatccctgagtggttccctgccctgcacctgctctgacagttatacagagtttctcagaagctgtgtgtgtgtgtgtgtgtgtgtgtgtgtgtgtgtgtgtgtgcgcgcgcgcgcgtagatgcacaaaagctccgcgtggcaggtggtctcctgtaacacggctgagggggcggggcctcagagggaacatgtgttggaattccttgcctgctggcctcttctaaggcaggaggagggggtgggacagaggctggtcctggaaaattccataggagggaggagaggatgtgagcctgcacgtttgtcactgggggtctactgtatcagactggagctgactgggggagccctaaagcaggccccagtcctcagaggaccgggagccaggccagctcctcacaggggagaggaagcctagccttgctgttgtccaggccctggagacacccacattgctgggtgcccctggcctatcataggatggatggatgcctttcctggcagccatatggccccgctgaggtgatttgcatacaggtggaaggcctggtgcaggctggcgagactgttgccttggtgacgcctccctgaccctgacctgccccagctgtctctatcactgccattctctgggctttctttcattcagggcagcctttaaaattccaagctgcctcttatcttccccctccccaatacctgggccccctgatggtgggcgttcttcccaccccaccccttccactgccttgagccttggcccttgtctttgcccttactcccccctggactgggggcctggtgctggggtgggtgatgggtgcggagggagcatgggttgcatgggacccttctctgtcctaggtttgaacaggccatccaggcagccagccggatcattcgaaagtaagtgttcctgggcctcttccatctaccacaagctttcccttaggacagggctccagaagggcatgctgcatgctcttggtccctgccctgcctctcccagctctcacctgtccccatttcctcctgtagcgagcagtttgccatcagacgcttccagtctatgccggtgagtgtcttcgaggcctgactgaggcttaggcatgctagccaggcatggggtagatgagcaggatgcattcagggatcacctcccagctgggtgtccccaggcaggctgtaggagatggggtttcagaggtaggtaggtaagtgggaggagctggaggagaggtggagaaggtagggcctgggctcgtgccggaggaatgcagccttcattcctctgcctgccgccctgcctggctctctaggtgaggctgctgggccacagccccgtgcttcggaacatcaccaactcccaggcgcccgacggccggaggaagagcgaggcgggcagtggagctgccagcagctctggggaagacaaggagaatgtgcgcttctggaaggccggggtgggagctctccgggaagaggagggggcatgctggggtggttccctggcatgtgaggaccctcctctcccatcttggctgcaggatggatttgtcttcaagatgccatggaagcccacacatcccagctccacccatgctctggcagagtgggccagccgcagggaagcctttgcccagagacccagctcggcccccgacctgatggtacatccagagagcggatccctgggaggggcctggggaggcagcctcggagaagaggagggtggccctgaacccccaggcactgggaacttttcctcaggaggatgggggcgggaactatctccacctctaagtctgtgtctgtctgtcatgtggacagtgtctcagtcctgaccggaagatggaagtggaggagctcagccccctggccctaggtcgcttctctctgacccctgcagagggggatactgaggaagatgatggatttgtggacatcctagagagtgacttaaaggtaaacagccttgtcccaccaggcccctaccttcctatccctgggttcgcccaaaagaagagagctctgagcccttgtggcaggaccatgatgtcattccagtgtcagaagaagaatctgaggtaactgagtcacagcctaacctctggccaatgagagaagaacaggtggctggtgccacagtggagggcggtttgggaggtaggggagcttctcaccccaacctggagtttgccagggaaacagggaaggctgtgctggaggattccgggactggaggggtttggcctatgcctgtgggttgtgaccctgtccttgctaatctggcctcaggatgatgatgcagttcccccaggcatggagagtctcattagtgccccactggtcaagaccttggaaaaggaagaggaaaaggtgggcctctggggtggccccctccgaatttggaggcatggggtccatcctactctccagtggatttgagggatgggacggggcctgggcaccctgatccctaacctgctgtccctgccaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctgtgagtgccttcctcctggggttcactttggcatgcacctgggcagccacccccttggctaagtttgtggcagagggcaggtggcagcctgggcatggcagagaaagggggtaccagccagccagagcactggggggcagccccaccctgaccctggcctccatctgactcactttccagaaagcccgcgtcctccgctcaaaatcactgtgtcacgatgagatcgagaacctcctggacagtgaccaccgagagctgattggagattactctaaggtacctgcagcagcgaagggggtaccttgggggcttgacctcttactgactaggggtcctctagcccaggggctgcttgggttcctccctttctccccggagccccccttttctttgtcctttgtatcttttcatcctttgttctcacatagactcctccctctggccctccttgtctcctgactccacctcaagtcagtccaggcatctgttgagtctccgtcttatttccaagctcatacctagcttggaaccccctcatgcctcaccttcgggcttggcagagggtagggagcagagtgtggagttcatctcttccacttccctttttcatttctctttccccttggaaggttgttccctgggtgtcagacccaagaggtgcctctcagttgccatgggaaccagaactgaatttgaaggccaaagcaggtgtggcctctgattttgggaatgaaacttcattctttgaggctcctggtcttaccaatttaactttctcccctctccctcatcccttccgttcccttcaggccttcctcctacagacagtagacggaaagcaccaagacctcaagtacatctcaccagaaacggtaaacagcgttgcgtcattttctaggcacatttgggactgtagctccattgttgaccttccctggggacaggctagggccacctgccagctgccagcctgacctgccggaaccaacccccatgacctcctacagatggtggccctattgacgggcaagttcagcaacatcgtggataagtttgtgattgtagactgcagatacccctatgaatatgaaggcgggcacatcaaggtaagatggggcaatggggagaggccctgaagatcccacctggtttaggtccttgctttgccaagagggtgaatgggtggaggacgggtgccccctctcatggggagggttcctactaagagaaggacagcgactgcacggggagggccctgactcctggacccggggctgtgcctgacctctggctcctctgacagactgcggtgaacttgcccctggaacgcgacgccgagagcttcctactgaagagccccatcgcgccctgtagcctggacaagagagtcatcctcattttccactgtgaattctcatctgagcgtgggccccgcatgtgagtcccagctccgcccagccagctagtgtctgccctggccttccctgcccaggctcacaggtgctggcaccattgagatggccaggggtgcaagtccaggtcctcctctgtcccatctgatggcctagagctgacctcagccccacttcactgtgcatggtacccgcctcccatctccctcactgtcctgcctatcaagcctcatgtccaccccacatccattactgccaccctcagaaaatttagttccaagtctctagcggtgtcttttctcgaaatctaagggccgcgtgtcagtccccagtacacggaccctccccatgttcagtgctgttaggtctccattagaacctcttccattggcatccacagcacctgggcctccctggctgagctccttctgtcgctattcctgttctgcctggccatctgtcctcccacccctgcctcctcctgggttgccactggtccatatgactgctagtggctccccagcctggcctcacccatgtggtgggaatctgcacccagacgccccttacagagtcgcatccctgcggccctcccaacttctccaggcatcccagcatatggcacccacctccacctgggcaccgggcctgggcactggcttcagtcttgggtcctcctcctcccttctccccaccactgatcctcaccaggtcttgtccaggagtggcccgaatggatcccttgaatttggcccacttgtctcctctcctgcttctcctttcctggtccaggcacagatatctctaacaaagattgtgcaactgccttctagaaacggagagttcatccccttgattttacctccttccttccgcctccccaccctcttctgtagccagagtgacctaaaagtgttcttgtggttacattcctgtgctctaaagctttctgtggctccccaaggccctcaaaggaggggacgtgggggataggtcccatgatgtacaagccactgcatgccccactctgaccacaccctgcccatgacgccccaggtgccgtttcatcagggaacgagaccgtgctgtcaacgactaccccagcctctactaccctgagatgtatatcctgaaaggcggctacaaggagttcttccctcagcacccggtagcgtgggtggggaaggccacagtctctgtgtgagggttggcttggccaggctggagccatgggatggggggtgggagggttgggtccctgccaaacttacccattccactgcattgacccctcctgtcctgccctagaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaaccagcattgtgtcctgtggggccctgggcaagaccccagaagcccgccaatggcgggattggggtaggagacagggtcagcaaaggcaggaagagttgctggagaggtgccctcatgctcttgtcccttcttctcccaatgtcttccatctcttgggtgacactcctgccaggactttggattcaacccctccttcccctcacctggcctcccaagcacttctaggcttgcccttcctaaactcggcaccaaaaggcaagagtgacctcatcactcaaggatcatcagtggctccccattgtcctcaggataaacttaaagccagctgcagtgactcacgcctgtaatcccagcactttgggaggctgaggtgggcagatcacgaagtcaggagttcgagaccagcctggccaatatggtgaaaccccatctctactaaaaatacaaaaattagccaggcatggtggcacacacctgtagtcccagctaactgggaggctgaggcagaagaatttcttgaatctgggaggcagaggttgcagtgagctgatattgcgccactgcactccagcctgggcaacagaatgagattccgtctcaaaaaaaaaaagaaaaactcctggcatggccttttgagatttgggccctcgccagcctcattccctcaagaaattgggaaagggccaatctgggagcccaggccaaacccagatctctgaggaaatcctccctgaataccactgcaggtgaccctccccccagccccccacacacaaatgggagctgtgcgatgggagggactcctttatatctgtatatataagatgctgtctttgacacagagtgcacacacatgtcaggcatgattaccactttctgggacagttcatctatgttgtgaagtaggtgatgcaatgattatccaccccgtttttcagatgggaaaatggaggctatttcctatcagaacagaaaaaggggactccagatccccatgctgagtctaaaggacacttgtgctatctctagcttgttctctcaagtttcttatgcccaagagcttggtcttcactcctggttcagagccctctgcaagggcacaataggtgggagttattggggtgtggttttggtcttggggctgggctgtgctcagggagggaagggacctcaagggttcagaagtcccctccacctagcaggcagcgatagaaaggcaaatgtttatttggtgagaggatttgcccagaaaaggggaaacagctgtgcagatccctgagaaagggagatggaggaggggagaggatgggccccgggcgccatcatgctggcatgcctgctccaccctaagtgcttagggagtcttgtgaagccaccctccctcctggtttcacagacgaaagcagcttcagaagctcacagaaggcactcacttgccccagggcacacacaagatgtaagcagagcagctatcccagccttcccaggagtatcccatccccccttacctcccatcttagtcccagagcccccaggcgggtggggctgggcagcctcacttctgctgtgagcgtcctcttcccactccgggatcaggccacgtgatgaggaggaaacatgggctgagtgtctacaatgcccaggctttgtgccaggtgctgatgtccgtggccacatctgtccccattgtaactcaccatcagagtcttagttgcagccatgggacaattagtatgctctagacacttttagatataatgtctcctaagcccacccaacaggtattcagctcattttgtgggagagatgcgggcattggtcaagccaggagacacctcttccccaagaaaaggctctggtgctgacatctctgctgaggaagcaggagcctgggcctgggcctgggaaagggggtgctgtgggcttgcctctcagtttctgactcgggaccccctctgccctggaaagttcagggggatggggcagaggtgtctcatctcccttcccc

SEQ ID NO: 16371 - DNA, 13814 bp, Human; identical to SEQ ID NO: 16370

SEQ ID NO: 16372 - DNA, 13814 bp, Human; identical to SEQ ID NO: 16370

SEQ ID NO: 16373 - DNA, 13814 bp, Human; identical to SEQ ID NO: 16370

SEQ ID NO: 16374 - DNA, 24154 bp, Human
ccattctgtgggttgtcctccttttattcactctctggatagtgtcctttgattcatatcctttttttttttttttttttttgagacagaagagtctcactctgtcaccaggctggagtacagtggcgtgatcctggctcaccgtgacctccgcctcctgggttcaggtgattctcctgcctcagcctcccgagtagctaggactagaggtgcacaccaccacacccagctaattttgtatttttagtagagacggggtttcaccatgttggccaggatggtctcaatctcttgaccttgtgatctgcatgcctcagcctcccaaagtgctgggattacaggcgtgagccaccgcacccagctgttgtttgttcttttcagacagggtcttgctctgtcacccaggctggagtgcagtggtgcaatcatggctcactgcagcctcgacccctcccctgggctcaagcgatcttcccacctcagcctccagagtagctgggaccacaggcctgttttttaatttttcgtagagacagagtcttgcagtattgcccaggctcgtcttgaactcctgggctaaagtgatcctcctgcctcagcctcccaaagtgttgggttcacaggcatgagccactgtgtctggccaagttttaaattttgatgaagtccaacttacctatttttttttttcgtgcttttaatttcatacttaagaaagcattgcctaatccaaggtcatgaagattttcacctgttttcttctaagagttttatagtttcacttatatgtgtttctggcatctcttccttttgggctcaggtctatggtaccccttagacactccctgaccaggggcactccatggttgagggcctgcctttttggatatggtacactccgcacacattgagctcatatttgtggggtatgtgttccacagcgctctcatgctacctttcaaacctagacttgccttgccacctccccactccaactctgaacctcagctctgaacccctaaagacctcacccctctcttagtcactaaggggtttgctgaatgcctggtaggctccgcactgctatggggcacatatcttcagttctaggtcctgagaaatgggctctcacaagctgtaaaaaacaaggcaaggaaaatagagatagctctggggtagctacaggaacctcaaaggagaagttccagctggaagccaaattcatgctgctccttgaaggttgaataaggtttcagcaggcaaagattatctgtggtggagatagagctgggcagctagggagcccttgagcagacagaactgcccccagagtgggtctgcggagagcagggaatggggacagagctgggggcaggaaatgaggacttttcacatctcacgggcaatggggagccacagaaggtttttgagcaggggagtgactgttaaaggcagcacttcggcaagttcagtaaagccccattatggtctatagttagtaaggcaggtggtaggagacaagcctcaggaagaaaccatcattctagctgggtgtcttggagtgagtaactgggcatctctgggctccagttcctgttggtttgggtggtggggagggggcagggaagtggggaagagggagaaacagctgttcatctgccttagggtggtatccttgaggggctgggaaagcagaacttgggatagggccaagggacacacaggcttttctgaggcaggccaccaagtgagggcattcctgggcacagcctgagctgggaacgtggcctcctggctctctgctggtgtctgactcagaggtctttaagagccctgccctcttattgggttggccagcagaggaggtggggacacaggctcggacttctagcaggtgctggggctaaagtgcccagaggtgtccctggaggcccctgtgagcccagccagcgcagtgcgcaccaccctcttaggcaacaggagcagcacaagaacctgctatgggcttcttgcccaagcttctcctcctggcctcattcttcccagcaggtaagctttgcgggcctagtgcctgtcttccagggtccagccttcataagtccagcccttggcagattagactatgcctgggtcacatgtttggttgctgaggtcaagggagggcccaatcgggcagtggccaggagctgggcaggaagctgccatctgtcttcgagccaccctaccaaacctctgagcagcctcgggcagtggactgacccctggggcactgagaagggctgctctaagtgtgcatttctcggggcagggcagaatttgggagcccagctggggcaccttctctggggcaggtcgcagggctctgtggcaccctgaggcctgtatcaccctcccctctgtccccctgccgttcttcccccaggccaggcctcatggggcgtctccagtccccaggacgtgcagggtgtgaaggggtcttgcctgcttatcccctgcatcttcagcttccctgccgacgtggaggtgcccgacggcatcacggccatctggtactacgactactcgggccagcggcaggtggtgagccactcggcggaccccaagctggtggaggcccgcttccgcggccgcaccgagttcatggggaaccccgagcacagggtgtgcaacctgctgctgaaggacctgcagcccgaggactctggttcctacaacttccgcttcgagatcagtgaggtcaaccgctggtcagatgtgaaaggcaccttggtcacagtaacaggtgataagtggggtggcctggctgccccccgggagggattcccaagctgcttctggaccccttggctctcagccccagcccttgtcctgaatctaaccccagccagtctcagcctctgttccagccccggcgtaggcccaggcctggttctcccttgtattcacccaagtggggctggagtagaaagcgtctttccttcccctaaaagccccctccccagggctctctcctcagctggggtttccagggcgagggatctcaggggtggcaaaagcgggtcctgagcactgctgtctctgtcctcagaggagcccagggtgcccaccattgcctccccggtggagcttctcgagggcacagaggtggacttcaactgctccactccctacgtatgcctgcaggagcaggtcagactgcagtggcaaggccaggaccctgctcgctctgtcaccttcaacagccagaagtttgagcccaccggcgtcggccacctggagaccctccacatggccatgtcctggcaggaccacggccggatcctgcgctgccagctctccgtggccaatcacagggctcagagcgagattcacctccaagtgaagtgtgagttgtctggggacacacccttgtggctgagcgcatctgttgctcctgacagaaaccagcccctctccagcccacagaaacggaacccttgctcctgatgcaaaaccaggctgctcctgggcctccagggtagggcaagtggagagacactgctgagccccaaggacttcgttaaatggttccctccacctcctactgcttcgaaggggcttgtccttgaggccaggctgggcagagaaagggagacacaaagggttggggaacaggagctcccatgcagcttcagggttggcagcaagtgccccgggatttaccccgtgctggaggatgctggggaggtgggatttatccctttcctgcctggctctgttttctcagtctatgacgaagataacaatagatggttcctgtctcacagatttatgataaaaattaaaggagatgggccgggcgcggtggcttatgcctgtaatcccatcactttgggaggctgaggcgggtggatcacttgaggccagggattcaagaccagcttggccaacatggtgaaacctcgtctctactaaaaatacaaaaattagccgggtgtggtggcatatgcctgtaatcccagttactaaggaggctgaggcactaggattgcttgaaccccgggggtggagttgtattgagttgtgattgtgccactgcactccagcctgggtgacagagtgagactgtgtctcaaacaaaaaacaacaacaacaacaaaaacaaataaaggagatgacccaggtcaaggatttagaagagtgcctggcacatattaaacacttgaggccggatacagtggctcacacctgtaaccccagtgctttgggaggccaaggcaggagaattgcttgaggcaaggagttcgagaccagcctgggcaacatagtgagaccctgtctctacaaaaaaaattaaaaaacaaaaattagctggatgtggtggcttgcacctgtagtcccagttcctcgggaggctgaggcaggaggatcacttgagcccaggagtttcaggctgcagtgagctatgattgtgcctctgcactccagcttggctgactgagccagatcctctttctaaaaaaataagaataaaacacttgaatacacagagagaggctttggaacaagatttaaggaaatgcagttctttgtgttgttggcctcttgcttacaaactgggtaactattttcagagctagtttgatgctgcctttggccccctcccactaggtagttggtcccttaccaatagcttccacaggccactaaagctagcagtggggtacccatgaccctgtgtgtggagctcatcccaaatagagcaggagcaatggacagcattgggaagcagaaaactacagctggtggggtaggctggacgctggccaagcgtcacatgatcagctctcaatgggcataggaatgcatcaggcgcagggggcgggaaagggacggacatgggcagacagagcatgccctgggtgaggattgaaggggactgctgttttatctgggcatacttccttaggactgagcttttaaaggggggcaagaagaagtgtgccatcctctgccctccccaagcaccttacccaataccccctactgtgacttgcagatgcccccaagggtgtgaagatcctcctcagcccctcggggaggaacatccttccaggtgagctggtcacactcacctgccaggtgaacagcagctaccctgcagtcagttccattaagtggctcaaggatggggtacgcctccaaaccaagactggtgtgctgcacctgccccaggcagcctggagcgatgctggcgtctacacctgccaagctgagaacggcgtgggctctttggtctcaccccccatcagcctccacatcttcagtgagttcttgggaaggttgcgtattggccagagaatagggaggagctcaggcctcagggacggaggggagacagggcagggcagggccagcaactggcataacccagtgcttcctggatgcaggtgtggagtcccagccctgccttaccatgagacaggtgacaatacccccacgaagggtggggtgtcagggggatcctggtgagcaggacaaagagatgcagagcactccaggaggctcccctgtagcagcaggcgggtggtgtaggatgtgcagagattgaggctgattggctgagacccggggactgtatggggctggggctggaagttggctgggaccccccagcactccctatgctgcccttgcagtggctgaggtccaggtgagcccagcaggtcccatcctggagaaccagacagtgacactagtctgcaacacacccaacgaggcacccagtgatctccgctacagctggtacaagaaccatgtcctgctggaggatgcccactcccataccctccggctgcacttggccactagggctgatactggcttctacttctgtgaggtgcagaacgtccatggcagcgagcgctcgggccctgtcagcgtggtagtcaaccgtaagaggccagggtggggtggcactggacacagtcagagcaggaccagatggtggagccccaaggaagggttggggtcctgggcatgggaacttcaaggccacttacctggaggtggccttgagctcatgtcccagctctgcacacctgggcaatgctttgacctccctagttccctcctattttatatttggaagtttaaacttatgaaaagttgcagagaaagacaaataatgattatatacctttaacctagatttcccatttattaacattttggcacatttgcttaatctttctcgctgtctacacagacacacacacgcacatacatacatataaatgtatggatatagacttgcatatatacaggtgcacttgtgtgtatgcacatccactctatgtggacatgtgcacttatacatatatggacactctatatacatatgcatatgttatttatgtatctacctacatatttatattcctgaagttgcagacatgaggcctctttaccgctaaattcctaagatcattctcttacatatccacaatgcaatgatcatgatcaggaaaattagcattgatagaagacttttttttttttttgagatggagtctcactgtgttgcccaggctggagtgcaatggtgctatcttggctcactgcaatgtccgcctctggggctcaagcgattctcctcctgcctcagcctcctgagtagctgggattacaggcacccaccatcctgcctggctaatttttgtgtttttgtagagacagggtttcaccatgttggccaggatggtcttgaactcctgacctcacgtgatccacctacctcggcctcccaaagtactgggattacaggtatgagccactacacctggctgatagaagactgttatctaagctataatctatattcacattttaccagtggacctaatactgtcttttgtagccattttttttctggtccagaatacaatcacagttcacatattgcattgggtcgttgcgtctcttcattctccgttagtctgagactgttcctcagtctttccttgtcattcttgatgttgaaacttgcagagtgcaggcctgctgttgtgaggaggtccctcactccacatttgcctgacttgaatggcctgagaccatgccctctgggtgggaaggccgcggacatgctgctctgccctgtcaggaggcactctgtgtcagcttgtcccattgctgatgatgctcactttggtcacctggctgaggtgctgtccctcaccaggtctctctattagttttctcatctttgaagtggggcttttatccccacttgcagggtggccttgaacactgactgggacaacagagtgacgtacccagcccagccaaggacaaaagtgtattcagcaggcactcaggcactttgggatcacccccttctcgcagggcagtgtgggacaaagcagtgcagaggtcacgggttgtatcagggtatccagggaatgcccttgtctgagggtgacaggcccacctctcgtctccacacagacccgcctctcaccccagtcctgacagccttcctggagacccaggcgggacttgtgggcatccttcactgctctgtggtcagtgagcccctggccacactggtgctgtcacatgggggtcatatcctggcctccacctctggggacagtgatcacagcccacgcttcagtggtacctctggtcccaactccctgcgcctggagatccgagacctggaggaaactgacagtggggagtacaagtgctcagccaccaactcccttggaaatgcaacctctaccctggacttccatgccaatggtaagatgggcactggcagccagggagagtggagggagcctgaggaggagcctgctccagtctgttccttctagaagtctagtggactcaaccgcaggactgagctaactggctacgccacataaaagacaggggctgtgcagtgacccaacggcagagcttcctggaagtcaagggaaaaagggaaacacaacaggtcacatcattccttttgcacctaccctgaccctaaacttggagagtccctcagaagcattcattgttttttaattatgaaactttgggagcaggctctatgctagcagtcagatgtgggaagccaaatagaaaagtagggtcttctggctgggcgcggtggctcactcctgtaatcccagcactttgggaggccgaggtgggtggatcacgaggtcaagagatcgagaccatcctggccaacatggtgaaatcccatctctactaaaaatacaaaaattagctgggcatggtggtgagttcctgtagtcccagctacctgggaggctaaggcaggagaatcgcttgaacccaggaggtggaagttgtagtgagccaagatagcgccactgcagtccagcctgggtgacaagagtgagactctgtctcaaaaaaaaaaaaaaaaagaaaaagaaaaaagaaaagtacggtcttccaactttcggtatgtgcactgtccttccctcctcctgagggcatggtagctaattgatcaagccaggtttttctttttgttttttgagatagggtgttgctctgttgcccaggccggagtgcaatggtatgttcatggctcactgcagcctcaaactcctgggctcaagccatcctcccatctcagcctcccaaatagctgagactacggcccatgtcaccacacccagctaattaaaaaaaaaaaattgtggccaggcatggtggctcatgcctgtaattccagcactttgggaggccgaggcaggcagatcacctgaggtcaggagcttgagatcagcctggccaacgtggtgaaaccccgtctccactaaaaatacaaaaattagccgggtgtggtggcgcacacctgtggtcccagctactagggaggctgaggcaggataattgcttgaacctgggaggcagaggttgtagcgagctgagattgcgccactgcactccagcctggctgacggagcaagactccgtctcaaaaaaaaaaaaaaaaaaaaaaaaaaaagctggccacagtggctcacacctgtaatcccagcactttgggaggctgaggcgggtggatcaccagaggtcgggagttcgagatctgcctggctaacatggtgaaaccctatctctactacatgtataacattagctgggtgtggtggcacacctgtaatcccagctacttgggaggctgaggcaggagaatcgcttgaacctgggaggcagaggttgcagtgagccaggatcacaccactgcactccagcctgggagacagagtgagactcagtctcaaaaaaaaaaaattgtttgagatggagtctcactatgttgcctaggctggtctggaactcctggcctcaaacgatccttctgcctcagtctcccaaagtgctaagattacaggcatgagctaccatgcccagccaagccaggtgttggacataagcctgggctctggctctgaatcttcaaccatgctgcagccatctactaccaatagatctgatttggcattaaagggcaaaccctcctgatgcaccacaaagcccagagctacctacagtagtgtggggaaaggagaaccctggaaggctttctatatagggcagcatgtggggttgagaggagggacccttcccagcctcttcctctccccgcagccgcccgtctcctcatcagcccggcagccgaggtggtggaaggacaggcagtgacactgagctgcagaagcggcctaagccccacacctgatgcccgcttctcctggtacctgaatggagccctgcttcacgagggtcccggcagcagcctcctgctccccgcggcctccagcactgacgccggctcataccactgccgggcccgggacggccacagtgccagtggcccctcttcgccagctgttctcactgtgctctgtgagcagccaccacctgttgcagcctcctgccgggacccaccagccaccccacctcctctaggccccccagccctgtcctgccctgccccacggtctatatcgggagggctgggtcacagacctggccacagtgggtctttccacgtggggctgaagtttaggaaatgaggctggggccttctctacctccccatgtctttaccctccaatgccagccctgtgggctcctctgtcccagcctcaagctcagcatgggcaccacatccatgctttgtcctcatgggtgagccctgggacaccacactcctctatttgtgcacatgccccacaggctgtgctgggctcccatagacaccaaggcaaagcccctcagcacagggacagacagcccctctgcatccgccaagcggggaggctccgtgtaagaccaagggcctgattccagaggcttcccctgacacatgtgtgccggagccacgtcccggaactgtcagagggcagctgcctctgcaaagttttctggtgtctgagtgagatcacatgggggccttggctgattgctctcttttggccaactgtctccagaagccttcaggaagaggccattctatgcattcgctagtatcacaggagctggcttggagatcacagataagctgcagggcagatcttgaggggaggctccgtggtaaggcattgggtgcagggtgggagcagacagcatgacccccagggattgctaggtgggcaccctgctcagcagcagatgggacttatgcaaggtggcagccagcccatacagcacctttgtctgagctagaaaatggtgctccttcttctgggaagactcagtaggcatcagggcacagcttagcttgaggagcatgagcctagcttgagttccacccaccctggtctggctgcccttgtgcagtgcacagtctgcacagctgcttggggcagccttcgggatctgcctttgtccagtgtattctgggagcctagccaggcttgtggggccctggagcatccgtgggatgagtgcccatgttcttcctccctgcagacccccctcgacaaccaacattcaccaccaggctggaccttgatgccgctggggccggggctggacggcgaggcctccttttgtgccgtgtggacagcgacccccccgccaggctgcagctgctccacaaggaccgtgttgtggccacttccctgccatcagggggtggctgcagcacctgtgggggctgttccccacgcatgaaggtcaccaaagcccccaacttgctgcgtgtggagattcacaaccctttgctggaagaggagggcttgtacctctgtgaggccagcaatgccctgggcaacgcctccacctcagccaccttcaatggccagggtgagtcaggcagggaatgggtggcctgggggcaggggctggagctctggactgttctgctccgaggaggatctaatcaggcaaaaccactctgtgcagcagtgggggcccttcgctgccctcctccacattcaggaagagcggagctgctccttcccatgatctctgttcaggccggggataggcaacacagctggtctctgaggaaggactccccagctgggacagttgggctgccttgtcctccttccctgtactgcaaccctctctgcccagggcccccacagtccccagggcccacttctcctaggctgccctgtgagctagcttgcttttctccccaaccctgtgggcaccccagggggcctccttcctgctccttccaggctgggcggctggacccctggctcctgggggccgggggtggtcagtaagctgtgccgcctgctctccagccactgtcctggccattgcaccatcacacacacttcaggagggcacagaagccaacttgacttgcaacgtgagccgggaagctgctggcagccctgctaacttctcctggttccgaaatggggtgctgtgggcccagggtcccctggagaccgtgacactgctgcccgtggccagaactgatgctgccctttacgcctgccgcatcctgactgaggctggtgcccagctctccactcccgtgctcctgagtgtcctctgtgggtgactggcatgggcagcctggggacttggagggtggaggggtggtctggggagaagcaggggccgggctggggtttggggaggaaagagcatggcttaggctgtgtgtgtggcaggaggtgggggacatagtgtggcagttgtaatgtggtgagctaggctgggtggcctcagctccctctgttcctgcagatcccccggaccgtccaaagctgtcagccctcctagacatgggccagggccacatggctctgttcatctgcactgtggacagccgccccctggccttgctggccttgttccatggggagcacctcctggccaccagcctgggtccccaggtcccatcccatggtcggttccaggctaaggctgaggccaactccctgaagttagaggtccgagaactgggccttggggactctggcagctaccgctgtgaggccacaaatgttcttggatcatccaacacctcactcttcttccaggtccgaggtgagtgtcagtcttctgaagatatggtagactctgatgccctggggactactctggtcagactttgggctgggtgctgtgaattttgtgcagaaatatgtctttttcagtcctggtaagggcagtttccagccagcagaaggcctccctttgcctccagctagatattttcacctgtaataactgcagcagccactaggaggcaatggcaattcacaaagtggcttgcttggtgggagcactttctgaaataacttgttttgtgatcatataattttgttacatagtaaacattctcatacatatgtatatttatattatgcatatatgtttatgtatgagtatatacacatacaaatatacattatgtgtattcttatgcataatatattcatattctttatttatatacacatacgtgtgtgtgtgtgtgtgtgtgtgtgtgtgtgtgtgtgtgtatatatatatagtctctataaaaatcctccctcaggccgggcaccatggctcatgcctgtaatcccagcactttgggaggctgaggcgggcggatcacttgaggtcaggagttcaagaccagcctggccaacactctactaaaaatacaaaaattagctaggtgtggtggtgggcatttgtaatcccagttactcgggaggctaaggcaggcgaatcgtttgaacctgggagatggaggttgcagtgagccaaaattgtacttcactctagcctggatgacagagtgagactctgtcttaaaaaaaaaaattctccctaaacaaataaaccaggaaaaaggaaagataatgcccataatgcgaaggtcaaaggaacatgagtgtttcttccaccacggtgaccgacagcaccaattttgggacatttactttgagccttggttctgtgtatcttttcttacttagcatacctatttcgcaggaagaaattgaaggtttgagttttaggagcttttccccagttgcatgaccctgctagctgtggtctcaggcatggtctgtgttcttgcttagcattccagctgtccctccatctcactccctgcaacctggggttctcctgcttcacacccaggggccactgaggagctgccctttgcctggtccccaggtcctgtgctcttgtggcctggagtctggatgcagggctggcctggcgagagcgctcaagataacatagctgctaacattcccttccaagccctcggtcacccatgctgagtccagatcctagttaggacaatggccccgggatgatctaaatccctcccttttcagtactttatgggttgaaccaacatttgtcaggagctaacacatgcaggcacagtgcctggaactggggttacaggtcacacaagtccagtgcccataaggcttacgctttggtaggcgagatatgactgacacagtaaaaccatcccaccaggtggtgggaggtaaatgccaggatggagcctgtgcaggagagtggggagcaggaggggccaaggcatagggctgagtgggccctggcggtggtctggaaggggctgcggctccagcacatggggttgggttgtgtagtcctaggtggacacgcacatggtcccagactgtgagaggtgtggtggagagccctcacctgctcttggttttcccctgcaggagcctgggtccaggtgtcaccatcacctgagctccaagagggccaggctgtggtcctgagctgccaggtacccacaggagtcccagaggggacctcatatcgttggtatcgggatggccagcccctccaggagtcgacctcggccacgctccgctttgcagccataactttgacacaagctggggcctatcattgccaagcccaggccccaggctcagccaccacgagcctagctgtacccatcagcctccacgtgtcctgtaaggacttttgtcccatccaggtgtgggggaaggaatgcagtcccccagtcctgggctgtgtcacatgacagagccctggatgagggacccccctggctgggtcctgaccactccccaccctgtgtagatgccccacgccacgtcacactcactaccctgatggacacaggccctggacgactgggcctcctcctgtgccgtgtggacagtgaccctccggcccagctgcggctgctccacggggatcgccttgtggcctccaccctacaaggtgtggggggacccgaaggcagctctcccaggctgcatgtggctgtggcccccaacacactgcgtctggagatccacggggctatgctggaggatgagggtgtctatatctgtgaggcctccaacaccctgggccaggcctcggcctcagctgacttcgacgctcaaggtcagtgtgtgtgtgtgtgtgtgtgtgtgtgtgtgtgtgtgtgtgtcctttaaaagaggagaggaggtgggacagggttctagaagcctgggggcacgggaatagtccccattcccacccttcctaacgatggtggactccagacttgagtttcttaggagaaccttttataaacaccaaattttacaagtatgcccagtggataaaactaaacagggaatttcaggagaaagtgcagcaggggaggggaggtctgtggtctccccatttgcccccagccagggtcagggaggggctcagggctttccaggactctgtggaactctacttgggaccactcaggagccagtgggctattcccaagcttgacttctaagccacatttataggtgggccacccaaggctcccaaaggccaaggggctccccagcagtaggagtagctcacccacatggagacaggtggcctgctgtacacagcctcaagaccctcactggtgtcctgtgccctccctctccccagctgtgaatgtgcaggtgtggcccggggctaccgtgcgggaggggcagctggtgaacctgacctgccttgtgtggaccactcacccggcccagctcacctacacatggtaccaggatgggcagcagcgcctggatgcccactccatccccctgcccaacgtcacagtcagggatgccacctcctaccgctgcggtgtgggcccccctggtcgggcaccccgcctctccagacctatcaccttggacgtcctctgtgagtctggctggatgcagggtgggactcacaggaatgacagaagcccacagggatcacggcatggccggaacccgacaggtgtccagtggggaactcggtacccagtagctagtggagcactgggcaaggagcattaagagtagggggcgctggggtgagtcctgtctgggcagaggagcagtgcctcagactgggtggttgggagccataggggtggggagccagggccctcctgagtttgaatgccacctgcaaactggcctcctgcaggctgctgcctgtgactccgtgtaagcctctcatgccctgcagacgcgccccgcaacctgcgcctgacctacctcctggagagccatggcgggcagctggccctggtactgtgcactgtggacagccgcccgcccgcccagctggccctcagccacgccggtcgcctcttggcctcctcgacagcagcctctgtccccaacaccctgcgcctggagctgcgagggccacagcccagggatgagggtttctacagctgctctgcccgcagccctctgggccaggccaacacgtccctggagctgcggctggagggtaaggcagggcctaggccaagcccactgggatggaagcccactgtggtgtccggctgggcccggctgatcctggcctccttggcacaggtgtgcgggtgatcctggctccggaggctgccgtgcctgaaggtgcccccatcacagtgacctgtgcggaccctgctgcccacgcacccacactctatacttggtaccacaacggtcgttggctgcaggagggtccagctgcctcactctcattcctggtggccacgcgggctcatgcaggcgcctactcttgccaggcccaggatgcccagggcacccgcagctcccgtcctgctgccctgcaagtcctctgtgagcagagggtccttggccagggctgcccaggaggagggtggtggagggtgcttctgggctctggtgggagtgggcaaaggactgcagtgggcccaggaatgggcagttggggaaagaggacataggtgctagagaaagagacagtcctataagccctgcctggagcactctgcccacaggactcctgggaaggtgtcacttctaggaagtggccattggtccagaggcctcagcctgaccaaccccaggcagctaggcaatgagcagtacagggtgcctaagcaaggtccccatctgtgccctgcctgcccacagatgcccctcaggacgctgtcctgtcctccttccgggactccagggccagatccatggctgtgatacagtgcactgtggacagtgagccacctgctgagctggccctatctcatgatggcaaggtgctggccacgagcagcggggtccacagcttggcatcagggacaggccatgtccaggtggcccgaaacgccctacggctgcaggtgcaagatgtgcctgcaggtgatgacacctatgtttgcacagcccaaaacttgctgggctcaatcagcaccatcgggcggttgcaggtagaaggtgagtggaagagaggggaggaggaggggctctgatgctctcaggtccaagtccacgagaggggctggagctcccactagagcgggctgtctggtctgagaaagctctgccttgagaagcctaatctggtggagggggcacagctcccactggagggggcatggttccaccttggaaagccctataccaagtcagactgagaccttcccacaatgtgcagaggcccctcagaggtcccacccagaggctccagcccccaaggcctacagatccccaatcatctctctatcctccgcccgcaggtgcacgcgtggtggcagagcctggcctggacgtgcctgagggcgctgccctgaacctcagctgccgcctcctgggtggccctgggcctgtgggcaactccacctttgcatggttctggaatgaccggcggctgcacgcggagcctgtgcccactctcgccttcacccacgtggctcgtgctcaagctgggatgtaccactgcctggctgagctccccactggggctgctgcctctgctccagtcatgctccgtgtgctctgtgagtgtgaaccccctcctccgccttagtctccccacatctcacacgcccacctcagttcttcctcctcttctgtctgccaagagtgaaggctttacggatattgagtcctgggttggaatcctggctctcccgctgtctggttgggtgaccttgtaaaatggggaatacatcattcgcctcatcctgcaagttgtataagaaataaatggctggtgcaggggcttatgcctgtaatcccagcactttgagaggctgaggtgggcggatcacttgaggtcaggagttcaagactagcctggtcaatatggcgaaactccgtctctactaaaaatacaagaattagcacggcatgaaggcacacacctgtaatcccagctattcaggaggctgaggcaggagactcacttgagcctgggaggtggaggttgcagtgagccaagatcaccacaacgcactccagcctgggtgacagactgagactctgtctcaaaaaaaaaaaaaaaagaaaagaaaagaagagaaaaaaccaaaagaaataaagcgtgctgagtgtgtctggcacacgataagccctcatcagtcttggtctcccactccagccttcaccaaggcctacactgtatcagtcagctattgctattgaccacaacaaaacttactgcttcaaacaaaagtcatgttatctgctcaattctgtgggctgggctcagctggggagttcttctgttgttcacacctcatgtggctgcagttgcccagtggtctcagatgactgcacgctcctggctgccagttgggccacatgtgcccagcaggctggcctgggcttcccacattgttgtgttccaacaagtagagcagaagctacaaggcctcttgaggtctggctctgaagttgcacaacatcacttctttcttcaattggtcaaactgagtcacagattcaaggagtgaggaaataggttctgcctcttaatgggaggagcagcaaagtcactgtgcatgggtacagggagggagaaatttgtggtcattgtctgcaatcaccacactcccttcctccccacagaccctcccaagacgcccaccatgatggtcttcgtggagcctgagggtggcctccggggcatcctggattgccgagtggacagcgagccgctcgccagcctgactctccaccttggcagtcgactggtggcctccagtcagccccagggtgctcctgcagagccacacatccatgtcctggcttcccccaatgccctgagggtggacatcgaggcgctgaggcccagcgaccaaggggaatacatctgttctgcctcaaatgtcctgggctctgcctctacctccacctactttggggtcagaggtgaggggagggggctccatctcccaggccactctgcacaaaagcccagctcttaggcccaaaggcttccttccctgtatccctcctgctgcagcatgatttgcctgtcgactctaaactgattgctcggggcacccttgtgtggagagcttcagcgataaagcaaaagttagaaggtgtcatcttgggtgggtccccttggaaggaagcactgggggcctgcagctgtggctgctctgagtcccgctctgtgttccagccctgcaccgcctgcatcagttccagcagctgctctgggtcctgggactgctggtgggcctcctgctcctgctgttgggcctgggggcctgctacacctggaggtgggtctggagctgggagtgggccagaagattggggtaaggcagcccacctcgtcttctccccaaattcccccaggtcctttaggacctcctattaagttcacaggctgcctacttcccagactgcccctccaaattggaaatcccttctagaattgtccctaaatcctccttgctgtagtttctttctttcctcctctctgccctggctgtgctaaagcaagggctagggaggaagacagaggaagcacccactctccatgaggttcccacgctcttgtggtctggagccagcctgtggggagcgggagaggaatgggggcaggaggtggggaggggagaggctctctgagtccactccgggccttgcagaaggaggcgtgtttgtaagcagagcatgggcgagaattcggtggagatggcttttcagaaagagaccacgcaggtatccattcaacacacacgggcagatataatacccagctaacccacagtgccaactggcatctggagactgctgtcatttagaggatggtgcctgggaccaaggggaggttggggagagtgtgcagggaaccaggagcccctcaggagataggagagccctgttctgctcggggcagagggaatccctgtgtcagctggcggctggcttagaggactaggggagactttctggacttggcagcatcccctccatttccaagacacgtatgttctgactcccccacctttgttctgaggcctcttccccactcccaagcctgcccgtcacctgggcagaagtgaaagtcagtttctcctcccctgtggtgtgtcccttctgcagctgattcacctggtaggccagggctccaagtcacacttccagccatgcacactcccaccaatcctcttgggaccccacctgaggctgggggcctgggggcctgccctggctcccagaggcctcctgtgaccagggttttctctgtgggaagctcattgatcctgatgcagccacatgtgagacctcaacctgtgccccacccctgggctgaccagtggtgttgcctgccctccggaggagaaagtggccagaatctgtgatgactccagcctatgaatgtgaatgaggcagtgttgagtcctgcccgcctctacgaaaacagctctgtgacatctgactttttatgacctggccccaagcctcttgcccccccaaaaatgggtggtgagaggtctgcccaggagggtgttgaccctggaggacactgaagagcactgagctgatctcgctctctcttctctggatctcctcccttctctccatttctccctcaaaggaagccctgccctttcacatccttctcctcgaaagtcaccctggactttggttggattgcagcatcctgcatcctcagaggctcaccaaggcattctgtattcaacagagtatcagtcagcctgctctaacaagagaccaaatacagtgacttcaacatgatagaattttatttttctctcccacgctagtctggctgttacgatggtttatgatgttggggctcaggatccttctatcttccttttctctatccctaaaatgatgcctttgattgtgaggctcaccatggccccgctttgtccacatgccctccagccagaagaaggaagagtggaggtagaagcacacccatgcccatggtggacgcaactcagaagctgcacaggacttttccactcacttcccattggctggagtattgtcacatggctactgcaagctacaagggagactgggaaatgtagtttttattttgagtccagaggacatttggaattggacttccaaaggactcccaactgtgagctcatccctgagacttttgacattgttgggaatgccaccagcaggccatgttttgtctcagtgcccatctactgagggccagggtgtgcccctggccattctggttgtgggcttcctggaagaggtgatcactctcacactaagactgaggaaataaaaaaggtttggtgttttcctagggagagagcatgccaggcagtggagttgcctaagcagacatccttgtgccagatttggcccctgaaagaagagatgccctcattcccaccaccaccccccctacccccagggactgggtactaccttactggcacttacaagagtggagggcagacacagatgttgtcagcatccttattcctgctccagatgcatctctgttcatgactgtgtgagctcctgtccttttcctggagaccctgtgtcgggctgttaaagagaatgagttaccaagaaggaatgacgtgcccctgcgaatcagggaccaacaggagagagctcttgagtgggctagtgactccccctgcagcctggtggagatggtgtgaggagcgaagagccctctgctctaggatttgggttgaaaaacagagagagaagtggggagttgccacaggagctaacacgctgggaggcagttgggggcgggtgaactttgtgtagccgaggccgcaccctccctcattccaggctcattcattttcatgctccattgccagactcttgctgggagcccgtccagaatgtcctcccaataaaactccatcctatgacgcaactggagtgagtctctttcttgcaacccaaacagctgggctagaacagaggagtcacatgttagtggggtttattcttagacaccatctgtaggagggggccaggggctgcaagttacatgacatttatcacaaattaccttacgctgaagtgatttgtgtccctttctgctccttgaggcttcgtgtgttgctcacatttgccacccacaatgaccagccccgtgcatggcacgcagtaggtgggcacgtgaactaagcgtttgtcttgtctacattgctgacagtggggagggtggagaacatggactaaatccagaggtgggacagggagagagcaagtcaaatgcagccagatgtttgggggctgtctggggaagagagggtgtagggaggaccataagcagctgctgaagctgcagctactggggggatttgggaatatccggcttaggagtcttcacctgcttctgcatacttccaaggggacatatgtccatcttggattggaggctctcagaggggttagttgtgtccgcttccagtggtctgaggcctcctgagactttttgtacattcaattaaagtgtaacatacagaaaagttcacacattataaatgcaactcaaggacttttccaaaagcgaacacacccagatcaagaaatagaccatcctacagtccccccttacactctgtaccagttgcagcccccacaagggtaactactgtcttgacttcgaacaccatagatttgatttgcctgtttttaaactttacataagtagaatcacagagtgtgtacaatgactttggaaaactgtttgacaatatctattaaagctaaaatacccttgccctatgaacctgaaattccacccaccttgccaagggacaaaaagttcccctctaaatgcaccaggctgtcagggatgaagcgttggctttggggcccccattcacacacatgactttttccggggcacccaagcatcagcctgtcgtcaccaggtgccaccctggcgatctctgaaggctggagtcggagtgcctccctcagacatcctgttctgcgtcactccttgggagaagtcgtgtttacagatggtgggtgtcacccatgccaagcacttctaagggttaatgctcactggtttgcctggttcccaggacatttcctgatgcccctctggagggtgacgccaacaagccagtggagaagccatctttcccaggtgctgtcaggcgcccccggagctgctcggtgcatcctaggatccctcttcctcagctttggtttgatggcctcatctcctcccctgcaacctcaaaatgtaaataaaccctttctcagagacttcggcagaaaattcctctgacctgcacttggacacagctcatctgggtttgggaggtgtcaactgtgtaaggatgactctgatccccatgtggcttttcgactgtgtcccctctacagtcagttattagcactgactgtgctaggaagtgagcaacacacatattcccagaccacatggagctcaggagcttggggagagagacagggaagtggacgactacagggccttctgaaacgtgttgcagggagaagtgtcagtcaggggatgctaacctggctttgggtaagggacagcctctgaatgacaggacattaaagccatggcctgcagtttaagtaggagttggccagttcgaggtaagaataccagtaagcaagaacgccagagtagctcctcgagctgccttctgtacctgacatccacactgaagccagcccctctgtgttcagccttgctttactgaagaggtgtcgctgaggggctgctctggggcgctgctctgctttcctgtccccaacttgttctgagctcgagccacctccatactggtgctcctggttctcaggcctttgaactcaaactgaatcacaccactggctttcctcgttctccagcttgcagatggcagattcgggaactt

SEQ ID NO: 16375 - DNA, 12141 bp, Human
gagggtcttgctagtctccggagacgccaaataggctcgagctccgcggcgatctcattttacgagttgatgaagaatcgtaagctaaaggatgggaaaagttgagagacagacggacggagagacagtgggccccggcgggaccgcacgcgttgaggggaacgccaaccgggaggcacggagactgctcacctgcccggcctggccgcggaggcccggcgccaagggcctcgcgctcggcctcccgccccctgcgcggcttcccgggctggcgccggcctccgctcccgcagagtggagttccgagcagaccgggctccgcgcgctccagcgtggaggggagcgggaggcttagcaggcggctcgggcaggcgggtcccccaagggcacgagacgcgctggttcccagcccaatggagctctgcgccccccagccccgcgctttacctgcgctgaggcctcggacagacaaacggacgccagacgcctaggcaggaggaggcctcagcctgagcccgcggccccttggcgctgccctgaactggcctgggagggggtgacgggggcgcgcccgcggagctgggcccagccgggcgcccccggagccgaggggaccgagggctttcctccctcctcggattattaaaaagttcatttcctggcgaatcgggtgacgtcaggggctcggcgtcgcggtggcggggccgcccggccggagaagccgcctccagttacccaattaccgactgtcaatcccgccgcccctcccccactctcccgggggtggccgggaccccagccctcctcctgcccccgacccacctgggggccctctggacatctaccccgggagcctcgggcccaacagggaagagggctggaggacgctgttgagtccccccagtactcggcacctgtctaggtcccccaaaatgcctttgtcctggacctccctcctcggcccggggctcccttcgagcctccgtctccccagtctgtacaatgggagggaggaagacttgtgcgcccggcccacacgaaccatagagccgatctccgggctagaagtgagtggggagcacttccaggtgacttagaagacggagacctcagaccaccgcctccccctcaccagaggccacctcggggaccccccccggaggaaaaaaaatgccacctcttgcccgggggcgtctccctccagctggcgccggcgccagtccgggtctccacggcctcgccccaggcaattgggcccgttggcctgcgaaggccacgcccggggaggggtgccccctccccctttctggagccaccggccgggccacctccactgggtcaagcacagccctgagcggccgcgtgtccgaggcccaggtgccctctagagccctgtagttcctgcccctctctgcccctctcggctcctgctgttccgccgctgtcgtccgaaccatcccaacccccagtccacccagacagcgcccgagctaggggagggaacggtctgggtaggtaactgcgctcggactgaccacgttcagcggtgaaggagcgtggcggggttagggtctcggggagaggccatccagagggtgtgcggcccgggctcctggggagggggcagttggtggttagttactgctagggaggcccagagcatcgagggatcccggagtgttcgcaagaggggctgcaggggtcgggccttggggtgagggtcccttagtggtggggcgcgttggcagcaggggccgccaggagcgcgcagggagggggcccgccggctgaggggggccggcccgcgggtcagtcccggagtccagcggttcgggaattgcggacgcagccaatgggaggcggaggctgggaggcgcgcggcgttgattggctggcttgggcttcttaggcgtgcgcggcccccgcttcatgtctgtgcaggagtcggcagctggcgccagggcggccggaggatgccgaggggccggagccgggcgggcccgaggccgaggcgcactctacccccagctcctaccctgtaagccccgccagcctccggacgtgctgtccctgggcccgtcgccctctgggctcccgccggaactccttcactctcagaggccgagtccctcccctccccacggctgcgtgtgtaagtttggggtttgagagccggctgggggcctggggcgctcctagctttgaggggactctggggggacttagggcggggggccaggctgcgggcgactgctttggtgtgctttgttgagaggtcctgattgtgccgcttagtactgcgctcagggggctgcgtgtgcatgttttcggggttgagatcagtatgtgtatctggcgccaagtgtgggtgtgtgcgtgtcgctgggatcaagtgccacactgggtgcccgggcgcctgtctccaacttttgagtctgtgttcatgtgtttgtctaccgggcgggggggctcagtgtgagtgtctgactgaagtgctgctctgtgcgtttgttggggtcactggtgtcgggacccgtccccgggcgtgaccccatgtgcacgggtgtgtgattctggagccgcgggtcaccacgtgagtgtgcgtggctgaaccccctcccccgccttcctttcgttttgagccttgggctttcctcccacccgggactggtgctctttctcgccggatctgggctggggctccgtggcgtgcgggacacctcgtggtgggactttggggggtgtcaggcgctggcggcacgcctcactcccccttcctcgcgcagggccgttgccgtctgcacccagaccctgagccgccgccgccggccatggaggtggcgccggagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacggtgagcactgggcccgtggtgatgagaacccaggcgccgcgcgccaggcgagggaggggaggagggcccgtctgcttgcttcccggatgtaggatccgcaggaatcgagctgctgaaaaattggggcgggagaggtgggagcagcggccgattggggagggtctgggacccacagggtttctgcccacttccagctggcctgtgagggttccctgtagggtctgtccggtggggttccttctatgccacttgtccttcagcttggactgacattcctgattattaccggtggggtattatgtttctggctttctttggggaggggatgactgctggttctgggagtcgtgatctcaatgtctgtcaggggcgtccctagctctgcctaccctgatctttctgcccaccctgatcctctctctctttgcccgcagcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcaggtaaaggcaggtgctggggacttcgtggaagaggggagcatttgcgtttttgtggtggggagctgtgacttgggagaggtggcagtgttggtttcccagatctggggatgggtgatgtctcgctctaatagcccccagcagatgtttgagacccccgggtcagggagaggagactctaaaacttttgccattttcttaagtgcttccagtgtacccccaaagttcagttccttgccccagggttggtcactgcctgaccagaacatagaacaggaattccccctttccctccctgaatcttaagtgaaaattcaagccacctcaggacttagtatgtgaagcgagggaagtgactctgtatgtgcatgtgtttgggagcgtgtgtgcatgtgtatacgtgtgtctgtgtgcatgttgtgtgtgcatgtttcaggcactccggaggttccagaccattaaggaatctgggtctctaactcaatcagtctgatcttgggatttcgatggctccctgatctcctcgggagattttccccagagcaaaattcccaggacctgctcctgctccctgccctcgccaggcccttccctctccctccctgagggctggagtgaggggatgaagctgcagtgcccccgccccttttcccgcagctggctggggccaaactgggtttgtccaagaatctggccacagagcataaacccagaaactcgtggctagtgtggagttcttgctgtccatgtctctttcccgaatccctttgagccacagagggggaaggtttttaaaacagttactcctgagtgcaggaaccaccttctcttgccagtctgtactcctcatttagtttaaactaaatcaagaacaacttcctggggaacacgatgccagccagtgatcctgctcaacttggtccccagccccagcccccgctggccccagcacccgctgagccccggctcagggtcctagttctgctcagacccgtcagcttgccttttcttggtcctttctcctgtttgttttgcattttatttgaattccagatggtcttttaattgaaaaaaaaaatacaaacaaaaaaaacccaggccacttatctaaaaaagaaagagcttattatttattttattttaaagaacaacaacttcgatccattatttccaggactcagaaaaattctagagctttggtggaagaggagaaaagttggggagaaagagggaaatgcttctggacttagagcagaaagacggggtggggcagacacagttgggtagaaaggagagggacaaaagaggagagggggagagacgcgccagagcgggaaggagagagcctcctgggcccagccaggttgagctgggtgactcctgccaccaccctaccctcggcaaagtttgcagtaaataccctcctggttgctccagaacgcctggggccctgggcccctcctcccctcctccttcgtttccatccctcctggtgaggattggaagcaggggatttggctttaaacgactctggacccgtgccccctcccatgtgggagaccctctagtccctcttcctgcccaggctgttgcagccaggcccaggccaaccgtgtgcctgagaggcaccggcactgctcggctggctgctttcctgccctggactccctcccgagaacttgccggttaagcaggcccccgtgtctctccctgttcccctgcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactggtaggagcgggcacaggtggctgggagggggctgctgggcaggagctggcggttaattacaggggaaaaaaactccttcaaatgcagacgctttgccgcttgaaatcctcttttatcatgaaaagcactgggatgtcagttggggtcgtctctctttctggccagattctttcgggccagatttcctcctcgggtatagggagcccaccgggcacccttgcgccaccccactctgctccgggatccccgaagttgagtgtccacgggccggactcctgtcctctggcctctgcttagctcttttttaaaaatagggccatgaagtacttttccttgtggctcagccctccccgacagccccgctcacaagctcctcgtgcttatttaaataaaacacaaactcacaccggccactaaaaaaacctgccctttattatttttccatggagtcacctatactgtgtattttcatttgagtgattttaaaaaaatgccctttcggatctcctgccggagtttcctatccggacatctgcagcctgaagataaggaaacttcgtgtatctgtttccggactctgcgagtttttagagtctcctcagctcagtcctgcctctcgctgggctgttttgaaatttctaataccctccactctgcaaataatgcgtaaaatgctaagaataataaatatattttttcagggcgaagtgatttatgaggcttaaatcgttccctgctttgggggcctttttttcccctggagcgagggcggggtgaggcccgggtgggggtagaggtggaggacgcggcgttggcccctgagtcagaattccagcttcaggctgcttactcacccctccctgcccccgcggctgcagtccctctgtcccttctgtgaccaggcttgggcctggggctgttccaggctctgcaggcctcagcccccagccccccacactcaccacctggtgcactcccgcctgcagttctctgggaagtgttgggggaccccctctgtcactgtggggctggcgttggtggaaccgggagaggggatctgttttcttgggtaaagcctccctctagcttctctctgcaaggaccaggcgctcatttccagaccctacctctgccaggcatttcctgagggactaggactcagaggggctgcggggtggttaaagctctaagggttggggtatggggggctggatgggggggatcagcactcacatcagctggagagatggaaaagttctgtgtctgcactgcccactgtggtagcccctggccacatgtgaatattgatcacttgaaatgtggctcgtgcaattgagggaactgggtttttaattttgttaatttgtagttagatcttatttaaatggctgcctgtggccagctgctacagtgttggacggtgcagctctgcactctgtaaacctgcgctggcctcagcgacactgactcacccaggattatggattttgagcggagtcgtgctagaggagacacagaatcggccccagatccaggggctcgagggggaccaagccggctcagcctcaggatgcctgtgctactagagagcccttctcagggcctcagtttccccatttatggagttagagcgcagggtagttgggggaggtagctaattctcctctgtagctcttgcaatcccgttgattctaacatcaggcttctgagagttctttattccaaagttctgtgagtcttgacttatttcgttctcaaattctaaaattccatggttctgagatgctttgattcccatgtgagatttagccctccttgactgagctggtggggactgggggtggagcgagggtcagggaggggggtcgaggtgggcgtgggagtccagcctgctgacgctgccttgccctcccagtcggccgccagaagagccggcacctgttgtgcaaattgtcagacgacaaccaccaccttatggcgccgaaacgccaacggggaccctgtctgcaacgcctgtggcctctactacaagctgcacaatgtgagtgcgccccgccccggccaccccgcccctcccaggggacctctgcgctttgtgctgccaggcaagaggccccagccacaatatccagcttggcttggcttgggaagctgctgccctgagtgagcgccagaagggcttcccgtaagaggggtgccttgcctctgctcaggaggtggagctggctaggacagggtctcgggctagggaagtggtttctctgcttaaaaagggtcagggtgggggggaggacttcagttggctgggcagtgctggcatgcggtgggcagagccagggagggtgtgggtcagccccatatgccagaacccgcccttcctggaatggtagccatctggtgatgggactatgaaggtcgggcacaattcctggcttcctgggaccctcagcttgacctgcctctggtccacgctgtggcggggtgggaggaatgttgctggaggaaggaactggccctctgaaaactggtggttgcctctaggttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaatgcccctggcctgtcttgtgggctcccagggtgctgggtcccgggtgtgaatttgggcagccagattgcattgcttttgtcgccggggtggctgcgaggggaaagcccctggaatccaggatggggcctctgttgggcctgggtctgattttgccactgacgtcctgaggctcctcccctgaactgctcccatctggatttcctgtcactgcaccaggggtcctagtgaatgggaagatactggggaggtgcagggaggccgtggtttctccagcctgtggtccacccctgagggctcaacgaggctcctgcaaaccccatctccatttgcttccttccaggtgctgaactttctctcagctctggtttctgagatatttggtcatcaatattcctgttcattggcaaacttgaccagcagtgtctgtgatcactgatgtcattgattgctgtcatctttgatcagtgatgttggtcatcaatgataggcaccatgactgatattccagatcaatgacatgtctgatcatgagagcctgccatcagagacacctgatgactaacaactgatcaccaatatttcatccatgcctctgcttaaccatgagtttgatcactgacacccacaaaatgtgatcacgaatgtctctagtgaccatctttgctcaccagtagtatgcctgatcatagtatctcttctcaccaatgtgttgatcgccaatgcgctttgtcactaatgttctagggcatcaataagtatgaccaccaatgtaattgataagtgttttttctggtgatagaccaatcactcacatgtaatctccagcatctctgatcacactgtttcttatcaccagtgtttctttaacaatgtccttggtcagttgtttctgatcaccattacttctaactagcaatgtgcctgatgaccaatgtccctgatcataggatcctctccccatcatatttcctatcaatgtagtcactagtgtttctggttctcaatacccctgattgctcaacactgatcatcaagatctcttatcaccaatgtctctgatgcccaacatcagtgattgctgaatcgtcttcaaagtctctgctgaccaatgttcccgttttccaaagtcccttatacctctgatcactgacctccctggtcattgatatccctggtcatcagaatacccagtcaccaatgtctctgatcaccaaattctctaatcattgatgtctctgctcactagtgcccttgatccctgatggtctgcatttggttctcttcaccaagatctctggaccccatgtctccagtcattgaatctggtcactaatatctcgtatacctttggccaccaaggacatggacacccaatactttccccactaatgctcccggtcattcacagccgaagccacccatgccccctgatcaatgattgatgacatatttgttcaatgataattctggttgccaagacccctgaacactggctcctgatggccagcatgtaacacacccctccctgaccaggttgtgtctgatggacatcatctctggctgacttcaccgtccctaattaaaaatcactctgattgtatgtccctggtcagccatggcttctcttcaccttagttgtcatcatctttgaccaccaggatctttattcaccaggggccctgaggactgggtatttctgattgc

SEQ ID NO: 16376 - DNA, 13634 bp, Human
ctagagaaggtggcgatgtgatttcccaggttctccgtgaagtagtcaagtattcaaactcctctatgcccttcttcctcttaccccttcattccctctatttctcctgcctctctcattgccattctttcttacattattttgcttccttcctcagttctccaggatcttcacctatttgtttattttgagatagcgtatgacttgtcacccagactgcagtgcagtggaatgtcatggctctctgcagcctcgacctcctgggctcaaataatcctctcacctcagcctcctaagtagctgggaccacaggtgcatgccaccacactcagctttttttttttttttttttttttttttgagacaagttatcactctgttgcccaggctagagtgtggagtgtggtggtggagtgtggtggtgatctcagctcactgcagcctcgacctcccaggctcaagtgatccttccacttcagcctctccccgagtagctgagactacaagtgcacaccaccacacctgcctaatattctgtatttttagtagagacagggttttgccatgttgcccaggctggtctcgaactcctgggatcaagcaatctgcccgccttgccctcccaaagtgctggggttacaagcctgagccactatgctttgccgaagattcccgtcttcccactgaaccttcctctttccttctcctgggccattcctgagccctggctgaggggagagaagggaaggaaagcccctcctgcggccatctcagcatccaaggcaatccttctggggctgctctgtctccagggccccagccatccccagacactgagtgcctgaggggggaccctcactcctgtggcactatggtaagataggaaacagtggcttctcctcaaagcagcctcgccggtcggtcagctgactaccaacatgggaagtggccgaagatccacatggaatgacactgataagcactttgcagtgtctgaaactcttaaacatcagtgctgtcttcctagttttacagacacaactctgtgggttggatgaggtttttctaaatgtacaaatgcagaaatatacggagggagtaaagggactgcctacaaatcacatctagagtgtggtgtacctgatttcaagtcttttattttattctcgcagcaacgggagaatccgcagtcgagggaggtgaaatgacttgctgaacgccacacggcggactccaagccccgagctcctataacagaggaggaggaaggcgggctcagctcctgccacccagcagcgggggagatgcagcccgggactaggctgggccatggggacagatccaggccccgccccctgaccttgttctctgcccgccgggaagtggggaacttgcggggagcagcctcagctagtccctggggcagagtctccacttgggtgcacgccctggggtggggcttcttcgggaagccgggggccttcaactctgctcaggagctcgggccggagaaaggccccgagacttgaagcccttgcccgggagggatgaacacgcaaaggaacccgaggaacggggtaggggaccaagagtaggaccagcttctcctgcgcggggacagggcctgtggagcggcctggaggaatctctcccagccgcgaagcccgggaaggctgcgaggccccagcgcggagcggcccctcccacctccccgagggcaggcggagcgaagcctcggggcccgggcccaggttttgtgcctacggaggctggacttccccgccaccccgaggagtcaccgagagccttctctccctcgcaggggccctgggaggcccgcgctttctctgaaagtggaaggagtgggcggggggcgcggccgaggcggggcgcgggcgtgcagcggcgcaggctccgccccggggccgtctccagccgggggcgccgagccgctccagtccccggcgcgccgcgggctggtgggctcagcggcggcgccggcactgggaaatgaccctgcccgggggcccaacgggcatggcgcggccggggggcgcgaggccctgcagcccggggctggagcgggccccgcgccggagtgtcggggagctgcgcctgctcttcgaggcgcgctgtgcggcggtcgctgcggccgccgccgcgggggagccccgggcccgcggggccaagcggcgtgggggacaggtccccaacgggcttccgcgggctcccccggccccggtgatccctcagctgaccgtgacagccgaggagcccgacgtgcccccgaccagccctgggccgccggagcgggagagggactgcctcccggcagcgggctcttcgcacctgcagcagccgcgccgcctttccacctcgtcggtctcctccactggctcctcgtcgctgctcgaggactcggaggacgacctgctgagcgacagtgagagccggagccgcggcaacgtgcagctggaagcgggcgaggacgtgggtcaggtacgggccgcgggggcggggccagcgccgggcgcgggggctgcacgggggacctggctgggtgctcccggaggacccgctcctgtccatgctccctccagcggaaggtcctgttctcgcggtttaggaggaatctgggggtcagagggaggcgcctggccgacctctcgcctgggcaactttcacctcggctccgccggcgggtcgtggcgctggccctggggcgtctaagaagcggggcgaggagcaggcgacccgccgcggggactgggcgaagcgggggtagcggaccttgttggctgtgggttaggacaggagggatcggaggggctgagccttgccgggtgaaccctcggaaggagagaggcgaaggagagtttcccttaccccccgccccctctccggtgccgcggccgcacccccgccgttgccacggtttccctctcctgagtgggagtggagcggcgctccaggctctgctcgggagccgctgccgtctgctcccagcgcccgcacgaggcgtggacgcaggggagggaggggcgtgggcctgggagctctggctgggagcggaacgcagcccacccagtgcgcgccctgcctcccatcttcccggctcgccgctcctgagcgcggcagagaggggcggtaaactgaggctgcaagggggcaggatcactctgctagtctctgcctctgatagcctgggtgttctgggaccaggtctgaccctcggaaaacacagccctgggcactgttaagtcattcctgacgcccgccacttagggatgtgcggctcccgggacaccctccttgttcccctcgttttaaccaaggccaaataccttgaataactgtccgtggtcagcgcgaaggactttctttagatccacgtttcgcaagtgtccctgaggccgaggaagaggcgaggggcgcccccggcctcgggcgtctggggcctgcccataagtccgggtcggcgcggcggggcggggagagctgtggccgcgcgcctgctccgccgcacaatcggctgggacaaggcagggaagctgtggcgacctgcaggggttcacaagcccggaggccgatggggtttgtcagtgacaccagaggggaaaagcctcacagagcaggaacaccccccgccgccaggtgctgggtgcgccggctcggtcactagcctgccgcttccccttcttccccggtggtcagagcagccccggacccaggatcgtttctggggtaacccttgcctaggtcggggggcggatgccggggcttcccaggatgtggagtgtggggcagtgagaggccccccgccccgcctcttcggaaaagcctgagcagcagctcccggggcgcggaagctctgacacctgagagccggtgcaggcgaaagggcgcgaagcgcgggcgcgtcccgcttccctcttccgcccgcagggactcggcgaagtgcctgggagagggagtgcgctaggaggaggtcctgcggcccaagcctgggtgtagagaccgccccggctaaggtcaagcctcggggacctgggcgaccccgccgccctccgagccgtcgggagccggtgcaaatcgccgctgagggcccttccagctccaaggctgcggcttccaggccttccccacccccaggcccgccggggcctccccgaagtcaaacagccacagcggcggcagataagccaggggctgttgacagaggctgcctgagtccgtgtggaagggcccagggcggactttgcctcgccgcaggtcccagagccgcacagcgcgccggcccaggccaatttagggcttccccaggcaggaagcaaggctggtccggctgaccgtgaaggatgcacgtgggccggactctaggactcccggcttaccagccccttacgcgcggcccaggcaggccggagcccaggaagtttctgcctgcctgcctgcctacctctctgcctggggcatacgtagtccccttcacctcctaggagccctctccagcctgcccagagcagggaaattgaaactgggcagcctcactccggcagaggaaaaagtcacaggcaggcttttcctaaccagccaggggagaagttggaggcccacccgcaaggtcagctgcatgactctatggccttgcctgcctcctcaaacaattgtggggtattgctggaggaaaagagagggtgtttggctcctgttcatctggttttcttctttctgtgctccaggataggtaaggagacctggatgccatcccctcctggactcagaattcccacacatcgctttccactaattatagagcagaatttaggttaacagacttcctttttaaacagctaatgcccatgggaaggtgaagtcgtgggtcacttataccttagtgcaaatcgttttataaatttaaactgattgctcttcccaccaccacgaccacagggagtgctagtttgatagggcaattggaacatggggagggtattgggctggtagagagcttcaaccagagcctggatgactggaggcagggagcaagggtgagtgccaaagacagagcactcacccacctgctggtctgctccagcagaagatacactgtgtatctggcatgagcaggtgtcttcaaggcttccgaatggagcttagacaaaggagggtctgaggctagtatccagccaagccctgcccagagagaggtactccctgttcagccctaggagtgaggaattatcagagggccctcctgtgacttcattaaagtctctcacacagtcagcaatcctagcctttgcctcaagatacccaggtagcctctggctgtgtgttagtctcccagagagggcaccttcatggagggaggcccgagccagaggatgttcaagcttctcccgggttcaagcgattctcctgcctcagcctcccgagtagctgggattacaggcacctaccaccacaccggctaagttttgtatttttaatagagatggggtttcaccatgttggccaggctgctctcgaactcctgacctcaagtgatgcatctgccttggcctcccaaagtgctgagattacaggtgtcagccaccgcgcctgggcttacattcatttttaaaagcgtgatgttctctgggggaggtatctccctaaggtggaaggtggcagtgatttgagttccatgacacttgcacaactcctgccatgcttggccatacccattactggcaggggggctaaatcctgtcatagcaacctcaggtggtaggacggaggactcagatgagataataggtatgaaaatcttttgtaggctgggagcagtggctcacacttgtaatcccagcactttgggagtccaaggcgggaggatcacttgaaccccggagttcgaggccagcctgggcaacatagcaaaatcctgtctctactaaaaatacaaaaaaaatgtcacggtggctcacacttgcaatcccagcactttaggaggccatggcaggtagatcacttgaggccaggagtttgagaccagcctggccaacatgatgaaaccccgtctctactaaaaatataaaaattagccaggcgttggtggtgcacgcctataatcccagctactcaggagactgaggcaggagaatcgctcaaacctggaagacagaggtagcagtgagccgagatcgcaccactcaaataaatatgtacatacatacatacaaaaatacaaaaaatcaaccaggcatggtgactcacatctgtagtcccagctactctggaggctgaggtgggaggatcacctgaaccctggaagtccaggatgcagttagctgtgatcgcaccactggactccagcctggacaatgggagtgagaccttgtctcaaaaaaaaaaaaaaaaaaaaagtattttgtaacctgctagctaggactggccttagttgctgctgctcttgattcttatgagatgcagaaaaccaaggtcaagagagtaggtgatgacaccattttacccctgcttgggagcaggtccatcaatcaaatggtagtagcccaggtttttagacacacatcaaatcctcttctgccaggcccacctgccagccctcctcactgtttctgcacagttctaaaaggatggttcagttccctcaccctgcctaacccaaggcaagtttcctcttcactaagtccattctggtcccactatcccctaaattcttctagcaggtccctacagccattaaactcattcttttggataaaggcaaaggtggccatccagtagagaagggcccccaggcaggtctcagtgttccccagaagtcaaaactcagactgccttattgctgcacatcacttcaccacgcacaaagcactttctcaggccacatcccatttaacccccaaagggaggcaggatggtagcatcctgctggggatactttggaacctgctggggcagttggaacttggggagggaggatgggctgatagcttcagccagagattgggaggctggaggcagggcatgaggggatgtaactccccttgatttccttctgtaaaatgggaatgataccacttcacgcacttgctatgcatgtgcattcattatggctctcaaactgagtgtgggagaagggggtacaggatggtgctgctgaatatacatggcacatacatcatcttcctggaattttacttgagggtttggaggtggtgagttttataataaaacttggatttattatgcagcagaatgcaaacctggtgtgtatttaaagattttaaaaggagttttgaaagtgatgtcatgcttctagtgggctgcttctggctacacccccagatccctggggattgggcacgtgatcacaccctagtgtgccatgtaagggcttcagtaggaaagtgggagcaatgctgcctgatggaagatgagaaagtgcctgacatgcaataggcaggtagcatttgatggttcgtgttacggcagcagctatgtcctcccaggggaaacaggcccacacagatggcagtacttggttgggttcactcagctggaaggtgacacagccatgactggaaccaactactgacttcccacccagtgctctaccataacttccatctcctccccatgggaaagggctttatggtcagcagccctcttctacttaggccacctcctcagttctctctctccctcttagaactccctcttgtcagggaggtgtattcctctgggggtacaacatgtgtaactgtgctaaaaggcaagtgcctctgtggggaggcggcagacacagttgacatgagccaacctgtgtacttcagagaggacacagggctgccgagttgcgggtggtaagaggagaggtccagaggatgggatgctctcaagattagctggaggctagaagagataaggggcacaccaaaaaaacaaaaacaaaaaacaaaaaacaaaaaacaaccctcgtctccttcccaggtttgtctaagttgacaggccctcaggtttgcaccttattttctttctttttcttttttttgagacggagtctcactctgctgccaggctagagtgcagtggctcgatcacagctcactgcaacctccacctcccagattcaagcgattctcctgcctcagcctcccaagtagctgggaccacaggcgcatgccaccatgtccggctaatttttgtatttttagtagagacggggtttcaccatgttggctaggatggtcttgatctcttgaccttgtgatccgcccacctcagtctcccaaagtgctgggattacaggcatgagccacctcgcccagcccggcatcttattttcatggcttaagatttctaggtccagataaaaaccaagggtgccctgggccttgccagctaatgagtgcatagaatccagggatagcaagagaggcttggagagccttttctttctccagccctgttctttctccaggccctgccaggctggccttcctgccctgggcctgtgtacaggtttgtttctgtgtatgtctgtctccctaaatgagaggaaccaaggtcctgagtgaaggaatcagtgattgagatttgttcagcttctgcctcataccatggaatgggatgggggagctgggcgcctatcatgcttaagccttatgtactactcacagcaacccagtaaggatagttatttcctcattttatagatctttttcttacagatgcacagaggcttgtttcttgggccctggaatcttttgaggcattggtagtaataaaaatttggggggccgggcctggtggctcacacctgtaatcccagcagtttgggaggctgaggtgggtggaacacctgagatcaggagttggagaccagcctgaccaatatggtgaaaccctgtctctactaaaaatacaaaaaattagccgggcatagtggtgtgcacctgtagtctcagctactcgggaggctgaaacaagagaaccgcctgaacccgggaggtagaggttgcagtgaggccagatcgcgccactgcactccagcctgggtgacagagcaagactccatctgaaaaaaaaaaaaaaaaaaaaaaaaatggccctactctagaccaacttagaacatccctgcggtaggcctgataatctgcaatttttaacaagggtgaccatcaggtaattccgatgttcacaacagttcaaaaacctcgacagagcattttcgtaacctgcccacgcgttcttcagtggcagagctggagcgcaaaccgggggcttcagatgctaagtccaggctcttgacagctcactggagacgctggaatcaccttcactgcgcctgtatcagcacccgccacacaggcgcacaaataaaccttcccagagtgaatgaatgaattaatgactcatccagccccagctgcttccggtgggtcgggggcgtggcgagaccctgtttcagtggagggagggcttatgcattgccgagacgccgattatcagaccttgaccctgtcgctttcagaaaaaccactggcagaagatccggaccatggtcaatctgccggtcataagccctttcaagaagcgctacgcctgggtgcagctggcagggcacactggtgagcagtggggcgggtgggcgggtgcccgcgacgggaaggggctgggcggcgctgacggatgccggtcctcagggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggtatgcgtgccctgccaggtcggttggggggatcaagtaggggtccggggccgggacagctgcttgagggggacccggggcgagtgctcgaaggggtctccgtgtgcgccccctcatgccctggccgctgcctgcgcccccacaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaaggtgaggcaggcgcgcttcgctggcaccgccgcagccccactgcgcgctgtctttcccgatcccccgctcccgccccgcctgcccctccgccctctcccaccgcctcgccgtcccctgcaactgggaggtaccgctgctctacgctgtcctcttccccactggcgggcccggggcccctgacactcctgtcccacatccagaaagcggacggctcctgcagcaccgacttcaagactacgcgaagccgagagcaggtgcttcgcgtctttgaagagtttgtgcaaggagatgaggaagtgctggtgagagcgggatcccaaaccctgaggtgttggggagcctgaagccgaggactgcccctgtcatctggcccagtgccctcggctgtgtccccaccatggccctcaccgcgctggctcgcaactgctctacgctccttcccttctgggccacgctgggcggggccctgggtcctcctcctggcggcatttgccaagcacagcgtgggtcccggctcctcatcgttagcaggggctcatttggcgtttagttaatttgccctcctctcccaccccaccctctgcagaggcggtatctgaaccgcctgcagcagatccgggacaccctggaggtatccgagttcttcaggaggcacgaggtaagcggcggctgcccgggtgcccgggccgcgagggctagggcgggaacccggcaagggcgtctctgggcagggccgcggcctgacggtgcggggctcgcaggtgatcggcagctcgctcctctttgtgcacgatcactgccatcgcgccggcgtgtggctcatcgacttcggcaagaccacgcccctccccgatggccagatcctggaccaccggcggccctgggaggagggcaaccgcgaggacggctatttgctggggctggacaatctcattggcatcctggccagcctggctgagagatgaggctggactcctgtccccgcgggccgctcacctgacatgtggacctgcagctttgtccccactgtgcatgccggcttgagactggagccccgcggtgcagggcagttcaccgggtcctgcaggaccaggtgccagccactaagggggggcaccgccgatgccaggggttttgcccacccgggccccagcgttcccagagccaaatgacactaacttatagaaggggagggggcaaagggcttcttcctcaggccagctcttctgaggaggctctgccctctccagaggtgccagaccgcggattttatttagcaagcccagaccttccggtctaacgtctcacaccacgacggactccccttcctaataaaactcaaagacaagatgcagcttcctgtgcctcaggcctcagcccctccctcctccggccccctcttcctcagttccggtccctggcatccacagatcgctggaggatgagaagagctttttattagaagcatctgcagggtggggggtctgcccagatgaaggatgctcataatgggagagcaatccagtgctccccatggacacctggggtgtgtgtaaggcggcctctggccccaagatcaaaagctggaagtggctgggcccttccctgggaggcctgggctggtttccagcatggcaagtgcagcgctgccaggccagccccgagacaggcccagacacacagcacagactgcagggaacagaggccgctggcataacaggccacccaggagcctgaggagtatagggagggaccctcagtgcctcagtccttaccctcagggccccttggggctcaggagcgataagtgggattccaaaggttctgaggttggaggcccctggatttgaggggcttgaggccagaggacagccaggggccaagagggctacctccccagcttttcaacttctctggactcagttcctggggctgtgggggtcttaggcactccaaagatctgttccccagcccagaagtcccttcctcctctggggtgggccccagctccattggcaggagtgaattcagcacatccgggtcctgtaatggaagagtcagggagcaggggggcatagagttttctggccctccctcctgacccacaagaccaggatgttagattaggtcgggggcacacctgagtgcagtactgcagacgctccaagatgctggcaaagctagggcggagctcaggctcgtgctgccaacactgggtcatgatgcggtacctggggagaggcaggagttcatgcccacccatggttgtgaaggacctcccttcccgggcagcactcaactcacacaggccctgggcagcccctaggagggtccatccggcctcctccaacgacgaagtccagcacctcctggttggtgcgcccaggatagggcatgtagcccagtgagaagatctcccagagcagcaccccaaaagacctgcatcacaagtgggggaaccaagtgaggcccgtcaggtgtagcctcccctcacatgaggttgctggaaaggacaggattagcctcaggggaggggaacagtggggaaggggaggggaagggtgttatcaccaggaatctgtcttggatgtgaagatgccctccaggaaggcctctgggggcatccacttgactgggagcaaggcccggtcccccctgcggtaataactggccctacaggagggaggaggtgaatgatgagttgttcaccaccaaggtgcggggaaaacccccttggagcaagagccttcccacctcccaagtcccgcaccggtagatatctcgtgccatcccaaagtccccaatcttggccactcggctgggtccagcgcagctcagcaggcagttccgggcggcaatatccctacagagtaggcaaaaaaaatcactgccagaatctagaagttcttgctcttcctgatctatttccttaaaagctgtgtggaagggctgttccttggggagggagttgggatgggggtcccctgagccaggactgctcctaacctgtggatgaagtgattttcctccaggtagtggcagccctgggctatgtcctgggccagttgcagcaggtcccgcatgaccagaggtgatggctggccctgggtcaggcagagggggcatcagtccatgtaggtctcagacacatggacagggtctttagaggggcctggggggggctaagacaagggtctcaccaggtgtggccgactgtgcctcaggaaactcttcatgtcccctccagacatcagttccagcagaatgaggcgaggggtggccctgaggctgagccccacacaccgcacaatgttctgatggcgaaacttgctgagtggggtgggggacata

SEQ ID NO: 16377 - DNA, 24804 bp, Human
tgagataagttttatgaaataaaaagattaaaaattcttacatttttagtgtccttccttggtaaaatgtagagttgtccactgtgtttatctcctcctccttattatcatggttgctgttattatttttaatggttcattaaacccaagggtctgggaaatactcatggaattcatctcacagccttcacactgtatgatatttaaacaggtggttgtccatctgattcttaaaatatttccaagaaaaatgattccacctaatgcataaatgctttcatcagattaagagaacaccatggacattttattttattttattttttaaatattaacttccattgcataagctaaatgggtaggaataagtgagatgatattgttatctagagctttaaaatattcaaagggctgtcatcattatctcatttaatctttgaaaacaactctatgaagtacaaaggacactgagacatttgttgctctatatcaaagaaaaaagtgtttgtcccaaaacttcaaaatgtgtaaattacacattctgcatctttacagctggagaaaattcactggcaatggaatatttaaaattagagcttgcttagtgtgctgcttctgatcactacttgatcccacttcgtgctttcatgttaattggcccaattggactctacagttggaaggtgaaaacttactatttcaacttgagtcacgtatgtattcttatcatatacttcttaaaggtactattttttttcttctgatagtcaccacaccaagcacttccagccaccctgccacagacttcctttgtaatcactgttgaaggacatgatgtttttatgacttcccgaaatgaaaaccctatcttgtttttaaaacaaacaaaccaacaaaaagtagtgtttatgtaagcattttgttccctgactctaggaacccctctgtttttatatcaactctgtactggcaaaacacaaaaacaaaatgccaccttgctaattcccttcctagcaaagtaatacagtttagcacatgttcaagaaaaaaatggctaagaaattttgtttccactaattattttcaagactgtgatatttacactctgctcttcaaacgttacattttataagactattttttaacatgttgaacataagccctaaatatatgtatccttaaattgtatttcaaatattttaggtcagtctttgctatcattccaggaatagaaagttttaacactggaaactgcaagtaaatatttgccctcttacctgaattttggtatccctctccccaagcttactttctgttgcagaaagtgtaaaaattattaaataaaattctaatgatggtatccgtgtggcttgcatctgatacagcagataaagaagttttatgaaaatggactcctgttccactgaaaagtaaatcttaatggcctgtatcaactatcctttgacaccatattgagcttgggaggaaggggaagtcctgaatgaggttataaagtaaaagaaaatatttgcaaaatgttcctttttttaaaatgttacattttagaaatattttaagtgttgtaacattgtaggaattaccccaataggactgattattccgcattgtaaaataagaaaaagttttgtgctgaagtgtgaccaggaagtctgaaaatgaagagagacagatgacaaaagaagatgcttctaatggactaaggaggtgctttcttaaagtcagaaagagatactcagaaagaggtacaggttttggaaggcacagagccccaacttttacggaagaaaagatttcatgaaaatagtgatattacattaaaagaagtactcgtatcctctgccactttatttcgacttccattgccctaggaaagagcctgtttgaaggcgggcccaaggagtgccgacagcagtctcctccctccaccttcttcctcattctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggtaagaaatatcattcctctttatttggaaagtcagccatggcaattagaggtaaataagctagaaagcaattgagaggaatataaaccatctagcatcactacgatgagcagtcagtatcaacataagaaatataagcaaagtcagagtagaatttttttcttttatcagatatgggagagtatcactttagaggagaggttctcaaactttttgctctcatgttccctttacactaagcacatcacatgttagcataagtaacatttttaattaaaaataactatgtacttttttaacaacaaaaaaaaagcataaagagtgacacttttttatttttacaagtgttttaactggtttaatagaagccatatagatctgctggattctcatctgctttgcattcagactattgcaatattgcacagaatgtagcctctggtaaactctgttgtacactcatgagagaatgagtgaaaaagacaaattacgtcttagaattattagaaatagctttcactttaggaactccctgagaattgctgctttagagtggtaaaataaataagcttctctttaaacggaatctcaagacagaatcagttacattaaaagcaaacaaaaaatttgcccatggttagtcatcttgtgaaatctgccacacctttggactgggctacaattggataatatagcattccccgagataattttctttcacaattaaggaaagggctgaataaatatctctgtttgaagttgaataacaaaaattaggaccccctaaattttaggactcctgaaattcgtctttttgcctatattcagctactttacgttctattaaatcttctttcaggccaggtgcactagctcatgcctagaatctcaggcaggcctgagcccaggaatttgagaccagccagggcaacacagtctctacaaaaaaataaaaaattacctgggtgtgttggtgcatgcctgtagaactactcaggatgctgaggactgcttgagcccaggatagccaaatctgtggtgagttcagccactaaacagagcgagactttctcaaaaaaacaaacaaaaaaacaaacaaacttccttcaaaataactttttatctgcaatgttttcctattgcctgtgagattaaatttactcttttacctgatttccaaagccctccataatctaatccgactttaccttgtgttcactgcaaaatagcaggactgttccactacaatccaaaaatcacaggttgggtgcagtggctcactcctgtaatcccaacactttggaaggccaaggcaggtggattgcttcagctcaggagttcaagaccagcctgggcaacatggcaaaaaccctgtctctccaaaacatacaaaaattagccagatgtggtagtatgtgcctgtagtcccaactactcaaaaggctaaggcaagaggatcacttgagcccaggaggtcaaggctacagtgagccatgtttgctgtgtcactgcactccagcctgggtgatagagcaagaccatgtctcaaaaaaaaaaaaaaaaagaaaagaaaagaaaaaaacatcgctctattcagttcacccccaccacaacattgttttgattatcacataaatgctggtccattgccttctctatctattcaaatctttaagcattctttgagattcaactcaattctccttttcaaactaggccatttaaactacatcagttccattttgatttttttgctttgagtctacagactcaaaaacaaaaacttaaaaacttattttttaagttttctgctactctcacctcttcaacactcacatacacgcattcataataagatggcagaatgttcaaggataaaatgatttatagaactgaaaagttaggttttgatcttgttgctgtcaagatgactacctacctgatctcaggtaattaattatgtagcatgctccctcatttcatcccatacctattcaacaggattggaattccacagcaaggataaacataatcatagttgcttttcaagttcaaggcattttaacttttaatctagtagtatgtttgttgttgttgttgttgtttgagatggagccctgctgtgtcacccaggctggagtgcagtggcacgaactcggctcactgcaacctctgcctcatgggttcaatcagttattctgcctcagtgtcccaagtagctgggactacaaggcacatgccaccatgcctggctaatttttgtatttttagtagaaacagggtttcaccatgttggccaggctggtctcgaactcctgacctcaagtgatccagccgcctcggcctcccaaagtgctgggattacaggcataagccaccgtgcccagcctaatagtatgtttttaaactcttagtggcttaacaatgctggttgtataataaatatgccataaatatttactgtcttagaattatgaagaagtggttactaggccgtttgccacatatcaatggttctctccttacagctttaactagagtctagaattgcaggttggtagagctggaacagaccttaaagattgactagccaacttccttgtccaaatgagggaactgagacccttaaaattaagtgacttgccccagacaaaactggaactcatgtgtcctaatttccatcatgaaattctaccattcactagcctctggctagttgtcaaagtattgcataactaaatttttatgtctgttttaaagaacaaattgtcactgcttactcctgggaggatctttctgaggtggtttataactcttaaaaaaaaaaaaagtcagtagtctgagaattttagatgaaatagtcaaagcatttttatccaatggatactataattttcatagattagagttaaagcaaagaaacacggatgagaaaggaagaggaaaattgaggagaggaggaatggggatgagaacacactacttgtaatcagtcatagatgtattgagaactaacaagaagaattgtaagaaaataagaatgaagaattcaaaatcaacacatgaaataaaaaagaaactactagggaaaaatggagaagacattagaaaaattattctatttttaaaattctgttttcaggcttccctcctgttcttcctccttctcattggctttcaggtggagggaaagtttaagatagaaaaaatatatatattctacacatccctttctacgctgttgtcatggcaacaaggtttatcatagcaaacttttattcatacaacatttattgagttcttactgtgtggtaagctctttccaggtgttgaaaattcaggggaaaaaagacaactcattgtcttaaaactcagatgaaagctgaacagacctatttttaatcaaagtaatctcaatttagggtagtaagagctatttaagaagcatgaacaggtgtgaaggaggtaggactctgaggagagaataattagctaggaatgaaagagcagagaagttttcctagaggaactattaaagctgggagttacgggatgaaagatgaggcagggtttgcaggcaaaaaaaaaaaaaaaggcaggggaaggggaagttctggcctggcagagagaataactgtggcaacaatggaggagagtctggaagcaagaaaaccaagtagaagagtattaaaatagaagatgccaggggtaatgagggcttgatttaaaacagtgctgttggagatggagaggagataccaaattctggagacatttctgagttagaatctacagtatttatcagacaagggaaagattagacaaaggagttaagaatgactcccaggtttcagtttggggcaggtaactaggacatgttttgaaaagtaatgtattagatctcttaccattggaactatgtatgtggagccaaattaaaatttgtacatgtatataactctccccccaccaccagtaactacttccctaactctctactttgtagccagacttcctaaaagaatagtttgtagtcactgtctttacttttcccctcccattctgtcctagatatttgtccacctaccatctgctgcctccactttacccaaactgttctacggttgcccaaaacttcctaattgccaaattcaatgaacaagtttaagcttatatgtaaattaggagctctacagtttgatttcgagcagcccctcctgaaaccctttctcttttgacttctgtgacacatctcagatttacaaaactgaactaattattttacacttgagctgtattttcgttcttttttcttaatgaatgaggtaaccactcaacaaattgcccaagccaaaaactacgaagtcatcctcagttcctccttcttctgtttgacccacaacagatcagctgagaaatcccgctgtttagtatctcttgaattcattaccttaatttatagcctcatcaactcttaattgttaaaattacttcagtagttgttgtctgacctctgtccaatcttgttcaatcaggtccattcttttgttcttggtggtggtggtggtgttgacagagtttcgcttttgctgcccaggctgaagtgcagtggagcacttcactgcaaccacagcctcctgggtttaagcagttcaccctcccgagtagctgggactacaggtatgtgccaccacacccagctaattttgtgttttcagtagagacagggtttcaccatgttggtcaggctggtctcaaactcctgacctcaagcaatccacccacctcagcctcccaaagtgctgggattacaggcatgagccactgcacacggaccagatccattgtttatgttgcttctagagtgagtttttaaaacacaaatttgaccatatctttctcctatttaagtcagtattttttttttcaggaaaaaacagttcaaactctttagtctgcttacacaaggcctttgtagtctgactcttctttccaagctttcatcaaagtatactgcaagttgcattttatgtgaattgaattaggcaacggtataaaaattatagtttatatgggcaaaatggaaataatgttaactcttccaaatagtttatctagaatgacataatttcaaagctgtcaggtcaaatgagttataaactgttaacactattgccacatgcaagtgtctcttatacttggtagaattatctgcttccatgtcattattatgtaaattagactttaaataactcagaagttcttcagacatacaggttattattgtgctttttaaacataattttaaataattttatatatgataatgttatccaagtgctaagggatgtattgttactgctgtgcaaaaaaaaaaaaactccaaataaatatgttgaaaccaagtttatatgcaagaaaacaatattaaaaaggccaaagtaccaccataataggctgtgtggagacagcaggctacaaaacactagtaataatgctgagaaagttgaaaaaagaaagaaagcaacaatatgctttggttgttgtaggtttatgtactccaagaatatctcctctcaaacttttacgttttttccaaagaaaagttaactttggctgggcgcagtggctcttgcctgtagtcccagcctttgggaggccaaggcgggcagatcacctgaggtcaggagtttgagaccagcctgaccaacatggagaaacccgcccccctcactactaaaagaatacaaaattaggccgggcacagtggcttacccctgtaatcccagcactttgggaggccgaagcaggaagatcacctgaggtcaggagttcgagaccagccatggagaaacccgtctctactaaaaatacaaaattagccgggcgtggtggtgcatgactgtaatcccagctactcaggaggctaaggcagagaatcacttgaacccaggcagtggaggttgcagtgagccgagatcgtgccattgcactccagcctgggcaacaagagcgaaactctgtatccaaaaaacaaaagaaaagaaaaggtaaccttgaactatgtgagatctttagaaatgcattctttctgtaaaatgtgactacatttgccttatttatggtaaaaatgttgaggcctcaaacaacccatattttctcggtctccccgctgcctagcctttgttcacattgcttcttcttggtggaagctcttcctctggccttgaaaatgcctgcttctctttcaaggtagcacagtcatcactttctgtggtaaccttctccagcaccatcaaacagaaagaatgaatctcttgtaaattcagctcttacgtcattcattacattattttgtaactctttatagattcttctctcccactagactctgagtcactggagagtaggagccaactctcattcatgtgtggtttggtcagctactggccacattcctgatgcatagttaatgctcaaaccttaactggtgaatcagctcaaatattgtccttctctaaatccattcactcattgactaactatgtactcaaaatagtaaacaccagtaatttaatccaattcctgcccatactgcttggtacatttcaggtgaattagtttgataaatatgtgtgtattacataatattaaagtatgtacagaagatcatgctaatcattatttcaccaactgataactaatcaaaacatagagtgcctctcaggttaacaaatgtctgccttctcagttaatgcagtcattaacaaacaccttctgatgctgataatagggccttgttcagcaatgaagccataaaggtgaataaagaacatgccctcgtggagctcacagcctagtcattattgttctgatttttaatattaatgttggtttgggttttggtgaaaaatgtttagacttatcttagtgatcttttcatcctttgctatattatttttctctaagagtcttccttatcccctcctttaaaaaactaggtgataattctaaattgtaaatttaaatattataaatagcttataaaatttaatatttataatatttaaatgtttgataaatatttaaattttataatatttaaatgtttatttaaattcatttgtacatcagtttttattttatttaaatgtgttggccaggcatggtggctgacacctataatcccagaactttgagaggccaagtcaggcaaaccatttgagctcaggagtttgagaccaccctgggcaacgtggtgaaaccctgtctctaccaaacatatgaaaacttatctgggtgtggtggcacgcatctgtggtcccagatgggagtcccaggctaagatgggagaatcgcttgaacccaggtgagaggggtggggtggatgttgcagtgagctgagatcgtgccactgcactccaacctgggtgacagagtgagactccatctcaaaaaaaaaaaatgttatctaaataagataaatttaataactgttcgcacttagatgagcataaggaactaaacctagataaaactatcaaataaggcctgggtacagtgactcatgcctgtaatctcaagcactttgggaggccaaaattatacaaagttagttgtataacaccaactaacaactattttggggttagcttaattcagattaattttttttaaactgagttttaaattcctgcttactctaccatacatgctaggcctcatattatgctagaaaaattttgagcacagatttatgaatactctcctgcataccatttaatttttaaacaaattttaatgcagtatatatgtgcctttttaccaacacattaaataataagatctactgtgaggactaaacttctgtaatttcaaagtagtaatgagtttaaaccatgtctcaagatctctgcaataactgtagcacaacagaaaataggtatttctattaatgacagagtcacaagtactactaataatactgtggtttgtttcctgcaactaatcatgggaggaatgctaaatttcagaggttggtgaaaatacatgtgtatttttttccccatccaagttcacagatttctcacactgagaactcctattccataacaaaattctggaagcctgcacaccgtattggaagaggggcagaaaggaaaagcaaatggaaggatttaaatttttttcaaatcctgtatcccttgattttacagcaagattgtatttatgtattacttgtgttaaaaatatagtataatcgagactccagatcaaaaatcaccgcagctcagggagaaagagggccaccaaatgccagagcccttcagccttctcccaccctgcctgtaccctcagatggaagcacttttttatcattgtttcacctttagcattttgacaatgaagtcacaaaccttcagcctctcacccataggaacccactggttgtaagagaaggatgaagccagtccttcctaaagggcacgattagatgtgtttatggcatcctcaggtgaaactatatttatattgacaatatatttatatttctcaaggaatactagaataatgattcagttcagtactaggccatttatctaccctttataatattgtttaatgagaaaatgctttctatcttccaaatatctgatgatttgtaagagaacacttaaacatgggtattcataagctgaaacttctggcatttattgaatgtcaagattgttcatcagtatactaggtgattaactgaccactgaacttgaaggtagtataaagtagtagtaaaaggtacaatcattgtctcttaacagatggctctttgctttcattaggaataaagatggctgctgaaccagtagaagacaattgcatcaactttgtggcaatgaaatttattgacaatacgctttactttataggtaaggctaatgccatagaacaaataccaggttcagataaatctattcaattagaaaagatgttgtgaggtgaactattaagtgactctttttgtcaccaaatttcactgtaatattaatggctcttaaaaaaatagtggacctctagaaattaaccacaacatgtccaaggtctcagcaccttgtcacaccacgtgtcctggcactttaatcagcagtagctcactctccagttggcagtaagtgcacatcatgaaaatcccagttttcatgggaaaatcccagttttcattggatttccatgggaaaaatcccagtacaaaactgggtgcattcaggaaatacaatttcccaaagcaaattggcaaattatgtaagagattctctaaatttagagttctgtgaattacaccattttatgtaaatatgtttgacaagtaaaaattgattcttttttttttttttctgttgcccaggctggagtgcagtggcacaatctctgctcactgcaacctccacctcctgggttcaagcaattctcctgcctcagccttctgagtagctgggactacaggtgcatcccaccatgcctggctaattttttgtatttttactagagacagggttttgccatgttgtccaggctggtcttgaactcctgatctcagatgatcctcctgcctcggcctcccaaagtgctgggattacaggcatgaaccaccacacatggcctaaaaattgattcttatgattaatcttctgtgaacaatttggcttcatttgaaagtttgccttcatttgaaaccttcatttaaaagcctgagcaacaaagtgagaccccatctctacaaaaaactgcaaaatatcctgtggacacctcctaccttctttggaggctgaagcaggaggatcacttgagcctaggaatttgagcctgcagtgagctatgatcccacccctacactccagcctgcatgacagtagaccctgacacacacacacaaaaaaaaaccttcataaaaaattattagttgacttttcttaggtgactttccgtttaagcaataaatttaaaagtaaaatctctaattttataaaatttatttttagttacatattgaaatttttaaaccctaggtttaagttttatgtctaaattacctgagaacacactaagtctgataagcttcattttatgggccttttggatgattatataatattctgatgaaagccaagacagacccttaaaccataaaaataggagttcgagaaagaggagtagcaaaagtaaaagctagaatgagattgaattctgagtcgaaatacaaaattttacatattctgtttctctctttttccccctcttagctgaagatgatggtaaagtagaaatgaatttatttttctttgcaaactaagtatctgcttgagacacatctatctcaccattgtcagctgaggaaaaaaaaaaatggttctcatgctaccaatctgccttcaaagaaatgtggactcagtagcacagctttggaatgaagatgatcataagagatacaaagaagaacctctagcaaaagatgcttctctatgccttaaaaaattctccagctcttagaatctacaaaatagactttgcctgtttcataggtcctaagattagcatgaagtcatggattctgttgtagggggagcgttgcataggaaaaagggattgaagcattagaattgtccaaaatcagtaacacctcctctcagaaatgctttgggaagaagcctggaaggttccgggttggtggtggggtggggcagaaaattctggaagtagaggagataggaatgggtggggcaagaagaccacattcagaggccaaaagctgaaagaaaccatggcatttatgatgaattcagggtaattcagaatggaagtagagtaggagtaggagactggtgagagaagctagagtgataaacagggtgtagagcaagacgttctctcaccccaagatgtgaaatttggactttatcttggagataatagggttaattaagcacaatatgtattagctagggtaaagattagtttgttgtaacaaagacatccaaagatacagtagctgaataagatagagaatttttctctcaaagaaagtctaagtaggcagctcagaagtagtatggctggaagcaacctgatgatattgggacccccaactttcttcagtcttgtacccatcatcccctagttgttgatctcactcacatagttgaaaatcatcatacttcctgggttcatatcccagttatcaagaaagggtcaagagaagtcaggctcattcctttcaaagactctaattggaagttaaacacatcaatccccctcatattccattgactagaatttaatcacatggccacaccaagtgcaaggaaatctggaaaatataatctttattccaggtagccatatgactctttaaaattcagaaataatatatttttaaaatatcattctggctttggtataaagaattgatggtgtggggtgaggaggacaaaattaagggttgagaggctattattttagttattacaagaaatgatggtgtcatgaattaaggtagacataggggagtgctgatgaggagctgtgaatggattttagaaacacttgagagaatcaataggacatgatttagggttggatttggaaaggagaagaaagtagaaaagatgatgcctacatttttcacttaggcaatttgtaccattcagtgaaataggaaacacaggaggaagagcaggttttggtgtatacaaagaggaggatggatgacgcatttcgttttggatctgagatgtctgtggaacgtcctagtggagatgtccaaaaactcttctacatgtggttctgagttcaggacaaagatttgggctggagatagagatattgaaggcttatgcatagaaatggcatttgaatctatagagataaaaagacaaatcagaggaaatgtgtaaagtgagagaggaaaagccaagtactgaactggggggaatacctacatttaaaggatgcagtagaaagaagctaataaacaacagagagcagactaaccaaaagggaagaagaaaaaccaagagaattccaccgactcccaggagagcatttcaagattgaggggataggtgttgtgttgaattttgcagccttgagaatcaagggccagaacacagcttttagatttagcaacaaggagtttggtgatctcagtgaaagcagcttgatggtgaaatggaggcagaggcagattgcaatgagtgaaacagtgaatggaaagtgaagaaatgatacagataattcttgctaaaagcttggctgttaaaaggaggagagaaacaagactagctgcaaagtgagattgggttgatggagcagttttaaatctcaaaataaagagctttgtgcttttttgattatgaaaataatgtgttaattgtaactaattgaggcaatgaaaaaagataataatatgaaagataaaaatataaaaaccacccagaaataatgatagctaccattttgatacaatatttctacactcctttctatgtatatatacagacacagaaatgcttatatttttattaaaagggattgtactatacctaagctgctttttctagttagtgatatatatggacatctctccatggcaacgagtaattgcagttatattaagttcatgatatttcacaataagggcatatctttgccctttttatttaatcaattcttaattggtgaatgtttgtttccagtttgttgttgttattaacaatgttcccataagcattcctgtacaaaaatgttcacacatttgtctgattttttcttcaggataaaacccaggaggtagaattgctgggttgatagaagagaaaggatgattggcaaattaaagcttcagtagagggtacatgccgagcacaaatgggatcagccctagataccagaaatggcactttctcatttccccttgggacaaaagggagagaggcaataactggtgctgccagagttaaatttgtacgtggagtagcaggaaatcatttgctgaaaatgaaaacagagatgatggtgtagaggtcctgaagagagcaaagaaaatttgaaattgcggctatcagctatggaagagagtgctgaactggaaaacaaaagaagtattgacaattggtatgcttgtaatggcaccgatttgaacgcttgtgccattgttcaccagcagcactcagcagccaagtttggagttttgtagcagaaagacaaataagttagggatttaatatcctggcaaaatggtagacaaaatgaactctgagatccagctgcacagggaaggaagggaagacgggaagaggttagataggaaatacaagagtcaggagactggaagatgttgtgaaatttaagaacacatagagttggagtaaaagtgtaagaaaactagaagggtaagagaccggtcagaaagtaggctatttgaagttaacacttcagaggcagagtagttctgaatggtaacaagaaattgagtgtgcctttgagagtaggttaaaaaacaataggcaactttattgtagctacttctggaacagaagattgtcattaatagttttagaaaactaaaatatatagcatacttatttgtcaattaacaaagaaactatgtatttttaaatgagatttaatgtttattgtagaaaacctggaatccgattactttggcaagcttgaatctaaattatcagtcataagaaatttgaatgaccaagttctcttcattgaccaaggaaatcggcctctatttgaagatatgactgattctgactgtagaggtattttttttaattcgcaaacatagaaatgactagctacttcttcccattctgttttactgcttacattgttccgtgctagtcccaatcctcagatgaaaagtcacaggagtgacaataatttcacttacaggaaactttataaggcatccacgttttttagttggggtaaaaaattggatacaataagacattgctaggggtcatgcctctctgagcctgcctttgaatcaccaatccctttattgtgattgcattaactgtttaaaacctctatagttggatgcttaatccctgcttgttacagctgaaaatgctgatagtttaccaggtgtggtggcatctatctgtaatcctagctacttgggaggctcaagcaggaggattgcttgaggccaggactttgaggctgtagtacactgtgatcgtacctgtgaatagccactgcactccagcctgggtgatatacagaccttgtctctaaaattaaaaaaaaaaaaaaaaaaaaaaaacttaagaaaagaaaatgatcaagtctactgtgccttccaaaatatgaattccaaatatcaaagttaggctgagttgaagcagtgaatgtgcattctttaaaaatactgaatacttaccttaacatatattttaaatattttatttagcatttaaaagttaaaaacaatcttttagaattcatatctttaaaatactcaaaaaagttgcagcgtgtgtgttgtaatacacattaaactgtggggttgtttgtttgtttgagatgcagtttcactctgtcacccaggctgaagtgcagtgcagtgcagtggtgtgatctcggctcactacaacctccacctcccacgttcaagcgattctcatgcctcagtctcccgagtaggtgggattacaggcatgcaccacttacacccggctaatttttgtatttttagtagagctggggtttcaccatgttggccaggctggtctcaaacccctaacctcaagtgatctgcctgcctcagcctcccaaacaaacaaacaaccccacagtttaatatgtgttacaacacacatgctgcaacttttatgagtataatgatatagattataaaaggttgtttttaacttttaaatgctgggattacaggcatgagccactgtgccaggcctgaactgtgtttttaaaaatgtctgaccagctgtacatagtctcctgcagactggccaagtctcaaagtgggaacaggtgtattaaggactatcctttggttaaatttccgcaaatgttcctgtgcaagaattcttctaactagagttctcatttattatatttatttcagataatgcaccccggaccatatttattataagtatgtataaagatagccagcctagaggtatggctgtaactatctctgtgaagtgtgagaaaatttcaactctctcctgtgagaacaaaattatttcctttaaggtaagactgagccttactttgttttcaatcatgttaatataattaatataattagaaatataacattatttctaatgttaatataagtaatgtaattagaaaactcaaatatcctcagaccaaccttttgtctagaacagaaataacaagaagcagagaaccattaaaatgaatacttactaaaaattatcaaactctttacctattgtgataatgatggtttttctgagcctgtcacagggaagaggagatacaacacttgttttatgacctgcatctcctgaacaatcagtctttatacaaataataatgtagaatacatatgtgagttatacatttaagaataacatgtgactttccagaatgagttctgctatgaagaatgaagctaattatccttctatatttctacacctttgtaaattatgataatattttaatccctagttgttttgttgctgatccttagcctaagtcttagacacaagcttcagcttccagttgatgtatgttatttttaatgttaatctaattgaataaaagttatgagatcagctgtaaaagtaatgctataattatcttcaagccaggtataaagtatttctggcctctactttttctctattattctccattattattctctattatttttctctatttcctccattattgttagataaaccacaattaactatagctacagactgagccagtaagagtagccagggatgcttacaaattggcaatgcttcagaggagaattccatgtcatgaagactctttttgagtggagatttgccaataaataaccgctttcatgcccacccagtccccactgaaagacagttaggatatgaccttagtgaaggtaccaaggggcaacttggtagggagaaaaaagccactctaaaatataatccaagtaagaacagtgcatatgcaacagatacagcccccagacaaatccctcagctatctccctccaaccagagtgccaccccttcaggtgacaatttggagtccccattctagacctgacaggcagcttagttatcaaaatagcataagaggcctgggatggaagggtagggtggaaagggttaagcatgctgttactgaacaacataattagaagggaaggagatggccaagctcaagctatgtgggatagaggaaaactcagctgcagaggcagattcagaaactgggataagtccgaacctacaggtggattcttgttgagggagactggtgaaaatgttaagaagatggaaataatgcttggcacttagtaggaactgggcaaatccatatttgggggagcctgaagtttattcaattttgatggcccttttaaagaaaaagaatgtggctgggcgtggtggctcacacctgtaatcccagcactttgggaggccgaggggggcggatcacctgaagtcaggagttcaagaccagcctgaccaacatggagaaaccccatctctactaaaaatacaaaattagctgggcgtggtggcatatgcctgtaatcccagctactcgggaggctgaggcaggagaatcttttgaacccgggaggcagaggttgcgatgagcctagatcgtgccattgcactccagcctgggcaacaagagcaaaactcggtctcaaaaaaaaaaaaaaaaaagtgaaattaccaaaggcataagcttaataatttaattcaaattttaaaaagggcggggggtggctggaagagatctgtgcaaatgagggaatctgacatttaagcttcatcagcatcatagcaaatctgcttctggaaggaactcaataaatattagttggagggggggagagagtgaggggtggactaggaccagttttagcccttgtctttaatcccttttcctgccactaataaggatcttagcagtggttataaaagtggcctaggttctagataataagatacaacaggccaggcacagtggctcatgcctataatcccagcactttgggagggcaaggcgagtgtctcacttgagatcaggagttcaagaccagcctggccagcatggcgatactctgtctctactaaaaaaaatacaaaaattagccaggcatggtggcatgcacctgtaatcccagctactcgtgagcctgaggcagaagaatcgcttgaaaccaggaggtgtaggctgcagtgagctgagatcgcaccactgcactccagcctgggcgacagaatgagactttgtctcaaaaaaagaaaaagatacaacaggctacccttatgtgctcacctttcactgttgattactagctataaagtcctataaagttctttggtcaagaaccttgacaacactaagagggatttgctttgagaggttactgtcagtgtctgtttcatatatatacatatacatgtatatatgtatctatatccaggcttggccagggttccctcagactttccagtgcacttgggagatgttaggtcaatatcaactttccctggattcagattcaaccccttctgatgtaaaaaaaaaaaaaaaaaaaagaaagaaatccctttccccttggagcactcaagtttcaccaggtagggctttccaagttgggggttctccaaggtcattgggattgctttcacatccatttgctatgtaccttccctatgatggctgggagtggtcaacatcaaaactaggaaagctactgcccaaggatgtccttacctctattctgaaatgtgcaataagtgtgattaaagagattgcctgttctacctatccacactctcgctttcaactgtaactttctttttttctttttttctttttttctttttttttgaaacggagtctcgctctgtcgcccaggctagagtgcagtggcacgatctcagctcactgcaagctctgcctcccgggttcacgccattctcctgcctcaccctcccaagcagctgggactacaggcgcctgccaccatgcccagctaattttttgtatttttagtagagacggggtttcaccgtgttagccaggatggtctcgatctcctgaacttgtgatccgcccgcctcagcctcccaaagtgctgggattacaggcgtgagccatcgcacccggctcaactgtaactttctatactggttcatcttcccctgtaatgttactagagcttttgaagttttggctatggattatttctcatttatacattagatttcagattagttccaaattgatgcccacagcttagggtctcttcctaaattgtatattgtagacagctgcagaagtgggtgccaataggggaactagtttatactttcatcaacttaggacccacacttgttgataaagaacaaaggtcaagagttatgactactgattccacaactgattgagaagttggaggtaaccccgtgacctctgccatccagagtctttcaggcatctttgaaggatgaagaaatgctattttaattttggaggtttctctatcagtgcttaggatcatgggaatctgtgctgccatgaggccaaaattaagtccaaaacatctactggttccaggattaacatggaagaaccttaggtggtgcccacatgttctgatccatcctgcaaaatagacatgctgcactaacaggaaaagtgcaggcagcactaccagttggataacctgcaagattatagtttcaagtaatctaaccatttctcacaagaccctattctgtgactgaaacatacaagaatctgcatttggccttctaaggcagggcccagccaaggagaccatattcaggacagaaattcaagactactatggaactggagtgcttggcaggaagacagagtcaaggactgccaactgagccaatacagcaggcttacacaggaacccagggcctagccctacaacaattattgggtctattcactgtaagttttaatttcaggctccactgaaagagtaagctaagattcctggcactttctgtctctctcacagttggctcagaaatgagaactggccaggccaggcatggtggcttacacctggaatcccagcactttgggaggccgaagtgggagggtcacttgaggccaggagttcaggaccagcctaggcaacaaagtgagataccccctgaccccttctctacaaaaataaattttaaaaattagccaaatgtggtggtgtatacttacagtcccagctactcaggaggctgaggcagggggattgcttgagcccaggaattcaaggctgcagtgagctatgatttcaccactgcacttctggctgggcaacagagcgagaccctgtctcaaagcaaaaagaaaaagaaactagaactagcctaagtttgtgggaggaggtcatcatcgtctttagccgtgaatggttattatagaggacagaaattgacattagcccaaaaagcttgtggtctttgctggaactctacttaatcttgagcaaatgtggacaccactcaatgggagaggagagaagtaagctgtttgatgtataggggaaaactagaggcctggaactgaatatgcatcccatgacagggagaataggagattcggagttaagaaggagaggaggtcagtactgctgttcagagattttttttatgtaactcttgagaagcaaaactacttttgttctgtttggtaatatacttcaaaacaaacttcatatattcaaattgttcatgtcctgaaataattaggtaatgtttttttctctataggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacccatgccctcaatcccagctactcaagaggctgaggcaggagaatcacttgcactccggaggtggaggttgtggtgagccgagattgcaccattgcgctctagcctgggcaacaacagcaaaactccatctcaaaaaataaaataaataaataaacaaataaaaaattcataatgtgaactgtctgaatttttatgtttagaaagattatgagattattagtctataattgtaatggtgaaataaaataaatactagtcttgaaaaacatcattaagaaatgaatgaactttcacaaaagcaaacaaacagactttcccttatttaagtgaataaaataaaataaaataaaataatgtttaaaaaattcatagtttgaaaacattctacattgttaattggcatattaattatacttaatataattatttttaaatcttttgggttattagtcctaatgacaaaagatattgatatttgaactttctaatttttaagaatatcgttaaaccatcaatatttttataaggaggccacttcacttgacaaatttctgaatttcctccaaagtcagtatatttttaaaattcagtttgatcctgaatccagcaatatataaaagggattatatactctggccaactgacattcatcctaggaatgcaaagatggtttaatatcctaaaatcaattaacataacatactatattaataaagtatcaaaacagtattctcatctttttttcttttttcacaattccttggttacactatcatctcaatagatgcagaaaaagcatttgacaaaatccaattcataataaaaattctcaaacttgaaagagaacatcataaaggcatctatgaaaaacctacagctaatatcatacttaacgatgaaaaactgaattattttaccctaagatcaagaataatgcaagcatgtcagctcttgcaacttctattcaacattgtactggaggttctagccagagcaaccatacaataaataaaaataaaaggcacccagattagaaaggaagtctttatttgcagacaacatggttctttatgcagaaaaccgtcaggaatacacacacatgttagaactaataagttcagcaaggttgcaggttgcaatatcaatatgcaaaaatacattgaaggctgggctcagtggagatggcatgtacctttcgtcccagctacttgggaggctgaggtaggaggatcacttgaggtgaggagtttgaggctatagtgcaatgtgatcttgcctgtgaatagccactgcactcgagcctaggcaacaaagtgagaccccgtctccaaaaaaaaaatggtatattggtatttctgtatatgaacaatgaatgatctgaaaacaagaaaattccattcacgatggtattaaaaaaataaaatacaaataaatttagcaaaataattataaaacttgtacatcgaaaatttcaaagcattctgagggaaattaaagatgatctaaataattggagagacactctatgatcactgattggaaaactcattcaatattgttaagataacaattgtccccaaattgatgcatgcattcaatttagtcttcatcaaaattccagcagggtttttgcagaaattgacaagctgtacccaaaatgtatatggaaatgaaaagacccagaagagcaaataattttttaaaaacaaagttggaaaacttttacttcctaattttaaaacttactataaacctaaagttatcaagaccatttagtactaatacaagatatatagatcaaaggaacagatttcagagtccagaaataaactctaatatttatggttaattgatttttgacaaaggtgccaagtcagtttgatagagaaaataaggccaggcacagtggctcatgcctgtaatcccagcactttgggaggctgaggtgggtggatcacttgaggtcaggagttcaagaccagccaggccaacatggtgaaaccctgtctctactaaaaatacaaacattagccaggtgtagtggcatgtgcctataatcccagctactcaggaggctggggcaggagaatctcttaaacctgggaggtggagtttgcagtgagccaagagtgtgccactgctctccagcctgggcaacagagcaaaactctgtgtca

SEQ ID NO: 16378 - DNA, 16044 bp, Human
  misc_feature (1)...(16044): n = A,T,C or G
cagataaccagaggcacagaagtgattaagcccccaggagcaaaggcagaagaaacaaagtctccaagttagactcccaaggaattcccatataggaatgattggaggcaaatgtaaacatacagccttgaaaagtcaggaaaaaatcaggtcacttccacttctacatgggatgcagtaggttgtggctgctcagaatgtgacaaccgggcaaatcaatccacagagttaaaagtcacatttgaaaggcccttggacagatgtggaagcaccaaggcctgcatgaactgaaattccgcagagggcgagcccttcccagggtacctttgtcattgcagatacatttgtcacttgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagagtgccaggtagggagaccattcagcactcaggatagaaaacattgctccaagaatgtacttctctgaggcctgactgctgaaactgtctgcggtaacctgaaaccagttttatctgatggctactgagaccacctgctgcaactctaagcctcggttcacccactgccgtcactgattcactcatcaaccagagcttgccagctccccaaaatcctactagtgccaatgaaactcagacagcaatatgtactatttctcttctttataaaaaagagacatagttcctttttttttgagacagagacttgatttgtcctgcaggttggagcacaatggcacgatctcggctcactacaacctccacctcctgggatcaagggattctcctgcctcagcctcctgagtagctgggactacaggcacacaccaccacacccagctaatttttgtatttttagtagagacggggtttcaccatgttgatcactctggtcttgaactcctgacctcaaatgatctgcccgcctcagcctcccaaaatgctgggattacaggtgtaagccaccgcgaatttaaaaaagccttttctttgttctttggacatactgaaggccagccagtctgcccccgtgcccctaattgcagttatttcctcccaaataaaacatttcaatttcagaaattcacctattttatatgacttcgacaagagccaagccacactgtgtaggagatgctcgggtgaagccagctgtccctggccacacacagcttgaaggcaaaatggcaggagctcaagcgaaagccaggcaggtctccccctgaaacctctgcacaggtgggcgctggcggggctgaagggcaagggcaccgctcaagctggctttggtcagggttagggacagggccggctccagaggcgacggggtcgcaccctgagcggaggggctcccggggtccccaggggttatggtgatggcgggaccccctagagggagggtccaggaacgaggcaggtggactgggaccttgagggcagggtgggcctgggcggtgccaacaggctgccgagggtggctgctgtcccgtttctccagcagccagggccgtgcgcttctagaacattccccgtggctttcctaaagggagcgtggatggagccagggtgtgcagatttctgtgagaaatattttcacctgggagccccaagggggaccctgcccacctttgaacactggcagatgggctggaggcctggagcctggggacggggctttgagggtccggaaggagggcggggctgtgcggccggcggaggcccccgaaagttccagaaagcgggtggggaggtcggcgcgggaggctcaaatggctggaggcggcgggcacgcacactgcgggctccgaggggcacaggtcagtttcctgaggcgggtcgggacccaggcgtgagactggagtctgcccaggggcccagctgaggcagcctcctcgtcagctgcttgggccgccaggacgccgccgggggtgcgccgcgcttccctggatggggtgcccccactcccctcggagccccagggagaccccccgaactcagctcctctcaggggtgccagggggacccctcaaactccactccccgcaggttcctggggagacgccccctgctccattcccctcagggtcccagggagaccccctaattcagctcctctcaggggtactgggggacctctcgagctccactcccatcagggtcccagggagaccccccaactatgctcaggggtcccagggagatgccagcaccccaactccgcttccctggggcccccctccccttacagctcaacttccctcgagagtctggggctggggctccgttcagttcttgagtccccttccctcggggtgtcccggggccgcccacccccacactgtctgtgattccccaaggcgcgggtctcgggccgcagcctgttccacgttctgctgctcgttcttttctggctccttgctttcgaaggagagaaggaggccttcgtttccagtctttttgccttttctaatggagccctgcttttccttccgtgtcccttcaggctacttctgccaggtttctatttttcattctttattatgactttgcccaaaatattcttgacttctattgagaaggatttgggggtctatttcttatttggaggtgtgttcttaagttccaaacagatgaggattttccagttaatccttctggggtgacttattgcttaatgccaccatagtcagaaaatggactctcagtgtccgaaactgcattcggctctgaagtgtctgtccttgtcacctcttgcaatgttttttgcctggaagcctgcactcgccgacgctgacgtaactgtttctgcctttcagttctacagcctcctttgctttgtgatattgtcatatactttatttctatatatgttatgaactcaatatttcttgtagtgggtctgctgataataagatattcctactctttttgtctgaagccatcttaagcttaccctgtatttgccccatgcatctcttccgtttcacggttcctgagttgtcacctttgtgataaactggtaatagtaagtaaactgttttcttgtgctctgtaagctgttctagcaaattatctaggaggaggtggtcttggaaacccttgatttataactgggcagtcagaagtacacgtggcccagacttgtgattggcatctgaagtgggggcattagggtgggactgagcccttcacctgtggggtctgccctgctcaaggcagtgtcagaattgaattgaaatgttggacggtcagtgtccagagagttggagaactggtttgtgtgtaaaaactcacatatttagggtcagaagtatggtggtgtagaaataattcatactatagtcccttatttctgcctcttacacatcctgttatttttaaaattttttcatctttaaaaaatcaatttagtaatctttttctctttaatgctctcattagaatttttaaagtacttgtatgctaatgtcaacatttgagtgaactgtgggtttatttctattgttgttttattgattagcaataatttattcctaattcttacatatcctgtgatgtttttattgaacatcttgcgttgcgtacaaaatagctggaaagcttggaggtggttgtatgttactactggggatgtgtgccctctcctctctccaggagcctgtgggaaggcctggactactggcttgctcaaaggtggaggccaagtgggatgcttgcagcttcaacctgaccctggctgcctctggagccggccctgtctctaaccctaactgaagccatcttgagcggtgcccttccccttctcctacagagtgtggcttgtctcgtgttgaagtcaaataaaatagatgactttctgaaattgaaatcttttctttcggaggaaataattgtaattaggggcatgggggtagacgggctggcattcagtatgtccaaagaacaaagagaaggatttttaaaatttgcagtggctcacacctgtaatcccagcactttgggaggctgaggcaggcagatcacttgaggtcaggagttcaagaccagcgtggccaacatagtgaaaccccgtctctactaaaaatacaaaaattagctgggcgtagtggcgtgcgcccatagtcccagctactcaggaggctgaggcaggagaactgcttgaaccctggaggtggaggttgtagtgagccgagatcacgccattgcactccaactccaacctgcaggacagagcgagactctgtttcaaaaaaagaaactatgtctcttttttataaagaagagaaatagtacatattgctgtctgagtttcattggcactagtaggattttggggagctggcaagctctggttgatgagtgaatcagtgacagcagtgggtgaaccgaggcttagagttgcagcaggtggtctcagtagccatcagataaaactggtttcaggttaccgcaggcagtttcagcagtcaggcctcagagaagtacattcttggagcaatgttttctatcctgagtgctgaatggtctccctacctggcactctgccttagttgggtgtgacaagggtgacccaatttgtatgctcacctttcacaccgaatcctcagctcggacaggtttccctgtctaggctttgactttccccttgaacctcatcccacacacctgttccatcggggccactggcttatgatggagaccagtggtatgactgtggcaggctccttctaggggcactctgtctcctgggatctgccacactgggggggattctacttggccttctctgactccccagggtccctcccaccacagcacttggaggctcttccatgggaaaactgtcttgatctttaggtacctggagattctgggccactttggttccccgtgagccaagacggcactctggtttgcattccctactggagtccctgtctgtagccagcctggctttcagctggtgcccaaagtgacaaatgtatttgcaatgacaaagggtaccctgggaagggctcgccctcttcggaatttcagtttacgtgggccttggtgcttccacatctgtccaagggcctttcaaatgtgacttttaactctgtggattgatttgcctggttgtcacattctgagcagccacaacctactgcatcccatgtagaagtggaagtgacctgattttttcctgacttttcaaggctgtatgtttacatttgcctccaatcattcctatatgggaattccttgggagtctaacttggagattttgtttcttctgcctttgctcctgggggcttaatcacttctgtgcctctggttatctgtggcacatttgtatttgtcattagtcaaccggagactcggggtctgagtggagggtatgtccccctccagtgatggtttctgttggcttcccagggtgaggatgactcatgaccacttgcaagtggtttttgtgtctggggtttatgatcacacagtcatacacgttctaactccagactgactgttgagaaagcctctgggtaaggaattcctgggaaacacactgttttcatgcatcctctggaagatgaggcctgaagttaccagggtctctgtttgctgatgctgatgatccacattttctagcccactctgcttctctgacacctttagtcttgaggatccatgctctgtgaaggaatccaagctctcatttcgcactcaccttggccctggctctgtctccaggacctcttctactacaaaatcctaaagctctgggagctgggtgtcaacctgtgcccgaggaaatcatacagttactgtggactttccagtttgctgtcttctagtattccattgtagctcttgggtattttcccatccaccccaagatccagctggaaatcagtgaacacacttgatgggagttttcctgcatgtgctctgggcattgacagtagaagggtgttcagaatgtctgctgtgccctcatggaggaagagggcctcagtgtacatgctctgggtcagtaggtgcccttgagcccagctttgggagcaagtgttggatgagtgaaggaggcatccagggaaagcaggcacgacagagtggagacggggctgctgggtctcaggggaatgggcatggagtgggtaggagatccacctagggaggctggctggctggacgagtcaggagccccttccaagggtggacactgacaggcccccagtcttggtctcctgcatgccagaggtaccagcccatcttttttcctaaacttgatgacctagggctaggggcattttgaatctcagcctcgcccactggcgctggacttggtacacagggtggggcaaagtgggtactggatcctgatcatccctatccctggggtgtggcttcttgctgcacagtcagcttctagttctgtagccccagctgctcctgcggtggagggagctacacatcaggctctgaccccctccaggtggggccttcgcgtgaggggagtcagcacgcatcagcagctgggcccagggagttgccccactgagcactgcgggctgacctgctcccaaccagggagatggagcttcccccttgagtcgggctgctgaagggggataggggatggagacagtgcgtttgcaggagtaagggtgcagttgggtccctgcgagaaaatgtctcagttgtggcaactgattggtgacctggggggcgtttctgagcccacagtgctggcatcaggactcaggtgtgaggtgccccagaccctccccttgccagtaattagctgatggctcggtgatgcccagggtgaaggaagacttgattttgggaggggagttctctcgtaatgacactgaggatgccttcaagttgggcttctggcatgttctgccctcgctccccttctgtagtcaccttggccctcgtgttgctgagctgtgtgtgggagcgggaagcgcgtcagtgggcggagggagcgggaagcgcgtcagtgggcggagtatttgagaacatttcacaagccgctgttgaggttcagaatcaaccagcagatacagaaacatatttcggagcgtggggacccttgggtgagctgccacatgaagcagccccaggacctccctggctcaaggagtgacagcgagtttgtctgaggtgagggcacaggcctggcgaagcctcgtgtgtgggtgagacctgcccgaccccagtgccttacccgaggagctactggcccagtgggggaggcattcaggtgggcagagtcagggagactcatgaggccgttgaggccaggggcatagagctggccaaggagccatggctcactaacgtgttgtatggggctccttcccttcaggtccaggctcctgcgtgaagtgatgctcctctttgccttactcctagccatggagctcccattggtggcagccagtgccaccatgcgcgctcagtgtaagtatcattccctctcactgtcctggagaggacgagaattcacctggggtgctgggggtcactgggatgattggctgcaacgtggagcaagcctccgttagctggggcctgcattgtctgtgtaatcaggggtgggcactagggcagtccaggagtagtcatgagcaaggagagggttaggatgaaggagcagctgaccagggaccaagggggaaccttgatgtggcccttccccatcagcgccaggcaggaggggctctgtccagggaaacccaggaggatggcggacccctgtgagtatccagtcttccttggcgaggtgagccaggtctgcagagcatagcaatcccgtatgtgaccaccagtggcgctctctggagcctgcgttggagagcagggaaagctctccttgtgcctggcctccctcccaggagctagcctgggccagactcagactgcatagagagctgagctgtgcaggctaggagaagtccttggaagcagaggggaagggctggccgttgaagaagggtggagtgagctggtaatgggtggaaaaggcgtagtggagcagaagcctgaagcctgctttctcccctctcagggacttacagtttgagatgccatgactgtgcggtcataaatgacttcaactgtcccaacattagagtatgtccgtatcatattaggcgctgtatgacaatctccattcgtaagtacctctttgtcattttgacacattgtagattagtcccctacctgggtagtttctggggccagggccagtctgctttcttctctgcacccagctctgtttccccttccctcatgtcctcccatcctgagtgcgtttctgcacgctttggtctcagcctcatgataggccagcatgcatcatcttgtagagccaggtactctgcaaagtagtacaatctgtccacacatctgcagcgtctccagggggtaggagcattgctggacctcagagcctctactgtccctggttgtgtgtgtagacaccccatgctgcctgggtgagtcctcactggccattcaatttctggtagtctagagagtgcttccagctcggcaggtcaaagcagtggatgggccatggactccccccagggaaaaacctaccacacacagatgggaaggacaagcatgaggtcagggcacagcctgcacttccaggatgctcttgctttttcctcagagccctctggtgccctctctccccagggccctaacctgcagaagatgtatggccagaggcccagtgaccaatggagcaagcagggagggtgcagccagtgtatgccctggcgcacaggtggagcctcgtctggggctctgctcagggcctttcctgtagcccttttgtccccggtgtctgtggttgtgcttgcaacttcacatgtcattctgtgttctaagctttgtgcaaaaataatcccctgattaccacctcggtgtggtttggctatgtccccacccagatctcatcttgaattgtaactcccataatccccgtgtgtcatgggagggacctggtgggaggtaattgaatcatgtgggtggttaccctcatgatgttctcgtgatagtgagttcccacaagatctgatggttttataaggagcttttccccggcacttctccttcctgccatcatttgaagcatgtgtttgctaccccttctgctgtcattgtaagtttcctgaggcctccccagccacgcggaactgtgagtcagttaaacctctttcctttataaattgcccagtctcgggcagttctttatagcagcgtgagaagagactcatacacacctcttcttcagaccaactgctgatttgggacatgggcaggaggctgagaatctgggctttgtctccacagtggccactgctggggaccttgatggcatggttttgtcatgttgggattactgcctctaaatgaggctgagaactatctttcccataactccctcgtggggtaatagttggcaaaaagaggaacttgagtgagattcgcaaggtatgggtgaagcagagatcactcttctggaaggtcacgatggtttagtgaagtgaaggacactggtggactccaatctgtcctccttcatgtccaccccatcttctccacttttgagcctttgactgaaagcaattctaagactccagcaggcatttggccactggcctgcctaggtgatgggtactccagtggcgcagtttaaatgtctctgcaagagactcctctgcacagccttacttgagaggataacggtgcatggcctttgatattgccctgcagagttgggctgttccagcctgccccagtgtaagtgacctagctctggactgttgttcctctgatcttcagccttacctgactgacttcctttcttggctcccccatggtcatggcagctgcaacacttttatttaataacttagacctagactgttttagaggctccattttcctgaatgaaccctgatggatattaggacaaagaaattgggaatgctggaatgctgggacatttttcctttcaggagatttgctgatttctggggctgtgcaggatggtaagcaaaagacctctatggaaagaaacgcaggcagtgtcctgagacaaggggcctgggtatgaggcatataggaactctgcactatctctgcaacttttctgaaaacctaaaactatttttaaaataaaaggttcatacacacacacacacacacacacacacacacacacacacacacaccataaccccactaccttgtggattcaataacagaattgcaatgtggtttacaatttgaaacccatcagtttaattcaccatattaacaaagaaaagggcagagatgattgtagatgctgaaatgttttgataaaatccaacaccctttccaaatctctgagggaaatgtctaccatcaccacttctattcccaatggaactggagttgttaggtagttcagttaggcaagaggaagtattaagtctcatggagaggagaaagaaagaatttaaactgcttactattcatcagagacaacaaacttcaaataacaaatatctttaggaaagatcctggatacaagataagtattcaaaaatcagtttacaaaatcagttgtccttttgtacatcaagaaacagattgaaaatgaaatccaaggaatggtgctctttaaagtatcacaaaatcaagtaccacaaatctaactggatttgtgcaagatttcaacactcaaactgcaagaacactattgaagacttaaaacaccattaaagacttaaacacatggaattgtacactatacttatggatcatgagaatcaaaagagtaaggatatctcttctccaattaacctacaaatccaaaagaatttcagtcaaagtctcagcaggggtatgtttgtgttttgacaagttggtgccgaatgctttttgaaaatatgaagggctaggaataaccaaagcagtcttggggaaaaagaaaaaagctcgaggacttgtgctctgaactatcaaaccgtttccttaatcaaaacggtttggtgttggatcctgtggtcaggattgaaaaataacaacattagaagagaaataattcagaaaaagccacatacttctggtttcttgatctctgacaaagttgaccctgcagtgcagtaggtaaagacacttctctgcgctgagcagtagtggatatgttagatatttatacacaatatctgcaccatataaaagaagcagtttcaggtggtttgtagatctcaatgtaaatattaaaccaataaagtttttagagaaaaatgtaaaatgctgtatttatgacttttaggaattaagaatttaaaaaatcgaacaaaatagtgctagtcacataagaatgaaattgataggttgaattacctttaacttcaaaacttctgttcctaagaagatacctgtgaaatagtataaccgcaagccacggatgaggagaaagcatttcaaaacatgtatttactaaagtacttgtgttcataatataatgaacttattcctatgaattaataaaaaactgatcaatggaaatttaaacaaaaggtttaaagggaatttgccagaaaatggtgtctgaatgtgtaacatacataagaaaagttgttcactgtcgttcttcttgaaagaaatgcagcttaaaaccacaacacaataacaccacaggaaatgactcagtatcctaaagtgatcataccaagtgttgtcagggttctgaactgtgcacaatccctcagactatagataagttcaacccagtgtagaaaactcttcgatgttgtcggctaaagctgcgtatcaaacactgagactcagcgcttctactcctaggtacatagctaattataaaaaagcttatacaggctcaccttaaggcaaatacaagacaagagtattcattgcagcactatttggagtagacaaaaaccagaaacaacctcaatgtccatcaacaataaattgtggtatgttcaccaatgtaatgctatgcaattttgagaatgaacaatatacaacagtgtgcaacaatagggataaatttcataaacacagattagagcaaaagaagccatccacaaaagcagatgtaatgtataatttcatttcataaagttcaaaaccaaacagaactaacctataggtttagaagcccatacatttcctgtctttggcctgggctgctcacagcagtgtctgcatggaggaacagagtgaagaatcctggggctctcttgcagctctgtttctgatgctgcatgctgagtactggctgtgggcacttggtgacaatccattgagttgtggacttatggtcaggcacatttctgtagaatggtgaactccaataaactttttaaatggaaaataacagaaaacaagtgactggttcgtattcatcatttgtttctggtgttatagaggagacaagacccagagccatgaatagataaatcaattatggtaagttccagaataaagtatttgtgtaaacactggatagacttcaaggggaacagaagtagtgatgagggccaaggtatttaaccctgggattcttgaaggaggtgttagatggagctttggtcaggtggcattggtcagctgaggccactggacaagccctctagtgaagattattgatcacattagtcgtgatcacattagttgcgatcgataaccttcaccagagggcttgtccatcggataacacgtacctagttggaaaggtgcatcaagtctgtactggggaggaggttggcaccaagggtcaagagcatttatatgttggtccaggagactgaaacaccaggctgagggtcccaggaaggagtttaccctagaagggtcttgccaactgcagaaaatctagttaaggctacattaatatggacacctctgttaaaggtccatgtgatctctagaccataagtgaaacatgatttctggtctgcatttaatttctcgggctctagaattcttaccataagaaatgaacaggacatttcattgcgtgtagctacatgacaaggtaccatgataccattttgggagggccagaggcctaaagatggcagcttagatagaaaactatctccagaagaagttgttctgggagtgatgagacccgctagtggacttggatgttctctcttagtcaagtgttctagacaattttatcacagctgggagtgtagaatgtgtacatggagctaattatggttgaatgtgaggtgtatgtgcctcaatatttacaagcagaaaatgtgaaatcaattattttcattgctgcttctttttttaggcataaattctcgtgaactacttgtttataagaactgtacaaacaactgcacatttgtatatgcagctgaacagcctcctgaagccccaggaaaaatcttcaaaactaatagcttctactgggtttgttgttgtaatagcatggtttgcaatgcaggaggacctactaatcttgaaagggacatgttacccgatgaagtaactgaggaggagcttccagaaggaactgtgaggctgggggtatcaaaactgttgctgagttttgcctctatcatagtcagcaatatattgccatgaggaccccaccttggagggtctgaccatcttcacctgttccgcagagaaatgttgctctccattattcccttctaagccagagacccttatccactgctcctctaggtggcccatttatggtttgttgtaagagaaaaattaaaaaaatattgtttagtggagatgttcatgagcatttgtttgcctgcatgtacttgagcactcatagtggagtctctattcatatctgttcttccctcccttgctctgtattcagggattactttgtggttttattataatcagttgctgtagctattaattgattttggtagttttgtctttgtgcttcatactaaagttatgagtgggttgcacactgcagttatagcattgcaatattttggtttgtctgtgtacttaattttaccctaggttttatactttcagatgttttctttttatacgtgagtgtttttttctttcagtttgaagagctccctttagcatttcttgtaagacagatgtggtggtggtgaattctctcagcttttgtttgggagagactttatttctccttcatatttgaagttcagttttgctggatacattattcttggatgacagttgaggattttttttttctgttcaacactttcaaaatgtcataccactcactcctggcctgttgagtttcccttaagaattctgttgccagatgaactggagctcctttacatgtctgcctattttctcttgccacttttagggtcctctttttgtccttgacctttaagagtttgattattatatgtgtcagggtagtcctatttgggtcagatctctttggtgttctctaactttcctgtatctgaatatttatctcttcttcaagttttggaaatttttctgttattattttttgaacagcttcctacccctggtgcttgcttaactccctcttaaacaccagtaattcttagatttggtcttttgaggtaattttctatatcttataggttatcgtcattccttttcattcttctctcttttttctcctttgtgtactttcaaatagctgtcttcaggttcattgattcttacctctgctttatttattttgctgttgaaagcctgtaatgaatttttcagttcagcaaatatatctctcatttccaaggtttctatttgactttttagattatttcaatgtcttcgttaattatttctcctaaatttctgaattgcttttctttgttatcttggagatcactgagtttccttaaaactactattttgaattcttggtcagagaattcacatattgctctctctttagggtcagttactggttccttgccttgttcggttggggaggtcatggctccctgtttgctgttgtttcttgtgaatgtatgtctgtgtccttgcacagaagaattatgtatttatttcagacttctctgtctggcttctttttgtttctttgtttttttgtttgtgggtgtgtgtgtgtgtgtgtgtgtgtgtgtgtgtgtgtgtgtgtgttaagacagggtctcactctgtcacccaggctggaatgtagtggtgattgtggctcactgcaactccacattccaggctcaggtgatcctgctacctcagtctcctgagtagttcagaccagctaatttttatatttttttgtagagatgaggttttgctgtgttgcccaagctgctttcaaactcctgggctcaagtgatcttcccacctcgacctcccaaagtgctgggattgcaggtgtgagccaccacacccagcctggtttttactggatatgtttcattagagatttttgtaatttatctgtttctttcctttttcttttttcctgctaggttgccgcctccttttctgcactagatggcaacttaagcccaactttgccttggttctagtcaacagtagagtactgccagtcccaaagagagaggccccaaggggatatcccggtcatgtgggaaggctgaccagggctgcatgcctgggggcctgtgggacttacttcctacagcatggcactgtgaacagccaccctgatttactgtctcctttggctgagttacacagcagagttttcaagggtgggatgggagtcccatttccccttttgtctctgactttcctcagaa

SEQ ID NO: 16379 - DNA, 29686 bp, Human
  misc_feature (1)...(29686): n = A,T,C or G
tagtggccagaacgtggctcactgcagcctcaactgcctcagcttcctgagtagctgggaccacaggaccacaggtgcacaccactatgcctggatatatatatttttttgtaaagatggggtctcaccatgttggccaggttggtctcgaactcctgggctcaagcgatcctcccgctttggcctcccacagtgccgggattacagacgttgagccaccgtgtccggccctgatccacctttataaatggctgtctgtagatcatggcctctcacattttaactgggctgtagaatatgtattgaaggatcatctttataaaatgtttatttgtagactctgaaaagataacaccagaaagggggaacaatggttaccactagaaagaacggagcggagcagctgatcgttgtatctaccttttttgttttttttttttttttgagacgggtctaactgtcgcccaggctggagagccgtggcgcgatctcggctcactgttgcaacctccgcctcccgggttcaagcgattctcctgcctcagcctccctagtagtggggattacaggcgcccgccaccacgcccaggtgatttttgtatttttagtagaggtggggttttaccatgttggccaggctggtctcgaactcctgacagcaaatgatccgcccatctcggcctcccaaaatgctgggattacaggcgtgagccaccgcgtcctgcccacgtatctacctttttatcacatgaatgttgtaccaagttcgcgtattacatatttgaaaataaattgcgaaaataacaaaaacaaaatccatctactggctagctctttaaaatcctgcgggggagcccagtggcccaacggcgaagtttagcccatcttgccctttctggtcagtgtacctgttccatttatctctgactgcgccactcagtcaggtgagggaccactggagttttctaccggaaatgcacttcagcaaatgccacttgctctctccaacttcagtttcaaccagcgcctacctcaggaagccttccttcatcctccggcccccgccgccgctaaggttatccttttacattcaacctcataatgctgctttttgtggcagtcatcacagtgtcgaaatttgtttacatgtccatctttgctacttgatggagggcaaagatacacctcatacctagcatagaccccaggaggtccgaaattgttctgcgaaagaaaaaaaaatcaatgtgctggcctcaaaggggctcacaggaagggaaaagcctcgaagactaaggctctcttcgattccttcgtgactaactcgaggcaaacatgccaggaacgcggctctccccacccgctcctgcatctgcgcccggggatcgccggattccagaggggtcccctccacctagcgcgcgacgactccctctggggtcccggaagcccggccaccgaccccacaggcgggcgtggcctcagagccctcttctgagcacggcgtgggtatccgcaggcggccatggacggtgatcacagtgaccagagggacagcgcaccctccggtcgaagcggggtaggcgttggcaggggaggggcgacgaagactggcgaggttcaggcgccagccaaagaaccactctgctaacttcctggcacttacgtttcctacccggggcccagagtcgggcggcggtcttccagcaccacgaactccagtactggtctgcgttgtagggagctggaagcccgacccagcactcctcagccccctgtgcccctccctctgctctttccgcccctccctccgcccccctccgcccccccctccgcctctccctcagccccgcagcgccaccgaccgcgttccccgcccacttcttacccgcgcgcgtcgccgccgccgcctgagggggcgtggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctggggtgaggagaagttgctggggcagggcccgggccggcgccggccccacgcagtggcaggcactaacacggctcgctttcttccgtagacgccgacgctttctccgtggaagacccagtgcggaaggtggggggcggcggcactgccggcggggaccgctgggaaggcgaggacgaggacgaggacgtcaaggtgggtgcgggctagggcgccgggcagcgcggaagcgggctggcgctgttgccggccgactctgggccccgggtcgctgccggggcctgcgggccgtgggtccaggcgcgagcatagggcctggcggtgctctcttcccctccgcttgccggccatgtgtgggccgaagactggcagcgtggcctcccggactccctcgccggttgagagtctgctctccggcgtggatcccacccgccggctggcgacgaaaggtgacagcatcggccgggtcggcccacgtgcaagcttcgcggtccggagcctctcgcaggaatgagaccgggaagttgggaattgagccttgtagcttatccatatggaaagccttgagactcgcctgtcttttcgagctcaagtcagcccagggccagtaactcatttatgaccctgaggtctacttatacagtttgttcgagggattagatgagtgaaatattgtagttgaatttcaacctttttttcccacacgagacagctagaaacagtaaagggaaataacttttggctctcccttcccccaccctgtggtaaaaagaatgaactgaccactgagatagcccgcagttagtggacagaaacccaggtagttcacaccgtgacctgagaaatggagagacgacagttactcaactacacacatacgacacctaaggaaatattgaagatttggtggtggttgtagatgacgggcccgtggttttttgttgttgttgttgttttgtctgtgccttgtagataatcatttttacctcagtcgtttgattttgaaaactccgaagggttcattatacagctgtaagtgacatttacttctacatggtttttttttttttttacagtagttacagaagtctcaaatccaaaatgttaagactcttattaacaaagttctcaaaatcttgttatatttgtgcagataaagttttgtgtgaaatggaaaatgatttttttttgtggttttgcctaatttagtgaatttctcctaatttataaacacaaacggagaaccctataaatcctgcctgggctgaaaagtttaagctagataatcactatgaacttaataggaatgttgttttgagtttttctgttctctccccagtccgatgaggttggatgtgtggatgtccgatttactgacagcctgaggttcaagaatgttgtgagctttgcacacattgaagttaataaatcgactggttattgtttgaagacactcagatgctttatttacatgttgtagaaacatgggactagattttgttaccagccgcattacaagatattagttacccctctacattgtagcagattttcagttttgagccttgggttcatattggtcctttcatttttttccatgcatataggaagtggcagttaagacatctgttatgaaatttgggaataaattaacaaatgcagagaaaagattagagatattaggaaagaagttgcagaaaatgaagttttaatggatagtctagactaatgtcatggaataacttccttgggattaagggatctaaatggtatcgatcttgatgaatataattctttttttttttttttttgagatggagtttcgctcttgttgcccaggctggagtgcaatggcgcgatcttggctcactgcaacctccacctcctgggttcaagtgattctcctgcttcagcctcccaagtagctgggattacaggcacgcaccaccacgcctggctaattttgtatttttagtagagacggggtttcgccatgttgcccaggctggtcttgaacttctgacctcaggtgattctcctgccttagcctcccaaagtgctggaattataggcgtgagctaccgtacccagcctctgatgaatataattctgatcacttggaacaagttttggatatttacaagttgtaagggaccacaaagattatcttgtccagttgctcttttttttttggaaatggagtctcgctctgtcacccaggctggagtgcagtggcacaatctccgctcactgcaagctccgcctcccaggttcactccattctcctgcctcagcctcccgaggactacaggtgcccaccaccacgcccggctaattttttctatttttagtagagacggggtttcaccgtgttagccaggatggtctcaatctcctgaccttgtgatctgcccgccttggcctcccaaagtgctgggattacaggcgtgagccaccacacccggccccagttgctgttttagtgctaaatttctttttcttttttttttttttttttaacttaaagcaatctatctattcatctaattttttgagagaaggtctcaccccgtttcccaggctggagtgcagtggcacgatctctgcaacctccgcctcccggattcaagtgattctccagcctcagcctttctagtagctgggattacaggtgtgcaccgccgtgcccagctaatttacatatttttttcttttttttttttttgagatagagtcttgctctgtcacccaggctggagtgcagtggcacgatcttggctcactgcaacctccgcctcccaggttcaagcagttctctgcctcagcctcccgagtagctgggattacaagcgcccaccaccacacccagctaatttttgtatttttagtagagacggggtttcaccatcttggccaggccggtcttgaactcctgacttcgtgatccacccgcctcggcctcccaaagtgctgggattacagacgtgagccaccgcgcctggctatatatatatatatatatatatatatatatattttttttttttttttgtagatacagggtttcgccatgttacctaggctggtctcaaactcctgaggtcaaagtgatcttcccgcctcggcctcccagagtgctgggattacagatgtgagccactgcacctgacctatttattttgagacggatttgtgagactggctaatttttgtgtttttggtagaggtggagtttcgccaagttgcccaggctggtctcaaactcctgaggttaaagcgatcttcccgccttggcctcccagagtgctgagattacaggtgtgagccactgcacctggcctatttattttgagacagatttgtgagactggctaatttttgtgtttttggtagagatagagtttcgccaagttgcccaggctggtctcgaactcttggagtcaagtgatctatcctcctcagcctcctaaaatgctgggattatgggcgtgagccagcagactcagccatatcaccaaatttctgaattcttatgtttttgtactttttatgaggagttgcagacaaggcttagtttccgtgaggtcttctgttcatgtcagcatctagtacttaacctttaaaaatacaggtttaatgtcatttgtaatgtcctgggaaatgaaaggaaaactgatgtttttgttattataatttgctccagcactttactctcatttagtagacttagtattttgctgtccttgacttttcaaatagctgtctggcagtggcagaagtggacttaggtgaaactgtacaaccgttaatatatatggcaagaaaagactatgcttttccccagttaaaaagatgagaactcgggagcatagtttcccatcaccctggctttatttaccttttttactatcctgatagttgtgcagaggtagtgggaagaattgttcacttggcatatatgactccttcctcattgctggtatgatatgtaggatgtgttgactgagaaggcagtgagtacctactggacacaaggacaacataacttttgctccattttactagtctcctagcatttcagtagaacagtttagaagctagatttattcaaagggtacagagtttgcagaaacttatagctgtgttcagccatctcacgcatttgcctctgtaaccatatagcatttcttttaaaagatcctgaagaggctgaggcaagaggattgcgtgagcctaggagtttgaagccagcctgggcaacatagcaagaccccaacacatttaaagagagagcgatcctgaagaacagatttagttgagcctctctcgtcctactcattcactctctgttaggatcctattccaataaatagtttgaatctaccagatagggacaattttcaggggttggaaacaacttctaaagaacaggatctgtattttacagaatgtgaaattactaggaaatacccagaaggtgggcattttgccagaaaatgggtattttgaagagagtgtgtgtatgtgtaacttaagaaaaattccaaacatgcagtagagagaaacatttaataaaccagtgaccagtcttgtctcctctgtatccccactttcctcctccaaccagattattttcaagaaaatctcaatcatatcatttcataccctgccacttttataaactagcaagttttgaattaggaagcatgtttgttattgaaaaatattttcttgtcatgatggatcattgtaaataaaccacttgtttagtgttcagtgtcttgatatcgctgagccagaaatttaaagtagattgataactgtcctgaatatgagacaggtaggcattgagatggaactcagctgagtgctgatccattgtagtatgttaaaagcttaatgaattgaattaaatgaagtagaatttactaaggcaggcaccttggcttctaggcacccagcatagttctgagatggtggaagaacattttggcttttaaaaaactgaactttgctgggaagtctacccttgccaagatctcgttgcacagttctgagttctctcagaactgcacagcttacagaacacaaattaaaggctttttttttctttcccagcaagagattatgttttacctaaaccaaattatttaaagaaaaaaggagaaggagtatatgttagttcctaggctgttgctatagggcaaaagagttttattgctcgtttgaagctacttctatttgacaatctataaatacatcttgcttaagttggaaagcattttcagccctaaatgtgttctcattgcatgtgacataatgtagttttatattatgaagacagaaccagctaactactggccacattgttagaaataaaaagaaagcaagatataaagttttctgctttgcttctgatacttagttgtgttcaattagggaagcaagttttaaagttaaaaagcagccatctctttcatagaaatagcttaaatgatgggtgtgtatctgcagggcaagagtatagataagcaagtagtttataaacaggccctattctaagaagctagccattttaggagagcagcctgggtgattcttttgaagataaattggatattatagttgaaagattaattggctaccaaaaataattgggtaaaggatttaattggatgttcataggtagtctcttgaaccaaataaccatttagggctctttgaagtgagttgtagacttgctccctattttaagtgttaattttagctgtttctctaggaagcctttttacattttatctgaatttgctgctggaatttacaaacttctaatgtttacaaaaaattgggcatattttttgaagcagcgtggtgaacattctaccttaaatctacttttcagacacttaattttataactatggaaacaaaaactctaacttcctggggaaagctacctggccttttgcttttataattacatctgtttggaagtgtgaccagtctctttttgctgacacttactatgctcctttctttaggggcttagtgctagtttggtagtaacttcagggcagacttgtaagcactttggggagagagtgacagtcaaggtttggatggtccttttatgaattgaggagcagatgtcatggctcttcttggtacatgttgataggaaccactttttttttttttttttgagatggagtttcgctgtctccaggctggagggcagtggcgcagtctcggcttactgcaacctccgcctcctgggttcaagcgattctcctgcctcagcctcccaagtagctgggactacaggtgtgcgccaccacacccagctaatttttgtatttttagtagagatggggtttcaccatgttggccaggatggtctcgatctcttgacctcgtgatctgcctgccttggcctcccaaagtgctgggattacaggcatgagtcaccacgcctggccagaatcacttcttttgctactaaaatccattctgtgatggagtagggaatgtctaggtagcttcattatgtctgcattgatgtgtgtctggggtaaggtttatgctttgatgggagaaactagggacagggatagaggtggacatagagttggtgtgaatgtactgagggagcagtgatatgggtggggtgggggttatgtttttctgggaagggtaactgaagagcatcaacattaaataaaaatgctcctgtgttgagtttgtttctttaccttggaggtattgagatggagctccttattttcagccatacttcttccttcttgacctcttactaccagaggcttgcagaccagtttttttacttttttcttttcttttcttttcttttttttttttttttagacggaggccttctctatcacccaggctggagtgcagtggcgtgatctcggctcactgcaacctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctcacacctgtaatcccaacactttgggaggctgaggtgggtggatcacctgaggtcgggagttcaggaccagcctgaccaacatggagaaacccatctctactaaaaatacaaaattagccagttcgtggtagcacatgcctgtaatcccagccacttgggaggctgaggcaggagaatcgcttgaacccaggaggcagaggttgcggtgagctgagatcgtgccattgcactccagcctgggcaataagagcaaaactccatttaaaaaaaaaaaaaaaaaaaaaaggtgggaggggccaggcacgcctgtaatcccagcactttgggaggctgaggtgggtggatcacgaggtcaagagatcaagattatcctggccaacatggtgaaacccggtctctactaaaaacacaaaaattagctaggcatggtggtgcatacctgtagtcccaactactcaggaggctgaggcaggaaaattgcttgaacctaggaggcggaggttgcagtgagctgagattgcgccactgcactccagcctggcgacacagtgagactccatctcaaaaaaaaaaaaaagatcagtagagaaccactacaggcaatttaaggtgagaagtttggtaaccagtatacctctagctgggcatatcttaatatgtgtaataatccttctctttatgagattcccagagttcccaggagagggacttagttcccagttagttattttatacttcaggactcagggaagaagtcatatttactataatactatttttatttttattattttgcattggaattgcattggaattgctttattccagcgaattaaattgtttaccagactgtgaattttgtaagcaagtgtttaaaacatgctttttaaagaccttccttaacattgtgtttaaagccttaaatgaagctgtttacatgtatacatttaaaggatgtatctcagcatgttactctaaagatgtgttgtaagctgctttattacagtgaattgaactctactaaaccgtgaactttgtaagcaagtgtttaaaacatgctttttaaaaaagtaaatcattttattttcaataaaaaggtcagtcaaatgtttagttatttaaaacttttttaaaattagtttttataattggcaaataatgtacatatttatggggtatattgtgatgtttcaatgcatgtatacattgtaattaccatttcatcactttaaacatttatcatttctttgtggtgttaacattcaaaattttcttatggaactatcttgaaatatataacattgttattagctataatcaccgtactgtgtaatagaacaccagaacttattcttctaactgtaactttatacctatgacactttaaagaactttggtccattcagagcaggtcccttagtttttcactgagattgtgggttggctatgtctgggcctgggtttccttttctttaaaatgggggaataacactaccttcttacaggactgttgtgagaattaaccttgttactacacctgtttctcagaagggttttaaatatgcatcttctggaagtaagcaaatggtcctcctatctgaaacactgccccctatcactcacagatccagccttcctgtgttctgtgaagatttaaacaacaaaaaatgcctagtaattcacttttatttttagctctttggttccttttgtactgtgatgtatagcacttagcaaactaacggcgaaatacaaacgtttgatctctaatttctaactctagtatcacagttactcaaataatgactagctggtttgctttcaatctgttaaaactgcgagctgtgggttaaattgctgaagtaagatgaatataaaaatacacttactttttaatacaaagttcctttaattatgcttgcagactgtatgacagccttaatcaggatgttgaatttttaatttctttactggacttagagatttttattaagaaccaaggcttggttagtttatattcctagactgatacaaatttgtgatctgtcgtgttatgaaaccagaagcttggtgtcatattgtggcatattagtcatactagtcagcctttgcttctttagtagcatcagggcctcttgccctgcttttgccatcttgccactcagcttcaaatggcatgtcatagtgtgcctggtggttgctgagacaatggccaggctacctatgattaaagccatctttaatcatagggctgtgtctgtccctattaaacttgagccttctaagttctgtggagcttttagaaaattgtgtttgataattggtttatatttagctcaatgattgagttaggcatagaaaaaacagagtatagatcttttttttttttttttttttttttttttgagacagagtctctgttgcctaggctggagtgcagtggctcgatcctggctcactgcagcttcgcctcctgtgctcaaatgattcttgttcctcagcatcctgagtggctaggattacgggcgtgcaccaccatgcccacctaatttttgtattttttagtataaacggggtttcatcatgttggccaggctggtctcggaactcctggtctcaagtgatctgcctgcctcggcctcccaaagtgctgggattaaagtgccctgagttagagagtgggatccatgaaggcttgattagctgttgacttttttttgtgagacggagtttcattcttgttgcccaggctggagtgcaatggcgcgatctcggctcaccacagcctctgtctcctgggttcaagcaattttcctgcctcagcctcccgagtagctgggattacaggcatgtgccaccacacccagctaattttgtatttttagtagagacggggtttctccatgttggtcaggctggtcttgcattcccgacctcaggtgatctgcctgccttggcctcccaaagtgttgggattacaggcgtaagccggccttgattcttttttttttttttttttttttttgagacgaagtctcgccgcactgtcacctgggctggagtgcagtggcacaatcttggctcactgcaacctcccactcctgggttcaagtgattctcctgcctcagcccccaagtagttgggattataggtgtctgccaccacgcccagctaattttttgtatttttagtagagacagggtttcactatgttggccaggctggtctcaaactcctgacctcgtgatccgcccacctcagcctcccaaagtgctgggattacaggcatgagccacgcacccggcctgactcctttttaatagtgggctttagaattatatagacttaattcattaaccaggcttatgttgtatggaatactacttgaaataaatgagctattggccagagtataggatgctttttacatttggggggaagtaagaactataaagttctctcagtttttatttattaataactgaatcactttcagagaggctattgatttcagctaggttgtcctaactgctaatggagaagctttcttatgaagttagataagttgatatgagggttcatatggaaaaacaaaacatgcaagaaaggccaagaaaacactaaaaaatctgaaaacctacaaggaaggactagctctagctgacattaaagtaaagcctctgtaattaaaacagtaccggctgggcatggtggctcacgcctgcaatcccagcactttgggaggctgaggatcacctgatgtcaggagttcgagaccagcctggtcaacatggagaaaccccgtctctactaaaaatacaaaaattagcccggcatgatggtggacacctgtaatcccagctactccagaggctgaggctggagagtcacttgaacccaggaggcagaggttgcagtaagctgagatcgcgccattgcactccaacctgggcgacaagagtgaaactccgtctcaaaaaacaagaccaaaaaaacccagtatggtaccgttatatggagagacagtagactagtgggataggatcaaaagcccagaaatagaccaagtacatatgaaaatttagtatatggtaagtcacaaggtatcttaaaatgttttttgctgcaatagaatgcaatagactgggtattgtataaacaacagatttatttcttatggttatggaggctgagaagtccagtatcaaggtgctggcatctggcgagggccttcttgctctattatcctggggcagaagggcaaaagagcacaaaggattgcaggaggtgtcagaactcatccttttatcagatatctactcctaatataaaggtattaataattcattcatgagggctttgcctctaatcatttctaaaagaccctacttctcaacactgttggattggagatttcatcacatgaactttggaggacacattcaaaccatagcccagggaaaaaaaccattatttattaaagggtttttaataaatgatgctgtgacaactgggtagccatttgggaaaaaaatgaaattagatccatgttgcatatcataacacaagaaaaaaactccaaatcagagatctaaataaaaaaaaaaatgaaaccctatacattctagaagaaattgtgggtgaattcttaggtgtaagaaaagactttctggctgggcgaagtggctcatgcctgtactcccagcacttcgggaggctgaggtgggcggatcacctgaggttgggagttcgagatcagcctgaccaacatggacaaaccccatctctactaaaaatacaaagttagccaggcatggtggtgcatgtctaatcccagctgcttgggaggctgaggcaggagaattgcttgaacccgggaggtggaggttgtagtgagcctagatcatgccattgcactccagcttgggcaaccagagcaaaactccaactcaaaaacaaaacaaaacaaaacaaaacaacaaaaaaacaagaaaagactttctaattgacttgaaatccatccagaggcaatgaaagaaaagactggggctaggcacggtggctcacgcctgtaattccagcacttcgggaagccgaggcgggcggatcatgagatcaggagttcgagaccagtgtgaccaacatggtgaaatcctgtctatactaaaaatacaaaattagccaggcatggtggcatgtgctggtaatcccagctactcgggaggctgaggcaggagaatcccttgaacctgggaggcagaggttgcagtgagctgagatcgtcactgtattccagcctgggcgacagaacgagactccgtctcaaaaaaaaaaaaaaaaaaaaaaaaaaccatttctactaaaaataaatgagccaggcatggtggtgtatgcctgtaatcctagttactggggaggctgaggcaggagaatcgcttgaacctaggaggtggaggttgcagtgagctgagatcgtgacattgcactccagcctgggcaagaaactccgtctcaaaaaaaaaaaaaaagtctggtaaattttattgcataaatttgttgggatgcatagcaattcatggggaaacaatagaggcatttccatcaagaaagcaaggatgcccattacttctgctgctgttcaacattgcactagaggtttagctggcccaattaggtaaatcacttgtgagggcctaaggattggtagagaagtaaagctatcttttgtttgcagataaggtagcatacctgtaaaaccctagagaagcaacgataaatctaacttaagtgataaatgaattcagtaaggtagcaggatattaacatataaaaaagccaatagtcatttttgtttatttgttttgagacagggtttttatgatagtgagttgcctaggatagagtgcagtggcactatcatagctcactgcagccttaacctcctgggctcaagtgatcttcccaccttagcctctcaagtagctgagactacaggcacatgccacgttgcccagttaattttttaattttttttttttttgcagagactgggtcttgccgataggtttttatacacaaataatagccacctagaggacataataggaaaacaccctatttataatagcaacatacaagatgaaatacttaggaataaatctaaagagaaatgcgcagagcctctaatagggaaatcactttaaaacacttctgaaaggtacaaaaatgtacttgatcaaatggaaagacagttcttattcttggttagggcagctcagcattataagatgtcaattccccctacattaatttataaatttaatgcagtacaaaaaaataccaacaaacatttctctggagttagtcaagttgataataaagttcacatagaaaagcaaacatgcaagaattattaatggaagtccttttctttaggataactgggatgacgatgatgatgaaaaaaaagaggaagcagaagtaaaaccaggtgagccactggggcgcctccatttttgtttttatgtcttgctgagcatttgtgacttgtattaagacaaatgacagaacgctcacaaaatggaacattttggtatttagaaaccaagtgtccttccattcccactttattctgttttccctgcaacttttctctatcgcctcaaaatataatcagattagatacttgctgtatttctgtatgagtgcttgttagtaggaaagggtagaggttctggcattaattatagttgaatgatctaagccctgcctataggacggtggggaaatatgaagagatatttggatcttaggggtcacattagagaggagaaggaagagtcccagaagtttcccattatttgtgagaaaaatcactgtttgaagctgggaaaggtttggtctcttaatagtatacaagtatcatgtctgtctcatccataaactggaaaatactcagtataactgaataaaacttttttttacttttagaggtaaaaatttcagaaaagaaaaaaatagcagagaagataaaagagaaagaacggcaacagaagaaaaggcaagaagaaattaaaaagagggtaaattctgttttctaaaatacagaattctcacatcggtagtggtatagtttctaacaggctgcaaatattacctaggaatttgaagggctctgtgaagactgtaaatggataccataagataggtaaaatccaaaacaaattgatttgtggtttttgcaaaaacagaacccagttttatatatgagtgtcttttaagttttcacaaacattcaggaatagtcatgatagtgcagtgactacagtcagtgatttttgccagtgcctgtagttcattctagtcagcagtattagtttttgttgttgttttttgttttttttttttggagacggagtcttgctctgtcgctaggctggagtacagtggcacaatctcggctcagtgcaacctctgcctcccgaattcaagccattcccctgcctcagcctcctgagtagctgggactacaggagccacggcgagctaattttttgtattttagtagagatagggtttcaccatgttggccaggatggtctcaatctcctgacctcgtgatccgcccgcctcggcctcccaaagtcctgggattacaggtgtgagccaccgcgtctggccaggattagtttttatttgcagtgtatatattgaacataatataaaaattgttcatttctgtgccatgtgctatataaatgtatttgtttttgattttttggcacaggatcagaaatatatgcttgtttttttttgtttttgtttttagacagagtctcactccgttacctaggctggagtgcagtggtgtgattttggctcactgcagcctccacttcccaggttcaagcaattgtcatgcctcagcatcccaggttggaattacaggcacacgcaaccatgcctggctaatctttgtatttttagtagagatggggtttcgccatgttggccgggctggtctcaaactcctgacctcaagtgatctgcctgcttcgacctcccaaagtgctgggattacaagcatgagccaccacgtccagcctattttctatttcttttcttttctttttttttttttagagatggagtttcactctagtcgcccaggcgggagtgcaatggcgtgatcttggctcactgcaaccttctcccgggttcaagtgattctcctgcctcagtcttcgagtagctgggactgcaggcatgtgctaccatgcccagctaattttgtattatcagtagagatggcatttcaccgtgttggccaggttggtctcaaactcctgacctcaggtgatccacccgccttggcctcccagagtgctaggattataggcgtgaaccactgtgcctggcctattttctatttcagaacacatttacatggttcaaaaattaaaacagcctgcgtggtggctcatgcctgtaattgcaacgctttgggaggctgaggtgggagtattgcttgagtccatggatttgagaccagcctggacaacatagggagaccccgtctctacaaaaaatagaaaaataagctgggcgtggtggtacatgcctgtagtatcagctgcttgggaggctaaggtaggagaatcacttgagcccaggaagttgaggctgcagtgagccatgactgcgccactacactccagcctaggtgacagagcaagatcctgcctcaaaacaaaaaaaaaaagaagaaaacggccaggcgtggtggctcacgcctgtaatcctggcactttgggaggccgaggcaggcagatcacaaggtcaggagatcgagaccatcctggctaacacggtgaaaccccgtctctactaaaaaatagaaaaattagacgggcgtggtggcgggcgcctgtagtcccagctacctgggaggctgaggcaggagaatggtgtgaactcaggaggcggagcttgcagtgagcggagatcgcaccactgcactccagcccgggcgacagagcgagactccatctcaaaaaaaaaaaagaaaaaataattatattccagtataaagagaagatagatatacactaagctgtcaactgtcatgtcagagaagtgggtttgggaaacaaatgacatctactattatatctttaaaatttgttatagtggtaattttataattatacaatatgatgaaaaggggaaatgttttgaaccattctgttggacatttaggttgtctgtaaatttatttgaaattatgaataatactctaatgtacattcttgggcttacatatttgtgtgcatcttatttcttaaggtaaatacctggaagtagaatacttgattaaagcatgtaaaaatattatttaagacttgatccatattaccaagttgccctagaaagggttttccaatatagttttagtagcagtgtatgaaagtaatatttttaccttgtccacagtctcaattcctttttttaaaaaaggttatagaagtaaccccagtcttcctgggtacaaatctgtcacgttaccagctgttaccttctatttagttgtgggcaggttgtttctttgtgcctccattgcttatctttaaaattgggttaaggatacctaaagtggactgggcgcagtggctcacacctgtaatcccaacactttgggaggctgagatgggcggatcacttgaggccaggagttcaagaccggcctggccaacatggtgaaaccccatcactgctaaaactacaaaaattagctggatgtggtggtgcacgcctgtaatcccagctactcgggaggctgaggtatgagaatcacttgaacccaggaggcagaggttacaatgagcgaagatcatgccactgtgctccagccttggtggcagagtgaggctctgtctaaaaaaaaaaaaaaaaaaaaaaaaactaaagtgtttagaagaatgcctgaaacagtaattaccagtgttcacttttatttgttattatatacgcttatttaagaattcgtacaatacagaaaggtactgagtgcatcataatccctgtgctttttaaaaacttttgtctcattttagttagaagaacccgaagaacctaaagtgctaacaccagaagaacaattagcagataaactgcggctaaagaaattacaggaagagtcagacctcgaattagcaaaggaaacttttggtaagacgggattatgattgcaatacagtattaaactgttacaggtgaagacccagaaagttcagaaaacatctccttttcttaaaagaaacatactggctaatgtagatattagaaagcagtttttaatctctgtgtatatttgagatttcattacatgttcagatttttgaataattgttttgagtaaaagattattaagataagtcatttatagcaatgcaagaagggcaaaaaggagtagactcagatgaagtacactactgcatagaatatttttatcagctggatgaaatttgcatgaaatgtgaggtctgtagctttgaaatggactgtagggctgtcctgttgtcttaagacttagacagtaggatgttgctccaggtgagaggcatgcagcttttgctgtgccttcttgtgctcagtgtcatttccttctgcaacccttctttgcccttaccatgccctatctttagagggcctccatttctttgtgcggtgtctgcagctgtggttagtgcgtgagataaaagtgcaggatcctataaatagataaattcagagtgttccagagtaagagacatggctagagaaatagtcaaagccctcgcttcatttaaccaagttatcgttacctgttgagtacttttcagagtagaagatcatgttgaaacagttaaatcactgaaatttataaccaagaaggaaagctctagttattctgatacccctcccccactttcatactttctctactctgaaacagatcaacaggctgactgtagtgattgttttccttttcatgaggaagtatgaccttatctgtcagtggatctgtacaaataccaggagttgatgtgaatgctcctgtgcaccattgtatgcttggcaggtcttaactgcactcatctaattatagagagctcttggctgttaatatgtgtcttcctaggatggtaaaagctgcccatgtgtttattaaagaggcaggtttatgaagtgtgcataaagcctagcatgggacacctgttatagactaaaaggtaaaaacatgcattcatatagtcattgttaataggattttactgttgtgtttctcatactaaaataccacatgtaatattgttaataactaatctacttgacatggaggatacagaagcatacttatcttagtgtaaaactcatctaggccagatttttttttttctaacagggtctggctctgtcatccaggctagaggacagtggctgagatcggctcactgcaacctctgcctctgggctcaagccatcctcccaccttagcctcccaagtagctgggactacaggcgcatgccaccacgcctgggtaatttttgttttttggggctttttttgtagatacaaggtttcaccatgctgcccaggctgttgttgaagtcctgagctcaagtgatctgccgccttggcctcctaaagtgctgggattacaggcatgagccaccatgcacagcctaggccagatttcttctattgggatttaacatgtttacccccgcttagcttctggagttagacaaatactttcacaggatccatctttgtttcttattctttttgttccctctctccccactttactgtgggggtgttcttggacaagaacagagtatcccttttgtaatgtaatatgttgtgttttgtttttagagaaaggttcttgctcagtcatccagtctggaatgcagtggcatgaccatagctcactgcagcctcaaactcctgggctcaagcaatcctcccacctcagcctcccgggtagcgagggctacaggtgaatatcaccacacctggctaattttatttatttttttgagacagagtctcactctgtcacccaggctggagtgcagtggtgcagtctcggctcattgtaacctccgcctcctgggttgaagtgattctcgtgcctcagcctcccaagtagctgggattacagatacatgccaccaccatgcctggctaatttttgtatttttggtagagacagggtttcaccatgttggccaggcttgtctctcggactcctgacctcaggtgatcggcctgcctaggcctcccaaagtgttgggattacgggtgttagccactgcgtctggccacacctggctaattaaaaaaattttttttgtagagatgaggtcttgctgtgttgcccaggctggtctcaaactcctggcctcaagcgatccttcctcttaggcctcccaaacaaaacactgggattacaggtgtgagccactgtgtctggccttgatatattgtttttaaatgaataaaatacttatttataaagaaaacctgttatatataaatagatgtcaaaatactaaaatgacaaatttgtgatacagaattatatgcttccttatcgatgcattaaatcaggtgtagtggcacgtcaaataatgtcatttgagagtaattatgactgaacaatattaatattgtaagatatctgtaatggcaggagagtgtgatctctcctggtaagtcaagttttgctaataccactgtgatttgttgccagtcaattgaaactgaaggaaatgctgaattagaggttaataaagatgtaactttttttctgatttaagtttgtaacccccctcccccctcacccagccattctatccagtgactccagtggctccaggttcagagcccctgctttagaatgaaacgacagggttattcagatagctattggctttgtaaggtttcatttttaaaaatcctaacctcctgatacttttcagtgcttcttttctcctacaggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcatgtaagtaattctaatttctagcccctctgggtagatttttagtaggatgttctcttcaggaggttgaaggttattttttattttcaaggatactataatacagactcatgatttgctgtttttagcaattaccttgtgaatgttgttctgcagatacagtgaatttgagtgctggatctttttgtttgtttgtaggggtaagaggacttcttgttttacaatggcttccctaagagatacctgggcttgtcagcaaagcagctaataaaacactggcctattctttttatctgattatcacttgagaggggctgggaagtatcttttgagggaaaaggtctctggcactgtaggatttgggttgggtgagacttcagccactgtcttttacaaatcagaattagacagggtgcaagttgagtgacagggctggcacctattctctgggtccgtggttgtggtgccacaccttgataggagtcatacatttcagggcagggtgaatgggagtgacagccatgggtggtgaagcaggaatgtatggaagggactggttttgctagtatttgcagtttttttgttgttgttgtttttgtgatggagtcttgcattgcagaggcacgatctcagctcactgcaacttctgcctcctgggttaaagcaattctcctggtctggcgcagtggctcatgcctgtaatcccagcactttgggaggccaaaacaggcggatcacgaggtcaggagattgtagaccatcctggctaacaaggtgaagctgaggcaggagaatggcatgaacctgggaggcaaagcttgcagtgagctgagatcgtgccaccgcactccagcctgggtgaccaagtgagactccgtctcaaaaaaaaaaaagcaattctcctgctcagactcctgagtagctgggattacaggcgcctgccaccacgcccggctaattttttgtatttttagtagagacggggtttcaccatgttggccaggctgctctggaactcctgatctcaggtgatctccctgccttggcctcccaaagtactgggattataggtgtgagccaccacgcccagcctatttgcagtttttaagatggagaaaaaggaatcctacacaatgaattgggttttctttgataaattatcactaagctgagggttctacatttgattggtaatgtgcccagagttgatattttattctgcatgtactaatttttttctggtttttggaggtgttctctaaccaaaactgaacactttctggtagctaaaaactggtgtctctttccagcttcatatttttataaggctgataatgctgtccactgaacaggactatttcttggtaggacatagagatggtcactgttctcattgtagttcccatgcaagaaaatggagacatcatgggatagggtgttgtcattgtaggtttaagaattgtcattctggccgggcgtggtggctcatgcctgtaatcccagcactttgggaggctgaggctggtagatcacctgaggtcaggagtttgagactaaccttgccaacatggtaaaacctcatctctattaaaaaaaaaaaaaaaaaacacaaaaatcagctgggcatggtggcacgcacctgtaatcccagctactcgggaggctgaggcaggacaatcacttgaatctgggaggtggaggctgtggtgagccgagatcacgccactgtaccccagcctggtgacaaagcgagactctgtctcaaaaaaaaaaataaaataggccgggtgcggtggctcacacctgtaaccccagcactttgggaggccgaggcaggcggatcacgtcaggagatcaagagcatcctggctaacacagtgaaaccccgtctctactaaaaatacaaaaaattagctgggcatggtggcgggcgcctgtagtcccagctactcgggaggctgaggcaggaaaatggtgtgaacccgggaggcgcaggttgcagtgagccgagatcgcgtcactgcactccaacctgggtgacagagtgagactccatctcaaaaaaaaaaaaaaataatagtaattgtcatttcatgtttatttgtctgttctccctgattactgggggtgtgttaatggaagggcatgttatcctcccccatttgtttagactgaggaaggatagtagggagcattgtgagctataaagacagtttctctttggttgagcaatggtgtgttggtgattacaggtcatcattataaataaaatgaattttgttttcaagagacagggtctagctgtgttgcccaagctggtctcgaattcctgggcttaagtgatccacccacctaggcctcccaaaatgctgggattacaggcatgtgccactgtgcccggccaccttacgtttaaagaggagaaattcatggtcctttcaaagttactgaagtttaacaatgaacaaattggatttctcataacacttttggaatgtacattttgggatatatagatatatatggaatgtacatatttagctttaacttttcaaaatgcttaaaaattcaagtttaatggtatgcccttttttttttaagtggaaattgatgacttgaaaaaaattaccaattcactgactgtgctttgcagtgaaaaacagaagcaagaaaaggtaagagcaagctgtgtagggaaatgggtattaaattagagtggggttataggtctaacagtcaacaaatataataggagcctgtcctaattaaaagtcaagcaactcactaataccatttaagttagactagaagaggagtatgggtgctattactgtccttttgtttccagacatgttccccttttctgagttaatagaaattgctgaaatcacagactgggttcaaatactagcactgctacttaataggtataggtaaatcagcttttctaagcttcagtcttctcccttctaaaataggaacaataatactcactttgcagagtatttataagagtaaagtaagagaagtatgtcaagtaaaggttagagctttgtgattttaaattggggggtacttatccacacttttctaaatttgcttcagtgaagttaaggctgtctaccaataacttataacccctgctggtgggctaggtatccagagcaggaccaaggacccagatcaagttttggagagactgactctgggagacctgttcaggtccaaaacatgtaggctcggatgtcccttacagaactagtgtttctgggaccaaaggtttttgtgtgtttgtttatgagggttgctgtaccagataagatgcccatagcacactaaggttcatgaattaactctctttcatctttagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactggaatctgcaggtacaggtattctttaatcattattggatcatctaaagtagaagctgtcctgaggaagaggaagcttttgatcttaatactagtatctatataaaatggtgtggatgaacaatcatctaaaatcaatctattttaaataggaatttcctcctgaaaagtttcttacttgctacctactacccacaaaggactgatatggtacagtaccgggattgttcaactttagcaaagatctccaatgcattcttcttctcatcacatctgtcagaatctgctaacagtacaagaaaacagacacctatgaaatcatctaacctgctagcatgtcctttagacagcaacctgtctgagggtccttcagaagcacatttacaatttcataaaacttgtgttcgtatgccaacttgtaatacaggtaaacatcttcacaatatgtgagtaatttcttcaggttttccatgaccatgtcagtaggctgatgttgtttatatctagataaagaaacataatgtacaggttaagatactgttttttgttttgttttgtttgagacagtcttactctgttgcccaggctggagtgcagaggagcagtcttggctcactgcaacctccacctgctgggttcaagtgattcttgtgcctcagcctcccgagtaggtgggattacatgagtgtgtcaccaccctggctaatttttctaattttagtagagacagcgttctgctatgttggctaggctggtgttgaactccgggcctcaagttacctgcctgccttggcctcccaaagtgctgggattacaggcgtgagtcactgtggctgcccttttttttctctcttaaataaaagatggaggtctcactgtgttgcccaggctggagtacagtggtttttcagagtgtgaactcctgggctcagctgcttctcttgcagcctcccgagtaactaggactacaagtgtgcaccactgtgcccaccttaggatactgtattttgagtgagggctgtcagctctgaagtaccacttactattacctatagaggagagggtgctggagtctgggttatctcagactagtattaggggtgcttgataaaatatttctttaaaaatgagtatgttaatgcttaccttatagagtaagtttagtactccaaaaggcacctctgatgttttagtgtttttcgtttctttttttgagacaagagtcacactctgttgccaggctggagtatagtggcacgatctcagcttactgcagcctctgtccccaggttcaagtgattctcctgcctcagcctcccgagtagctgggactacaggtgccagctaccacacccagctaatttttgtatttttagtagagacagggtttcaccatgttggcaaggctggtctcaaactcctgacctcaagtgatcctcccgcctcggcctcccatagtgctgggattacaggcatgagccactgggcctggccagtgttttaggtttttggcactgagtagctatcctcccattttaaagtacaaagcactatgagcaaactgttcttgttgatctctttgcataaatctgttaaaagacttccttctaaggattcttgatactgctttgccattttaagtagaggtaatctaaaggcatggtgtacttagccataaaattcttacacttgtctcacctcaaagcagaggcaaggagcaatgtttacagtcaacttttaatacttactttttggaaatctcttcaaatatactggactttaataacctttgctgcttaaattcttccaagtaattaaagtctcctttaagaatcacttgctggtataaaatttcagcccaatctggaacaaaatcgtaggcctcagccacaatagaagccttaaaaggagaggtgaagaaggacaccatcagagcccatctgatgtaaaatcaaaaacaaactgttgtagaaaacaatactgtatactcactcatgtagtgaatat

SEQ ID NO: 16380 - DNA, 16346 bp, Human
agcctggccaacatggtgaaacttcatatctactaaaaatacaaaaaattagctgggcgtggtggtgcacacccgtaatcccagctacactggagtctgaggcaggagaatcgcttgaactcaggaggcagaggttgcagtgaaccgagatggtgccactgcactctagcctgggcgacagagtgagacttcatcacacacaaaaaaagccaattcaacactactcccacaaaattccccagaataactatcttttacttgcttggtatgcattttctacttgtaagcaacacaatatttattttttacaaaaaatgagattacatcatattgatctacatttttgtcctctcagtacatatagatagacccccttctttctcttttttttttgagacagagtctcgctctgtcgcccaggctggagtgcagtggcgcaatctccactcactgcaagctccacctcccgggttcacgccattctcctgcctcagcctcccaagtagctgggactacaggcacccgccaccacgtccagctaatttttttgtagttttagtagagacggggtttcaccgtgttagccaggatggtctcgatctcctgaccttgtgatccgcccacctcagcctcccaaagtgctggggttacaggcatgagccaccacacctggcctgacccccttctttctaatggctgcagagtattccactgtacagatgtactaagcttgaataatgctttattgatatacatttaaatttttctgttttgtttttgccattacaaagtgtgatataaatattccttacttttttttcctaatagaaaccctttatcaaattaatatcttctcctattttaagctaagagctttttttttttttttttttttttttgagatggagtttcattcttgttgcccaggctggagtgcaatggcacaatctcggctcaccgcaacctccgcctcccgggttcaagcaattctcctgcctcagcctcctgagtagctgggattacaggcatgcgccaccacacccagctaactttaaatttttagtagaaacagggtttctccatgttggtcaggctggtctcgaactcctgacctcaagtgatccgcccgcctcagcctcccaaagtgctgggattataggcgtgagccaccgcacccgtccaagagcttcgttttaaaaaaaatcaggaatagattttaattttactataaattaaagcatatttgcaggtgggtgcagtggcccatgcctgtaatcccagcacttttggaagtcgaggcaaatgcatcagttgaggccaggagtttgagaccagcctgatcaacatggcaaaacttcatctcaactaaaaatgcaaaaattagccaggtgtggtggtgcacgcctgtaatcccagctactcgagaggctgaggcacgagaatctattgagccctggaggcagaggttgcagtgagctgagatcgcaccactgcactccagcctgggtgacagagcaagactccatctcaaaaaaaaaaaaaaaaaaagtatgttggagaccgactgggggtgaggggctggcagcaggagacagataacagctcctcagaatgcagagtgatgaaggctggaactaaggccacaactggagagatgttatggagatagtcagctatacttggtgacttatttgatacaggagggaggacatatagagaagactctggcaagcatctttggtgctgatctctagagcactcattaggtggccttgatctttgtagcatatgaggtctttgaagtatcccagggtgggatttcctggaagagggcaatgaaagaagttgaggtggggccctgtcagcagtggtcctatccccagtcagagtaatgggagtgcagtgcagggagcttcaagcagagaggtagagccatagagagctagggagaggccagaacctcccagcttagagcccctcagacttgtatttgcttccagcttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggtatgtgccaaggggtggggctcctctttctgagagggagggaaatgagaagtttgaggttgattttggacattgccaagtcagccttttagatgataatcatgacctgggagtagagctcttatcaggatgttggccctcataattttatctttggggaatggtggggaggacaccaggccaggtgccagggcgatctgactcctggctgcagctcagcaaaccagaaagctagggctgtgggcccctgtttcgtcatctataaatgatgatttgaccatgagggtctcttctagacttaatatcttgggttttgcattatgattgtgtggagcattccatatggaatgtgatgactataaagacaagagccagaggaagcagaaatcgtctgtacctttgcgctgcttgggggagaaaaacagtagactggaagtagaagagcacaagagaaataaagccaaaccctaaagccctcgtcttggagaagactcaaagacttctttggaaattgagggttttgctgctgctctgggaataataaaggctctcgtattttagtcggtgttcttacatttcataatatttttaaaaatcaggctgggcatggtggctcatgcctataatcccagcaattcgggaggccgaggcgggtggattacttgagggcaggagtttgagaccagcctgaccaacatggagaaaccccatctctaccaaaaatactaaaattagctgggtgtggtggcacatgcctgtaaccccagctgctcgagaggctgaggcaggagaattgcttgaacccagtaggcagcggttgtggtgagccaagattgtgccattgcacttcagcctgggcaacaagagtgaaactctgccacccctcccaaccctgccgccaaaaaaataagtgtccaacaagagaataacctgatgctttctgaatacaagcctttcttttacctggatttggctttggtgaaatgatagaaagggttagaaaacagtacttgctttttctaaggttcctgctgagggtgaggagtctgtaagctcagaatacagtggagtctgtccacatcagatttcagaaagggctcttttgctttttcctggcttctaaaagtggccttgactggctttgtcttcctctcaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggtgccctaccccccggggattcccaacctctctgacagcattctctagttcccagtgttaaggatttggatgttgtgcttatatacatcctgtatgtggttctctcaagtttctggattgcagtaatgtattttgtttaaataaaacaaaatacatgctttattttttacaaaatacatgtacaaaatacatgctgttgctttttattgttttatgattacactgggagtagctgtggctttctgagctaaagaactgtcctggccgggcgcggtggctcacgcctgtaatcccagcactttgggaggccaaggctggcagatcacgaggtcaggagatagagaccatcctggctaacacagtgaaacccgcctctactaaaaatacaaaaaagtagccgggcgtgttggcgggcacctgtagtcccagctactcaggaggctgaggcaggagaatcgtttgaacctgggaggctgaggttgcagtgagccaagatcaccccactgcactccagcctggatgacagagcaagactccatctcaaaaaaaaaaaaaaaaaaaaaaaagaactcctgtcctataaaatgaccaataggccaagggtttcaagctcagcaagcggagagctgcagagctccataagcattacctcctggtgcctaagcctgggcagagtgggcctctcttagataaaaccagcacctgtcttcacacctctctgtacaggacataagcagatgttcaacccaacagaggaaagccagacatttcttcagctgaccactctgtgtcaagaccgcacattggtaggcatgaagttgttggataagatttcctccgttccccatggggaactgtcttgcagtaagttattgacctttttcttacatattttggccctaaacaggtctcaaaaggtctcccagtctctccaaaacttgatttgggtccctgttcctgctctggatgcctagccctccagcaggagttataagttcttggtagaaagccttaacttcactgaagaaaatttagaaattatggatgagtacccccaaatttaaaatcatacaaaaaggtaacctttactcaacatacttatttcactcttatattgccctgcaaagagaacgttattgtcccctagaagggagacaaactttaccttaggaaagctgattacatctgttaagtggcagagctggtatttgaacccagtccatggattcaaagcctgtttattttccataatgtctaactcattataggccttcattagaatgtgtgataagttctcttttttaaaaaatgacattatactctgtatagtttataatttttttactttatgaatatgctgtcattaacatttttcatggcattgaatattcttctatataacttctaatggttacacagatttcttatatataatgaaaaactgtatattagaatggggaacagtggcccacgcctgtaatcccaatgcttttgagaggccgagggcagaggataattagagactaggagtctgagaccaatctgggcaacatagtgagaccctgtctctaaaaatatttttaaaaacttagcggggcatggtggtgcacacctgtagtcccagctacttgagaggctgaggtgggaggatcccttgagcccaggagttggagattgcaatgagctgtgattgcaacactgaactctagtctgggcaacagagtaagatccatctctaaaagaaatttaaggccaggcgcagtggctcaagcctgtaatcccagcactttgggaggccgaggcgggtggatcatgaggtcaggagatcgagatcatcctggctaacacggtgaaaccccgtctctactaaaaatacaaaaaattagccgggcatggttgcaggtgcctgtagtcccagctactcgggaggctgaagcaggagaatggcctgaacccgggaggtggagctcgcagtgagtggagatggcgccgctgcactccagcctgggcaacagagcaagcctccatctcaaaaaaaaaaaaaaaaaaagaaaagaaatttaaataaaaatagccttctctatctcttctcggtccagttcaacagtatttactgagtgccaactttgtgccagacactataagcatctaggatatggtgtataagcaattcctggagctcagactagggtcttaatacacagtaagagccagaatgatggggtcaagatagagttctggacgaaatgtccaaacgaaggcctgaaggattcattgtcagggatgcttaggagtcagtaggactggagagggccctgcagatgcaaaagcccagaggctacagcatgttttaaggatggagaaccttcttcagtcctcacattgcaggtgtttttcccagtttgccttttcattgtgcttacagtgattgtagtatttttaaatctgtacatgtcagactttcactactctagaaagccagaacaccaaatggcacttgattaggccctgagaccttttgctgggatacaagcagagaatgcccttggattcatgttggcaggaactccatcagtttgtctgcagaaagtttctccatgtttagaaggcgagggtgctgtgttctcattttgggggccttttggggaaacagtcactacatgattgtctttgaggattgtgccatgactgagagaatgatttggatgtcatcaaggggctgtctcaaagctacagctgctaagttcagggacttcggagggctgatgggacggccctctccagacaggccccttctccaccaggccctttttccctcctgccaggcagaggttgacagtgggcagccagggttcataatcttatcttaccagtgcccaccctcccagccacagagctcctgatcctggcccatcattgcttcaccctgacgtgccacatggagggcatcatccgagtcctacaggccgcccacatgctcacagataaccacctggcccccagtgaggagtatgggctggtggtaagtagccccctcaaccccagtctccatcctgtggaaacctttgagagtagtagaaagggtgggagccagcccagagctgatgtagtcgtagggggttctgcccatctggataccactacctacttgagagttggctgggcagcccaaccctctgctccaagttatcatttctgtcagaatcagaggttgctccaaaggagcgaaagggagaagatccctcccaggttccagggccatcccaccccctagtcagggcagttaacttttctagatagagggctaagacagctgcatttttccccaaaacaaggtttggaccttccccccatctctgaattgaagtaagtcggcaactcagttcccatgtgcctccctaaattctctgggcttgaaactgacctgagtggctgagcaagctactgggccactgtcatgagtagtggtgaaaagaggaagagtgcctgcccaggagaatggcactttagcacttgagagtcacatttaaggacagcaaagccgttcatggtggctcacgcctgtaatcccagcactttgggaggccgaggcaggcggattgcctgaggtcaggagttggagaccaccctgactaacatggtgaaaccctgtctctacaaaaattagccaggcatggtggcacatgcctataatcccagctacttgggaggctgaggcaggagaattgcttgaacccgggaggcggaggttgcagtgagccgaggtcgtgccactacactccagcctgggtgacagagcaagactccatctcaaaaaaaaaaaaaaaagaacagccagtggtggcccagtgactgacatttctgaatcctccagaggccccctgttgggtacatgggagggagctaagcatggtagcctggaaattagcccttctcctcctggagcttggcatctgaaagcaaccactgatggtagttgtctggctcagagaactccagactccaggtgatgctgatgcgagctgtcctcccacttcacaggtacggctcctcactggcattggaaggtacaacgagatgacatacatatttgatttgctgcataaaaagcactactttgaagtgctaatgaggaagaagttggatccggtaggtgcaaagtaatgagctccaggatggggtgtactgctgataattcaggagcctcagcttttctcaggaataatctcagtcagggtagactcttgggaaaatggagggaaggaattagggacctccccaagacatacactgtcaccagtggcttcagattctggttcagatcagtccgtgaatatgctgatgccatatattttttttttctttttcttttttttttttttgagacggagtttcgctcgtttctcaggctggagtgcaaatggcgtgatctcggcgcaacatccgccccccaggttcaagtgattctcctgtctcagcctcccaagtagctgggattacaggcatgcaccaccacgcccggctaatttttgtttttagtagagatggggtttatccatgttggtcaggctagtcttgaactcccgacctcaggtgatccacccatctcagcctcccaaaatgctgggattacaggcatgagccaccgtgcccagccgatgctaaatactgaagaaaataagtttgtcctcctccacctcagcctctgtctcctgcctctactgtcttaaatgccttctctggcaggggcaaaaaccctgagccaggctgaaagtggattgtctagctctgaggttgtttgagggcttttagagtggagagttttcaggagactgtgaaaaattgtgctgctaagagccaggttgggaatcaaacacaaaagtttagaccaaaaagctgtggagccatttatgatgatgaacaggaaggcggcttggaagcaaaggcctgacttgtttaagtcttgggctctgcaagcccgtgtgtcctcagtgtcctctgtgacaccgagcatactcctcacagtacctgtttccagaacatttggatgattcattgcttctgctcatttcacctttggcttctgggaacatgggcccagccaggcaggattaagagagaaagcagaaaaaaatctctctttaatattgggccaatttcaggacagaccaatctagtcatcaagtgaggagcaagtcctggacataggtgcatcttcaagatcccccaagggtttttaaaactgtttttgaggcagttttccttctgcatttaaatattttaataactttttcctgattacaaaagtaatgcatattccaggtaagacacttggaaaacagaacaacacagaaaaagccctcagtgtctatccatctggagacagtcactaacaatttggtataggccttctttgcacatgtacctgaaaacatctatatataattattttaataaaacttatacagtgaagagatgaaatatcctgcttttctcacttaacaaagtatatcatgactatttcccaaatcaacaaatcatcctcctacataagttttaatggctacatggtattctcttccccttattttggacatctggattgtttctcattgtttgctattaaatatccctgttacattcatcttagcacttttctctgcttatctctttagggacagattcctagaaatggaattgttagatcagcttatgcgggtgtatttttaaggtttctccctttagaaaaagttttgcctttcacacttccaacaggaaagcacacatgcctgtttcctcatacttgggacagcataaaacttgtatttattctcatttttgctcctcttcttcttgggagtttttaaggaatgcagaacaaggtgactcagctagtcctgtctgccttgcagtccctgactgacaccttgctttttcccttttattctgggcagagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctggggtgagtgaggtcacagccacactaccagaacagtgctgctagctaggtaaaattccttttttttttttttttttgagacagagtctcgctctgtccccaggctggagtgcagtggcacgatctcagctccctgcaacctccgcctcccaggttcaagtgattctcccgcctcagcctcccaagtagctgggattacaagcacctgccaccacacccggctaattttttgtatttttaatagagatggggtttgactatgttggccaggctggtcttgaactcctgacctggtgaactgcccacgttggcctcccaaagtgctgggattacaggtgtgagccaccatgcccggccctcgataaaattcttacagcaaaggacaagagcccatgagatgggctattagaatcttgaggtaggtggcccggcacagtggctcatgcctgtaatcctagcactttgggaggccaaggtaggtggattgcctgagctcaggagttcaacaccagcctgggcaacatggtgcaatcctgtctctactaaaatacaaaaaaaaaatagccaggtgtggcggcatgcacctgtaatcccaactacttgggaggctgaagcaggtggatcacttgaacccgggaggcggaggttgcagtgagccaagatcgcgcccattgcactccagcgtaggtgacagagtgtgactccatctcaaaaaaagaatgttgaggtgggtatgtcgctcagcaggacccccacttgggcagacagatggaatggagactttgaaggcatgtgcaatttaggattgtactcttggatctatagcctatatatccagggtatcatccaccaggaaccaacatgcacgttgataccatgtaagccttccttgatgttttggagaaatgaggcattagaaggggcactgaatcctactgcggagtgaagttacaataagcgtatgcatttctggcccaataacctttatctgagtgaggtgttcctgcctgcctgtgaacatggctgggatgtttctattctagccacgatcacaatgagtgggatgagaacagtgagctttgggagtcagactcggcaaatcttctttatttcccctacagaggacagcctcaaggatgggcaccagctgaaacaactgctgctgaaggccctgactctgatgttggatgcagcagagagttatgccaaggtaacccaaaggcttttttcagactggccttgggacttgctgtctgcagtaaaattattttcttttgtccttgggctctttccaggtgaagcgggagggcatcataggccaaccaggaacagaaggggtgaataccgttgtgagggttcacacaggaggtgacaactaggtctttctctactgtgcctctccacccttgttcctcaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggtgagcaagaaagcaaactgtagccagcactgctagcatcctctctccttctgtcccactcatggaacccagaggtaaggtctcagggctagtgacagaaccaggacagtacagttctgatttaactctctgataccaacatagaacggcaatttgatgtatttctctctagtatattgttgggcagaggttagagaatggtaagacagtgctgtctccctttcctgtgctgttaggccagcagagaggcagacacctttggccctttaaccccaggctgcagactggtactggcccatggcctgctaggaaccaggccgcacagcaagtgagcactgggcaagcaagcattactgcctgcacaccatctcctgtcagatcagtgacaggactatatttttataggagcatgaaccctgttgtgaactgcacatgcaagggcttcttatgaaaatctaatgcctgatgatctgaggtggaacattttcatcccgaaaccatcccctcccagtctgtggaaaaattgtcctccagggaacctgtcactgatgccaaaaaggttggggaccactgccttaagacagttgaggttcagagtaatactcttgctggtggtcctgcaagaacctcctagccccagcagttacagaatggcacactcaggttagtacagcaagtcagggagattggttctagccctttaaagaagtggattatcagggaatcagccctttcactgttcctcatactgctaatgggaataatatattcttagcagtttcaattcattgtgaggaagattaaaaacactgaaagaagctaggcatggtggcatatacctgtagtcccagatatgcaggaggctgaggcgggaggatcttgagcccaggaatttctggtccagcctgggcaacatagtgagaccctgtcttttttaaaaaagggtttaagataatttggggatttatgagagggaaaatgccaaacacacacctgacttttcaccacctctgatacatagagccttttaacataattggtaatgatcatattcactacatgagtgagtatacagtattgttttctacaacagtttgtttttgattttacatcagatgggctctgatggtgtccttcttcacctctccttttaaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaagtaagtattaaaagttgactgtaaacattgctccttgcctctgctttgaggtgagacaagtgtaagaattttatggctaagtacaccatgcctttagattacctctacttaaaatggcaaagcagtatcaagaatccttagaaggaagtcttttaacagatttatgcaaagagatcaacaagaacagtttgctcatagtgctttgtactttaaaatgggaggatagctactcagtgccaaaaacctaaaacactggccaggcccagtggctcatgcctgtaatcccagcactatgggaggccgaggcgggaggatcacttgaggtcaggagtttgagaccagccttgccaacatggtgaaaccctgtctctactaaaaatacaaaaattagctgggtgtggtagctggcacctgtagtcccagctactcgggaggctgaggcaggagaatcacttgaacctggggacagaggctgcagtaagctgagatcgtgccactatactccagcctggcaacagagtgtgactcttgtctcaaaaaaagaaacgaaaaacactaaaacatcagaggtgccttttggagtactaaacttactctataaggtaagcattaacatactcatttttaaagaaatattttatcaagcacccctaatactagtctgagataacccagactccagcaccctctcctctataggtaatagtaagtggtacttcagagctgacagccctcactcaaaatacagtatcctaaggtgggcacagtggtgcacacttgtagtcctagttactcgggaggctgcaagagaagcagctgagcccaggagttcacactctgaaaaaccactgtactccagcctgggcaacacagtgagacctccatcttttatttaagagagaaaaaaaagggcagccacagtgactcacgcctgtaatcccagcactttgggaggccaaggcaggcaggtaacttgaggcccggagttcaacaccagcctagccaacatagcagaacgctgtctctactaaaattagaaaaattagccagggtggtgacacactcatgtaatcccacctactcgggaggctgaggcacaagaatcacttgaacccagcaggtggaggttgcagtgagccaagactgctcctctgcactccagcctgggcaacagagtaagactgtctcaaacaaaacaaaacaaaaaacagtatcttaacctgtacattatgtttctttatctagatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattcagtgtatgtcattattactgctaaggaaatcttagcccttgtctgccttaaaggaatctttatttaatttactgtaattattgctgtgtagtcactacttttgttaatttctcaaatcacttagatgatggtcttgttttccacttagtaggtatacagagctttgacgttcctattatttcctatataagagaaatttaaaacattttttgttctttctgtcttaggggaataaaaaaacactaaccacacatttggttaaactgcttaggagaagacataataaagattccccaatctatacttaacagccataaacctgagttacaggctcagttactccaaataaatagttcttataggtacttaattaattaggccttggtatctaaataacaaaataatgtccccaaataaataagaggaaggcagccctatacctttgttgctctatggtgacaacataaggacctggcaaatcactcatgttttaaagctgtaactatgtcaagcatttattaagatttagtagagaacgtagagaactgtactcccaagagctgtgttctatactctcaaaaagtatctcttgggaggtaacacaaaatttaagtcctcacaacagtgattttattaaattagttgctttataaaacattgcagatgtcataattgttaacataacaatttaccaaactgtagttaactggtgcagtttgctgagcatgttttataaaggaaaggaaaggaaatgccaaaaccctggtaaagttgttccattgcagcctaagagaacaaagatttgtttctcagacacttaaatcaggcaaataaaaataagtttccctcccccacctgaagcagttcatcagtagaaatagcctgataaataactagacagtctttgcactcgagagattccacaacatgtaatgcaataatggaaaggtttaccttctttagcttcaaagttggagggttttggtcattttaattttatatcaaactagtgcttttcagccgcagtatcttcactctgagataagcagtcttcttcacaatgtatttttaatatcctcatgttcaattttaagacaaagcaattttaatactaggtgcacaccacatgcccttgctgcaaactgcttttcttgacaagttatgaagtagttcaaggaggtatggttaaggctgtattactgaatggtgctggtaaatactacacaattttttttgtcacgttgcaaccttttgtttccaatttagtgactgctgctatgaaatcagatagcaacaacgacaacattattaggttttgaactatgatttagtagcaacttaggttcccaattttaaccccttggcagcaagatccaagttccctcatttgcacattagcacctaagtgtcaaggggttaaataaccagcacaaaagatactgcacttctgattgtagcatttggcagaactgaaaggaaaggaagttgtgctacatgttcaagggattgtgggcaacataaagatgacaccaagaaaagataaaatgtcacatgaagtcttcatagtcttgtacatatcctccatcataaccaccataatctgccagatcatctttcatggtggcttttaatccccctccaggaaccacacctttcttcttctttttggctttgctttgctaaagatgaaagagagttaattcatgaaccttagtgtgctatgggcatcttatctggtacagcaaccctcataaacaaacacacaaaaacctttggtcccagaaacactagttctgtaagggacatccgagcctacatgttttggacctgaacaggtctcccagagtcagtctctccaaaacttgatctgggtccttggtcctgctctggatacctagcccaccagcaggggttataagttattggtagacagccttaacttcactgaagcaaatttagaaaagtgtggataagtaccccccaatttaaaatcacaaagct

SEQ ID NO: 16381 - DNA, 8675 bp, Human
ttatcccataaacctaatatcaacacatgatatactacaaataatttgattccaaatgaattaagaaaaaaggttttcaagtttcagattcttttaccaaaaatatcctgggaatttgagattgtgcctatgcagcctcaaacggatgaataaaaagtaatgtaggccgggcacccggtggctcacacctataatcctagcactttgggaggctgaggcggttggatcacctgaggtcagaagctcaaggccagcctggccaacatggtgaagccccatctctactaaaaatacaaaaattagccaggcatagtggtgcatgcctgtaatcccagctacccaggaggctgaggcaggagaatcgctcgaacccgggaggcggaggttgcagtgagctgagatcacgccactgcactccagcctgggtgacaagagcaaaactccatctcaaaagaaaaaaaaagtaaagtaaagttttgtttttttcccctttgggtggtgagattaaaagtaatttaaaagttttaaatactttaatatattttcacatgtcctacaataaatatataacttttttaatttgacaaaaaataattttgagtggttacaaaaagggacaggtgtggcttggtaactagaaaaacattcccagcctgggaaacaatctagtgagagcttggaggcagaagacagaactctgattacattcaaggagtttgccagatggcaacagataactgccaatgttcggttgcactataattattatacactctctgtcacttcagcaagcgctcttttcacaagacaagtggtgacagaatgttgtattaagattacccgttgctaagcttatgttaaaatgaggaaatgaaatggaaagtcttgttttggtaatgtctctggggtatgaggaatggagggaaaggtttgactatgagcataactgcatagagaattttgtttgtttatgccttttgggaatgcattattttgattgaccctaattgggaattcagagggggagatttcctctattatctataaagaaaggatctgctgagcaaacacaattgctagggtcatgtttaaagtacttaattgatctgctttcaagtctaatttaacacttcaggggctccaaacatgtgatacattggttacaaactcatcttagtctaattttagttagtgttcatattagaaagttatataatacttttctttctttcagatatattctataattcacatttttcactaattttacccagttctccttccactcccaatctatccaaataactgagttgaactgtgtgagtttactgctctattaatttattgccagagatatacaaaccatgacttcctcggctgtttcagatgaaactgtagatccacgtgtaaacttgcaatgcacagcttagctggaaagttacgtggagcaggtgacggaggggatagctttcactgcttggactaaagtcagttttgaaagagctaaagatgcctattgaattctggagtgtgtgtgtgtgtgtatgggtgtgcatatgtgtgggtgtaaggcagcaaactcttcacatttcaaataactaaagatatgggtggtaaaatgaagtcacatttttacacctcacaggctgactagggagagcagtcaaatgcagcatcgattggttaaaattagtctatcattcttggtttatgatgttttaaagacatgttaaagttattcatgaagatgtaaaagacacatttaaaacccacatcaattgcactaaaagtcaactggaaacagaaggtttttaaatcctggtggtggcaaattggcagccaaaggaacaaagtcttagtcaacatatttccatgtccccctgaacacaaatagcctcgaaccttcggagggtgttcctttgagatgtttcatcagtgacatcacagtgattgccagcttccacggactactttaggcgctgcccagagtccaggagtccagacagcctgggaggggagaaggagttggagctcaagttggagacagcgaggagaaacctgccatagccagggtgtgtctttgatcctcttcaggtaactgcaggatttttatgcttagcatacggtgtgtgtgtgtgtacaagctgcaaatgagaaaggcagaggaatgtttgcatttcttaatgaaataggcaatgccccttggatacagcatgccttaagatataaagtgagtactattgctttctgttttcctttttttttctcctaagggtatgcattttctcccttcctagtaaaaaaaaattttttttctttcttgtattatggaagatggtcttttttctatcttctctaagtctccattcaaagaaagccaatgtcaaacttcctgcacaatttattcagagctttttgggttttagttcatccatttgcaatcactggatcatatggcatgaccttgacttcagggaatgtttaaaatgaaacccaaagtgtctttatgggttaaaagcagaaaaatggaacttggctgatctgaatttctgcctaactggttcattcttcctaaagtgtataaatgtgtgtgaaaggaatgttcacaccacaccttacagttagcatatgtgttgattgaattgaattcactagaaattctcaccttaactcttcatgttttattcatctaaaatcacataaaacaacaaatattcaaggtcaccattaaagtgcaagaagtagtaagaggtaaatcccaagaaagaaagaagtgtgatgggtagcctgctaattcagaaatgactgaaaaaaaaaaagttaagagtgcataaacatacacagtttaaacaataactgaaaggcaacacttctataattatcatccaggtcaagaaacagatcattgccagcacccagaagcccattcttgatcaacccccattctgccccaagatgttgggatcctcttgtccctgttattctttataatttgaccatctatgtctgcatgcctaaacaatatgattaacctccctatttttgacatcatataaatggagtcatattctctgtttcttttgtaaattcttctttcacccaacaattatatttgtgagatctacccattttctgtgtagctatagttcatatattttctttgctttatgaaattcaaatgtataactataccacaatttatcatccattctgctgttgataaacatttgagttgtttccagtttggagttattgtgataatattgctgtgaactctttatttatgtaacctggcacgcacgtccttgactgtcttaaggtagaagtgaaatgccagatattagagaatgaacattttcaacattaattctaagaaagctaaattgttttccaaagtggttgaaaatttatgctaactttgtttagccaggccagttaattgcagtgacaattcacttgtgtcataactcctaggaattctagtaactagttccagtctgctaattctagctttgcctctaacttgttatctgtcattacacaaacatcttaatctcctctctctaaaagtcagtttctcagctgtaatcttgagaaagataaaaactgcagtaacacttgcctgagttgttgcgaaggtaacacaaacagagctgtggaacagctttcaatagtatttttctcattttctgagtatatcctgttggatcactatccatgattcccatgacttaacagcttaatttaataggcagatttggtgggaccgttgttttgctctccttgaattgttttgaccattataagccaggcttcatattttctgcttatctctgcatttcttgagaacttacccaaatagatggacatttggactatggttttatttcattgataagtttataagaaagagtctgtcttcgtttctcattcctttgcctccaggcaccttggcaagactcattaccgttctgttctcctctgctcttttgtacattctcataaatcctttttccttgatccattcattttattctgtttactttctcctccatgcaaatctttgtaaagattttctattttttcccctttttattttcttggagagacagggtcttgctgtgttatccaggctggtcttgaactcctaggctcaagtgatcctcccactccagcctcccaaagggctgggattagaggcatgagccaccacgcccagccatttgtaatggttttcattggcaatttactatttccttcatgctgaggtctaaaagatggataataattaaaagggagatgaaatataaatctgtcatcatttggctatatatctactggttggcaccatctgatttgaacttgtatttttttttgagacagggtctcattatgttgcctaagctggtcttaaactcctaggctcaagggatcctcccacctcagcttcccaattagctaggactacaggtaccgactgccatgcctggctgaacctgtatgttatgccaattacacaatatgaaaaatgatcattcagttggcatttatgcaattaacaatttggtccattgataatataatcaatacagtaattacaattaataattcagtcatgctagatagtttaaaaataccactcagaccaaaagcttgctaacaaccctttcagcctcttgaactctcacctttagcaaacacacaaaataccctttctccctaaactttcactctacagtagactttggtcctaaatgtctaaaacatagatatcgaattatctaaaatatataaatctttaatttcatttaggctgcataaataatgtgcaatttacaccatctcactgaagacaatagtttgatgacttcattgcacatgttctcaaagtatgatttcctgtatggacaatctgtacatactatgaagataccatccctgctctttgaaatgtttacaatctaggcacatcctggacctgactaaaaatagctggcacaagcccttgttgaaaccgaagtacccatgaagttaacacttgctctttcggctgaatgcctgttatgccaggggcttttggttgatcccagtaggctatgtgcccaatgcaggacttgtcagaggccatgcagctgttgaaagtactttctgctttccgtagagttagatgaagacctacagcagcctgaggcctgaaagattatggcatcccacttatctatgtaattcaaagcaagaacaatactaaaccataaaatttttttgttttggtacccctgcttattgatactcttaagaaaagtatacacatgcatacgcacacacgcaaacacacacagaagttggagaaagaaaaatgtaatatttcacattttatgaaaagcaccaatacgatcatcacaggaaaaaagtcaggacaaaaatggtggtctttatgacatcaggcagagaaatcaggctctctctctgtaatcattagggctcttcagagaaacataactaatagaatgtgttgtgttgaggggattggtgtctgtttttaaggaattggcttgtgcgattgcagagactggcaagtccaaaatctgcagggtgggctggtaggctggagacttagggaagtctccagtccaaagactgtcaggaggctacatgtcccagatcaaggtgttggcacagttggtttcttctgagtcctttctttggcttgtaaatgcccatcttctccttgtgttttcacatggtcttcccctctgcatgtgtctgtgtcctaatctcttctgataaagacactagtcatattggattagggccctccttaattacctaattttaacttatttacctcttaaaagaccctatcttcaaacacagtcacattctgagatactgtgagctagggctttgacatgtagatttttgggggacacaatttagcccatcacactctccttttccacaacacttctgtttcctttgaggaaagaacgagcattgttatacaggaatgcccattaatctccttgtgttttctttgttatgttttatcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaaaacaacttctagaacttattttagcttccatgtgtgacagagcatttgacccttggctgggattggagtgacaagtgctaccgtatttctagcatttgaggtaagccaagatgctccaactgctgaagatttgaaaccaagtcaacacactgtgtcatatttcaagtaattccattggttcagcgctcctcaaacttttcccctaaactagtctgaagggcagagggagaataaatccattccactacggggtctgaagcacaggctgaattgctggctaaaagtgcaacatttctttgaagtcttgtgttttatctttagaatccacaagaaatgtattttctatcttataatatcttcatgtttgttttcatataaatatttaaaattatttacactaagtaacacaagaacatgagtcatgtccctaagagtagcatagtctattttgattattgttattacacaaatggagctagtctttaatcaactacagttctaaaaggaggaaaatagaaaatgcaaacttatatgtttataaaagacatataaaatagatgtttcttaaacgtgttgcctgaacaccccatgttagacagaacaaatttgctatttgtgctgaggtaaccatggagaaagggaatgttgttaaacctcatcttacatagccgccttcatgaaggcatttcttgccaagaatttgacctgtcattgaggcattgactacatcacattatagttcttaacctttggctgcattcaaagaaagtcaattatcccaggggtgatttttcaaaatactgaggctgggtccttctcagaccaattaaataaaaatcccaggggatagagcccaagtatctatctttttaaaatatcttctagatgattacactgtgtagccagaattgagaatcactgataccaacccttgcttctcaaaatttgatgtgattgtgaattactgggaagtctcatttaaacgcagattctaattccattctaattctgattcagtctggggtggggcctgagagcctacattttggacaagctcctaagtgatgccagtgctgcccttccagactgctacccttggattaacatattagaatcacttggggggacccttagcaaaaccacgcaagcttgagccccattcctagccatttctaatttattcggccttgggtgaacctgaatgttattctttttttcgaagaagtccaggtgacactaatgtgcagccaggattaagaatcctcaaatagctaaagaaaaaatgttatattttgagaggttcctctccaaattgggaaatagcagcatatagtcctcaatgcgttgtccctaacttcagttagactacacatatggatgtgcaactgctaatgatttagtaggcagcatatgtactcacagacttgtggctctagggccctcagtagacggttagccgtctttcccctatttgcagaaaacctactgtttgtgtatgtgtttgagaaagtgtgtgtgtgtgtgtgtgtgtgtgtgtgtgtgtgttggggagagccacaacattcccttcagatgttggaccatctggcctttcacagaaatctgagtgatggtgccaacactgacaacaggtaccatttattgagtctaccgtatatgaagccctgttctgggcactttccataactcatgccatttagcagatttgggaactgaggatcagagacttcactaaacagatgtgagtggggaagccacaatgagaaaaggatcatcttaacctctatggggaactgagtacaaatcatgctttgttatagatctccaaaccattggattatgctttaggttttaccctcacattctttagtattctaaaatatcagcctgtttcgatcaaggtaacaattgcagtactctatgtcatttctttttgcctgttaatcctcactcctttctttctctaacttcctgtgactgaatctactgagagggccc

SEQ ID NO: 16382 - DNA, 36103 bp, Human
ctctcatctgatttcctagaattgagatgtgtttgggatccttcctggaggatggaggattcagagcccaccaagcccctctctcagggatccaatcacaggagcttttcttctctgggacccccaggctttctcttcctttacccttggcctcttccatgaatctgaatttccagaatgcctccccgttcaccttgaggacttgctgaaggctctctctctctctatatctctctctctctcaatctgggacctctctcttcctgaggtcccagagacagttcaggtcccttgtcacttaccaagacccaggagggtgcagagcaacacaaaggccagcagaaaggtctctggtctcctggagagcctcatggtgtgtgtatcagcagtacctggtccccagcttttataggaagctgaggaggggcgggtctggacccacattcaccctacggggagaaatagctgaggtcagaacccagggcagtcctctgtggcctccgggttgggaaggcagaaccagaatccaaaagtgacctgggcatcttgtgcccagccccccacctccatggagaccccaggagtctgggcttccatccccctcttctattagaacccagaaagtcaccaccctgttttctcaccttcccacggcccattgttgtttgtttgtttgcttgaagaccaagacggagttgggcctcttgattcccagtggctgcaagaactgggattccctctccttctctctcttcccctctcctcccaaggaagcacccagtgtgggtagggccccaccttggagcacccagcatgtccaggctggtcctgcgggtgcggggtgccttgtctcccttcccctctcttcatgtgctcggctcacactccttgtgtgtttgggctgtctccagctgcgaccccacccagggctgcacccttgggtctccaaggcaccgaatgaacagagggatgtctgtcggcagtcataggcgggcgtagtaaaagacagatgcccacagtccacatattgggaaactgaggcttttgtggaagaactccaggataggggtgtgtgtgtgtgtgtgtggtgggggttgggcacatgctttgtgttatatttaggacgcagaacccttctcttttggcctcaggcataaggctgaaagagatctgctaatttttttcgcgcgtgcgcgcgcgcgtatgtatgtatatgtgcgtgtgtgtgtgtgtggcaaggggacagagagaagagtgcagccgcctgagccatttgaagagatcctgttgcgtagaatccaggttccctacgaaactacgaaaattcactcagatttgctgtcctagcccagcgcagtcgctcacgcctgtagttccagcactttgagaggccgaggcaggtggatcgcttgagctgaggagttcgagaccagtctgggcaacatggcaagacccgccgccctctcaccccatgtctccacaaaaaatacaaaaattagccgaatgtggtggcgcgtgcgtgtaatcccagctacttaggaggctgaagtgggaggatcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgccccctcccactctccctgcccctcggaccccatactctacctcatccttctggccaggcgaagcccacgacgttgacatgccggagatccgcctccgccatgtcgtgtcctgcagcagccaggactcggtgagggacctgcatgggggaggttggaagacgtgagggaattaatgaggatagctcttaaaagagcttttggggttctcttggaagtctaaggagagtcatggggggatttccaggaggctaaaagtgaattgtggagagatgttgaattagggacgttccggcgtctagggaacttccggagagaaaaggaggaatagggaagctttcttggagagcccataggtgaacttccacgggaaagtgttgtaggggaaactccaggcagagtgtcgggggattaacgggagagcttaaatctgggggtcgtagaggccttgggaggactcaaaggaatcatctgagagctggaggcctagctgtcatctctgtgccctaattctcctctcccactgttgtttccagactcactgtgcagaaaatcttctcaaggcagacacttaccgaaaatggcgggcagccaaggcaggcgagaagaccatctctgtggtcctacaggtgatcctgccaccccacctcctcctcactaggagtctggagtccggggttccagattctgctcctgagccaactggcagtgggtttagtcactttctttgctgggcctcagcttccttactcggaaaatgggcagcataatccctgtgcccctcagcagagaggaaaggagacccaaggattaagtccaggatgaccacaggaatcagtgtgtggtcctgggcaggtggcatctactttctgggttccagtttcctcagctggaacaaaatgaatcattgccacgtactctgcctcctgcagccagtgggctcagggctggaaggtgtccaggaaggtcgtctaagccaatcaactccactttaaagaaggggaaactggccggatgccgtggctcatgcctgtaaacccagcactttcagagcctgagatgggaggattgcttgagctcaggagttccagaccagcctgggcaacatatcaagaccctgtctctatttttattaaaataaataattttttttaaagaataatagccaggtatggtggttcacacctgtaatcccatcactttgggaggccgaagctggagtcttgcatgagcccaggagtttgagaccagcctgggcaatacagtaagatgtcatctctaccaaaattttatagattagctgagtatggtggtgtgcacctgcaatcccagctactggcgagtctgaggtgagagaattgcttgagcccaggagatggaggctgcagtgagctgagattgtgccactgcactccagcctgggcaccagagtgagacccccaaaatataaaaaataaaataataataatgagagctggcattattcaacgttacctgtcagtcgctgctctacacacctcactcacatggattagctcattgagtcctcataaaaaaccccaagaggcaggctctgttatccccacttttacagatgaggaaactgaggcccaaagaagttatacaatttgcctgacagtcaatcttttatttatctgttgagacagagtctcactctgttcccaggctgtagtgcagtggcatgatcttggcttggctcactgcagcctctacctcctgggctcaagcgatcctcccacctcagcctcctgagtagctgggactgcaggtgtgcaccaccatgcctggctagttttttttgtatttttttagagatggggtttccaccatgttgccaggctggtctcaaactcctgggctcaagcgttcctcctgcttcagcctcccaaagtgctcggatgacaggcatgaaccattgttcctggcctgggggctgctttatgactataaggagcagaacactctgtggatagtgctagggtgacggaaaaattaaccttttgtgaatgggcagtcattcagcaaatatccactcctctccctcccactggagggggagtatatttccctgctccattgatgagtttgaccatatgatttacttaatggaatttcagcacatctaacttcagcaagggccttaaatgcacttggcttttgtgctcccataatatgccatgagaacatttgccaggttactgctaatcccagaaaactgtggaatctcatggaagagacctgaatcctcccaaactgcagccaaagcagccatcccacaaactcttataagaatgcttgttggtataagtctcagttttcatgttgggaggtcgaggtgggtgaatcgcttgaacccaggagtttgagaccagcctgggtaacatggggaaaccctatctctacgaaaaaatataaaaaatagctgggcttggtggcgtatgcctgtagtcccagctaccagggaggctgagcggggaggattgattgagcccataaggttgaagctgcagtgaactgtgatggtttcactgcactccggcctgtgagacagagtgagactgtatctcaaaaaaaaaaaaaaaaaaaaaaagaaaagatctcagttttaggatgatttgttacacagcattattacagtgtaagttaatacaacttggttgttttaaaccactgagattagggactcctttgttactgtaacatcatctggtccaccccaattgatgtcagtgtttagtgcctgtcaactaatggcctccacttcccaggttcaaatgattctcatgcctcagccttctgagtagttggaatttacatgcctggctaatttttgtatttataatagagaccgagttttgccatgttggctaggctggtcttgaactcctgacctcaggagttcaaggcaaatgagcaccaaatgctaatttaagtgatccacccaccttggcctcccaaaatgttgggattacaggcatgagccactgcacctgacctcagtcttttaaactgtgatagatacagattgctgacagttttagtcttgagatctagattcaagcccccagctcttcctcttaatcggtgacctcaagaaaattgtttcatttctctaacctgttttctcatgtgtccattgggaataatgacatccaagcccggagttgtgaaaattcggtgacataatgtctgcacaagtgctctgtcaacatgtaggtgtttgtgtagagggagggatttgtgtttttattacttagtgggtgatgattccactgggctctcttatgatcaagtgactccagggaaatcacatttcattctgttaccccagttgctgtggaaacagagtgactggaggcagaagagacagaacctgtctctggcctgggagagactgagggagtattgcagcggtcaccaacatggtaaaccccagagggagcagcttggggaggtgatgtgtttcagttgggatgtccaggtttgatgtgactttgggacattctaggggtggcatccaggaggcagttggggatcacatgtggagctgaagacagaatgtggggaagttgtcagtgcagagaaagaacctatagactcgggagtagatgatggatttatttgttcattcactcatttatttagtcaagtatttattaagtgccttctgtaggccaagcactgttttaatacagcagtacacagcagaagacaaaaaatattcactctcagtggggtgcagtaagctcacgcctataatcccagcactttgggaggccaaggcctggcagttcgagaccagcttgggcaacacagggaaacttcatctctactaaaaatacaaaaatctgccaagcgtggtggcctatgcctgtggtcccagctactccagaggctgaggcgggaggatcacttgagcctggaagatcaaggctgtagtgagctatgatcgcaccattgcgctccagcctgggcaacagaatgagatgctgtctcttaaaaacaaaagaaattcagtcttgtggagctttcacgttagtagggaaagactgacaaatgagtcagtgaaacatatgttggatgatgagtgctatggaggaacttaatgaaggggaatgagagtgccccagctggagctggagcagtggcaaggatttttatttaaatagtagggtccgggaaggcctccctgaaaaggggacatttgagcaacatgagctatgtatgtatctagggaaaagactctgaagctggcttgtgacagcaaggaggccagtatggctggggtggagtcagccagggggagagaggtaggagatgaggtaacagggtgggactgggaacccctaaaaaaccacttaaggcctggaaagccattgaaaggacttgagcttttactccaggtgtgagataggagccaccggagggctccgagcagaggagggacaggatctgccttaggccttcacaggatcctgctggctccatgttgacaatcaactgcaggggccacacacaggagtgggagatcagcattgcagcagttgttttgttaacttactccacgtcagagaccctttggaatgactgattgcatctggcaatgactaatttgtggggttactctggattcatcaaatgctaattttgattcttttgacgtaactgataaggcagacatttctggccaccaaggcagtaggcttatctctgggttgttatgttatgttttgagacagggtctcactctcttgcccaggttggagtgcagttgcaaagtcatggctcactgtagcctcaacctcctgggctcaggcaatcctcccacctcagcctcccagatagctgggactacaggcgtgtgccgccaggcccagctaattttaaaaatttttcgtagagatggggtctcactatgttgcccagcctggtctcggactcctgagctcaagcagtcctcctgtcttggcctcccaaagtgctggcattacaggcatgagccactgcacctggccacatctgtgggttcttctactaccctgcattttctcctctaattattgttatgcaacatctcgatcttaccacatggggcttagccatctgcttatgacagccccacacacctggttgtttgcagtagccacagcaggctctgttgtctgttcatcacctgctcccagagggaaatgccaacctctttgctaactactcctgggctggaggggtggcttggacaagacccagatataactctggtgtgtcactggaggtgtgtcatttttagaagaaatgttcatcagcaatagggcctatggtcatttttgattgttattggttttctaatcactcagttcgccactgtggtgtcttaaatttgtttttactgttttttgatgtgtaacatacatagagtgaagtgaaggtgtaagtaagagtacagctcagtgactctttgcaaactgcagccctgtgtactccacacccagatgcagcacagaacatgcctagcccccagcagttccctcaggttctttctgtcagtacccctgcaagggtaaccactgtcctgattgttaacagcatagattcattttgcctgattttgaattgcatataaaatggaatcgtgtggtataaacttttcttatctggcttcccttgttatgtttgttcatttcatctatgtcgttcagtgtagctgtagatgatttattgtgattttttttttttctgagacggagtttcgtcttgttgttctggctggagtgcaatggcacaatctcagctcactgcaacctccgcctcccaggttcaagtggttctcttgcctcagcctcccaagtagctgggattacaggcatgcaccaccacgcctggctaattttttgtatttagtagagacaggttttcaccatgttggtcaggctggtctcgaactcctgacctctagtgatccacctgccttggcctcccaaagtgctgggattacaggcatgagccactgtgctcgactcctattgtctttttttttttttttttgagacagggtctcactatgttgcccaggctggagtgcagtggcaccatctcagctcactacaggctcgacctcccgggctcaagcgatcctcccacctcagcctcctcagtagttgggactacaggcatgtgccagttcaccagtctaatttttgtattttttttgcagagatgggggtctcactgtgttgtctaggctggtcttgaactcctggactcaagcattcctcctgcctcagcttcttaaatccttgggattacagacatgagccactgcacctggcctattgtcatttctgtatagtattctgttgtattgagataactattatggttttatttatttatatttgatttttttttttaaacggagtctcactatgttgccaaggctggtcttgaactgttgatctcaggtgatcccccaacttggcctcctgagtagctaggactataggtgcacaccaccacacccaactaatttttttttttttttttaagctttttggaggcagcttcctgagtagctgggattacagggattacagacagagccacaaagacctggccattggggttttattatatttgctttctgaatgggtattatatgcatatagtgcaaaattcaaaaggtgcaaaagggtatacactaaaaagaaaatctcccctcaccctttccatccctccctgctccctccccaactcctgctccctccccaactcctgctccctcattcttctctcctgatgcaaccaccattagcagtttttttgggtggtcttcctgggtcattctgtacacatacaagcatatatacctaccgcctccatccctttttaaaaaattcatagtatatacactgttcccttgtgtgttttttttcaagtaacagtgtattttggagatgcacactgcatgaagttctaccttatttatttatttatttatttacttacttacttacttacttactttgagacagaatctcgctctgtcactcaggctggagtgtagtagtgcgatcgtggctcactgcaacctccccctcccagcttcaagtgattctcctgcctcaatctccctagtagctgggattacgggcacatgccaccaggcttggctaatttttgtatttttggtagagatggggtttccccatgttagccaggctggtcttgaattcctgacctcaagtgatcctcctgccttggcctcccaaagtgttgggattacaggcgtcagccacgccgtgcgcagcctaccttattcttttaaatgatgcatacaattgcatttcatggccgggcgcggtggctcacgcctgtaatcccagcactttgggaggctgaggcaggtggatcacgaggtcaggtgttcaagaccagcctggccaagatggtggaaccctgtctctactaaaaatataaaaattagccaggtgcagtggtgggcacctgtaatcccagctacctgggaggctgaggcaggagaattgtttgaacccgggaggcggaggttgcagagagccgagatcgtgccactgtactctagcctgggtgacagagcaagactctgtctcaaaaaaaaaaaaaaaagaaaagattgcatttcatggatgtgaaacagttttttagcaatatatctcaggaactttgccttcctgtgccatgtttgtttcaggaacagttcatatcagaactgtgtctccctgagaaagctgcatgcacacgaacccaggccatcggtgatagtcatcttgtgctcttatcctcacagctgatacatactgagcactcatctcttattttgagaaaaattcacataaaatttactgttttaaccatttaaagtgcacatttcagccagatgcggtagctcacacctgtaatcccagcactttgggaggccaaggcgggtggattgcttgaggtcagggattcgagactaggctggccaacatggtgaaaccccatctctactgaaaatacaaaaattagccgggggtggtggtgcgtgcctgtagtcccagctattcgggaggctgaggcaagagaatcacttgaactggaaggcagagtttgcagtgagctgagattgcaccactgcactccagcctgggcaacagagtgagactccgtctcaacaaaaaacataaataaataaataaataaagtgcacatttcagggttttttttttttttttagcatattgacaatgttcttcaaccatctccattctctaattcagaatattttcatcactccaaaaagaaaccacataaccattaaacagtcacttcttattctctccccaatgttgcccttggcaaccactgatctactttctgcttctctggatttgcgtattctggacttataaatgtatacgtggtcttttacacttaaccttgttacactttgcataatgtttctgaggttcatccatgttgtagcatatatcacaacttcagttttttaaataactggatgatattccataaatatactgtacaatgtttatctattcatcaactgatggacatttattgggttgttaccatgtatatataaacctttttttttttttttttttgagattgagtcttgctctgttgcccaggctggaatgcagtggtgcaatctcggctcactgcaacctctgcttcccaggttcaagtgattctcgtgcctcagtctcctgagtagctgggactacaggcgcatgccaccatgcccaactaatttttctgtttttagtagagacggggtttcgccgtgttgcccaggttggtcttgaactcctgggctcaagaaatccacctgccttggcctcccaaagtgttgggattacaggcgtgagccaccaccccagcctccatgtataaacatttttatcagattcttaaaaagtatttatttacttttttttttttttttttttgagacagagtcttgctctgccacccaggctggaatgcagtggcatgatcttggctcactgcaacctccgcctcctgggttcaagcaattctctgcctcagcctcccgagtagctgggattacaggcgcctgccaccatgcctggttaatttttgtatttttactagagacggggtttcaccctcttggccagcctggtcttgaactctcctgaccttgtgatctgccaacctctgcctcccgaagtgctaggattacaggcctgagccaccgtgcctggccacttttttttttttttagatggagtctcactctgtcacccaggctggagtgcagtggcatgatttcggttcgctgcaacttctgcctcccaggttcaagtgattctctggcctcagcctcctgtgtagctgggattacaggtgcacgccaccaagtctggctaatttttatatttttagtagagacagggtttcaccatattggtcatgctggtcttgaactcctggcctcaagtgatctgcctgccttggcctcccaaagtgctgagattacaggtgtgagccactgtgcccagcctgttgttttctctcttgagacagagtctcactttatcacccaggctggggtgtagtggctcgtctcaactcactgcaacctccacctcccaggttcaagtaattcttgtgccttagcctcctgagtagctgggattattgaggtgcgtgtcaccacacccagctaactttttttatttttggtagagacagggttttgctatgttggccaggctggtctcgaactcctggcctcaagtgattctcccgcctccacctcccacggtgctgggattacaggcgtgagccagtgctcctagccaggactttttttatatacaaagaagaaatgtcagggagtgcctgtttaaagtagaaatagttatttatgcagtaggaattgttcatttaaaatacaagcatctccatcctaccacatttaggagctatgctgaatattgtgggagaggtaaagatgttgagtttgactcagggatggaaagaaaggagttgagaacagtggtggtattggacagtgctttgcagtcaggcagttgcgtccgaagtactctgctagttattagcttgtgtgccatgtaagctattgattaaacctgtctgagcctcagtttccccatctgtgaaactggagtcgtaacagacccttctatttaaagtggttttgaggcttcagtgatgcccggcccatgcttagccaagtgtggtggacagaacagtggtgctcaaaagatgttcatgtcctcatccccagaacctggaaatattttaatggccaaaggagctctgtgggtttgattaaattaaggatcttgagatggggagagtgccctggattatctggtgggcctcacgtaacccccagaggccttataagggaaagagggaggcaagagagctggaaccagagctgtgaagatgcaagcagagcctggagtgatgccagcgctttcagcagctttgaagacgaggaagggactgtgagccaaggaaggcaggtggcctcgagaagccgaagatgcaaggagacacgttctcctctagtgctcccggaaggaaggaatgcagccctgccgcatctagattttagccctgtaaggccgagtttcagacttttgacctccagatctgtaagatattaaatttgtgtgttttttttttgtttttttgagacggagtttcgctcttcttgcccaggctggagtgcagtggtgtgatctcggctcactgcaacctccgcccccccggtttaagcaattctcctgcctcagcctcctgagtagctgggattacaggcatgcgccaccacgcctggctaattttgtatttttagtagagacggagtttctgcattttggtcaggctggtctcgaactccctacctcaggtgatccgcctgcctcagtctcccaaagttctgggattacaggcgtgagccactgcgcctggccaaatttgtgtttttagccacaaagtttgtgctaatttgtacaacagtaacaggaaactcatacaccaagcacctggcacatggtgagaatccgaaaatgttagccatgatgatcctcttgtgacagatgggacacccaggcaagcagcagagaaggggctcaacagggccacttggtaagggaggacagagccagagttactgcttaataactcttgagtagtaacttctgcaaacggttgctgggcgcctgttctgtgtctgtctgtacatccattgggaatgcagtagaggcctgctgtgttaatgatattcgcagctgacatttatgtagtgtttgctcggtgccaggcagtattccaggcacttggtatgttatttctcattcttggtatggatttgaatgttctcaacaactttatgagatagacgttgttattgtccccatttcataggttcgaaaactaaggcacaaggggtgaaatgaaaccatttgctccaggatcacacagcaggaaatcagcagagctgggaaggaccagacactgttcttggccttggggacacagtagggaacaactcagacgatactgtccttgctcttgtggagcttaaaagtctggcgggagagacagatgctagacaaatacaaacaaaaaagatgtaactgtgtaacaccaggcagtaatcatgaagaaaagtaaagtcgggtagggagatagagagtggcaccaggtagggggcgaggtaggttacttatggtctgaagtgacatctgagtgggcacctgaagcacagaaggcaaacttttacccagctatggatatgtttgagggaagagtggtctaggcagggggattggcaggtgcagaggccctgaggtgggaaggagccagactgttcttggcacagaagggaggccgttgtggctggtggaaagtcaccaagcctggcctggggagcagtcagactgggacttcttgttgttgttgtttttgttgttgttgttgtttttgagacagagtctcactccatcgcccaagctggagtgcagtggcacaatctcggctcactgcaacctctgcctcccgggttcaagtgattctcctgcctcagcctccccagtatctgggattacaggcgctcaccaccatgcccggctaattttaattttcatatttttagtagagacagggtttcaccatgttggccaggctagtctcaaactcctgacctcaagcgattcacctgtctcagcctcccaaagtgctggtattacgggtgtgagccaccacacctggcccagactgggacatctcatgagcccaggcagcactgtacactgcccagggcccagggctgggaatggcggtggaggcaggggagtcagcaggaggtctgccggcctcagccttaggcaggcccttcctccagcaccatcttcctcctctagcacgtcagtggtgtgatggaggagcacgcgtggactgttgccagcctgcctgggttccggtccggctttgccacccaccagctgtgaagttacataaccacttcctgcctccgtttgctcatgtgtaagatggagataattatagcaactgcctggcagagccattgcaggagagtagatacatgtattattagcaggagtctggcacaccaggagcgctcagtgcactcggatgttggccgcagttgtggttatagttgttaattctgtgtcatctcaacttccttcagagggagggtaagtttttttttgaagacaaggtctcatcactctgtcgcccagagtacagtgatgcgaacatgactcactgcagccttgacctccccaggctcacgcgatcctccttcctcagcctcctgagtagctgggaccacaggtatgtgccaccatgccttgctaatttttgtaatttttgtagagacaaggtctggctatgttgcccaggctggtcttgaactcccagcctcaagtgatcctcccaccccagcctcccaaagtgctggttatagagacgtgagccactgcgcctggccaaggagggagggttgttatgaccatcttccctttttgcatgtgaggaaactgcctcacagagacgttgaatacgtcacccaaggttgtgcaggttggaaatggcattgctgtatttgagcccaggcctacctcaccccaagtccaggctccctccttccatacagtggtgttcctgttgatagcagtgtgcaggtgatgtctagatgatctgacagggaggcaacagagcagattggagcatctgtcatcaccaggggtgggagagggcagtgtagggtggactaggtaccttggttttttttttttttttttttgtgacagagtctcgctctgtcacccaggctggagtgcagtggcatgatctctgcttactgaaacctctgcctcctaggttcaagagattcttgtgcctcagcctcttgaagagctgggactacaggcatgtgtcaccatgcccggctatattttatatttttagtagagaaggggttttgccatgttggccaggctggcctcaagtggtccactgccttggcctcgcagagtgctggatttacaggcttgagccactgcacctggcccaggtacctttgagagttgtaataatgcgtcattctaggatcctaataaaagagccccaaactggaaggcaggacacttgcctcaacctaactgcctcccgtgcccgcatggcccgcacggctttctgcatcttcatctgtcagacaggaatggcagatcctttgagatgagccctcctataggtagctcttttcttctttcaacaaatagttgtctagcactgactaataatacctcctgactgacagcagataattgcctactcttcgccatgccctgtggccattatttatgtgcatgatcctagatatggtggtcattcccattttacagatgagaaaactgaggctccaaaaggttaactggtatggtcatacagctagtgtgcagcacagctgggattcaaacccaggaaccagcggtgagcaagatcggacaaagcccctgccctcagggaggtttcctggagtcctctgcgattgtgggtgaggggtgacatgtgctgtttgtctgcatgatgatttgaataaagttataactctggcaagtgcttatcaaggagagctctatggcagtgtgtgataagctgacctggtggagtctggagaggtcagggaagcaggtatgtgtgaggtgggcgcgtatgcattcattcagtgactattttgtgagtttctgctccatgccataccctgtgctgcatggaggggacacatggcaccattcaaccctggtgtgccccctcacagaattgacattacagggacatggtgatccaaaggagattcatcctgaggtcccacagtgagcccagaggcagagcaggcactgacagtggcctctctctctgcccacagttggagaaggaggagcagatacacagtgtggacattgggaatgatggctcagctttcgtggaggtgctggtgggcagttcagctggaggcgctggggagcaagactatgaggtaagcagggctatgagatggatcccatactgacctctgcccctcatgctcgcatcaccgtctcccccaggggctggggctgggaagacatggggcagatgtgagtcacacctgattgctgccctctggaggatcacccagtgtacggaggagacagaaggcagacacagggcggtaaactgcacatcagggaagagagcaagtttggatcatggcttaaaatgacacaaatgtattattcgactgttctggaggtcagaagtctgaaatcactctcactgggctaaaatctaggtgtaggcagagccctgttccttctggaggctctaggggagaatccatttccttgcctatttcagcttctagagtccatctgccctcctcagcttgtgacccttccttcatcaaagccagcactcctgtcactctaacgcctgcttccacttccattgttacttctccaactctgactctcttgccttctttttttctttttctttttttttttttgagacggagtctcgctctgtcgcccaggctggagtgagtgcactggcgcgatctcagctccttgcaacctctgcctcccgggttcaagctattcttctgcctcagcctcccgagttgctgggactacaggtgcccaccaccacgcccggctaactttttttttttgtatttttagtagagacggggtttcaccatattggccaggctggtctcgaactcctgacctcgtcatctgcccgcctcagcctcccaaagtgctgggattacaggcgtgagccactgcgcctggccttctttttcttttgttcatttttttttgagacagggtttcatttccgttgcccaggctggagtacagtggcgtgttctcagctcactgcaacttctgcctctgaggttcaagtgattctcccacctcagcctcccaagtagccagggctacaggtgcacaccaccactcctggctagcttttgttattttttatagagagagggtttcactgtgttgcccaggctggtctcaaactcctgggctcaagtgatccacccaccccagcctcccaaagtgctaggattacaggcatgagccaccacacccagccctcctttcttataaagacccttatgatgacacttggcctacccggataatccaggggcatctcccccatttcaacatcttcaagttcatcacatctgcaaagtgccttctgccacatttccaggttcagggattaggatgtaaacatctttgaggagctgttattctgcctgtctcctatgttttcttctagaagctttctatttttagattttacatttagatctctgtttcatctcaagtgaatttttgtgtattgtgtgaagcaggggataaggtttattttttctgtatcttttttttttttttttttttttgagatggagtctcactctgttgcccaggctggagtgcagtggcgcgatctcggctcactgcaagctccacctcccgggttcacgccattctgcctcagcctccggagtagctgggactacaggcacgtgccaccatgcccggctaattttttgtatttttagtagagacagggtttcactgtgttagccaggatggtctcgatctcctgaccttgtgatctgcccaccttagcctcccaaagtgctgggattacaggtgtgagccaccgcacccggcccttttctgtatcttttttatatgtttgttgacaatgcttatttatttattttatttattttaagacagagtctcactctgttggccaggctggagtgcagtggcatgatcttggctcactgcaacctccgcttcccagactcaagggattctccagcctcagcctcctgagtagctgggactataggtgtgagccgccatacccggctaattttttaaaaaattttttgtagaaatggggtttcactacattgcctggctggtcttgaactcctgagcttaaagtgatcctcccaccttggcctcccaaagtattgggattacagacctgagccactgcacctggctgaaaatactttgaaaaaaaaaaaaagacttgccttttctcattgaatcattttgactccttgttgagaattaattaaccatatgtatgggtttatttctgtactctcttctctgttccattgatatgtatagttttctttatgccaataccaaactgtctctttttttaaccatattatttatttatgtatatatgtatttatttatttatttatttatttatttgagatgggggtctcactctgttgctcaggttggagtacagtggcatgatctcagctcactgcaacctctgcctcctgggctcaagtgatcctcccgcctcagccccccaagtagctagtgggagccaccatgcccggctaatttttaaatattttttgtagaaatagggtttcactgtgttgcccaggctggtcttgaactcctgaggtcaggtgatccacctgctgcggcctcccaaagtgctaggattacacatgtgagccgctgtgtgtacctggcctactcttttttttttgaaacgaggtctcactttgtcacccaggctggagtgcagtggcacgatctcagctcactgcagccttgtcctcccgggttcaagtgatcctccttccacagcccctcaagtagctgggactacaggcttgcaccaccatgcccaactttgcactagtcagtgtgacaaggtgagaaaaagaaaaaagaaaactatcttttttcacagatggcatgattgtctatgcagaaaatcccaagagatctagacaaactacaaggtttagtaagtgaaggtcacaagatgagaagtcaatatacaaaataaactgtatattacacatcacttctgtggtattctggccaaagtgtgcaacctaaattaatcacaaggaaacatcagatactttgtacaataagtgatatctgacaaaaatcactgacctctactcttcaaaaacatcaaaggcacaaacccaaagtcacaggagccttccttccttccattctccctcccctccttccctccctccttcctttttttttttttttttttttttttttgagatggaattttgctcctgttgcccaggctggagtgcagtggtgcaatctcggctcactgcaacctccgcctcccaggtacaaacgattctccatcttagcctcccaagtagctcggattacaggcctgtgccaccatgcatggctattttttttgtatttagtaggacagggttttcccatgttagtcaccagatgataaatgcagcttccctgtcagctccaaatcaggccttttataaacaagtatagtcaaggtcaggaagaaaacttcccttctgtataattgtctttcttgtttcctttgcataatcagctgtgcacaaagagagctatagttatgttctgtttttctcagcaaaaggctttattgtccaattttataatttcacagcatgtcagttagaaaagagactaagtcagtaacaaaatatacccaaccaaaagtggctgcattcatctttttttttttttttttttttttgagacggagtctcgctctattgccaggctggagtgcagtggcgcaatcttggctcactgcaacctccgcctcctgggttcaagtgattctcctgcctcagcctcccgagtagctgggactacaggcacgcgccaccatgcccagctaatttttttgtatttttagtagagatggggtttcactatgttggccaggatggtctcgatctcctgacctcgtgatttgcctgctttggcctcccaaagtgctgggattacaggtgtgagccactgtgcccagtctttttgtttcgttttttgttttttggcagagtcttgctccgtcacccaggctggaatgcagtggcacaatctcggctcaccatcacctccaactcctgggttcaagcgattcttgtgcctcagcctctcgagtagctgggattataggtgcctaccaccatgtccagctaatttttgtatttttagtaaagacggtgtttcaccatgttggctaggctggtcttgaactcctggcctcttgtccaccaggcttaagtgcaatggtgcgatctcagctcactgcaacctccgcctcctgggttcaagcaattctcgtgcctcagcctcccgagtagctgggacaacaggcgtctgccaccatgcccggcttaaattttgtatttttagtagagatggggttttaccatgttggccaggctggtattgaactcctaacctcaaatgatccgcctgccttggcctcccaaagtgctgggattacaggcgtgagccaccgcgcctggcctcagcttgggtttttcaatgcagattgctaacatgaattgctactctcaattccttgagagaacagacttgtgaggagttctcccgagaagaattttcacctcttctttggtgtccccccaagctaaggccaagacagacaggcctcccagggactctttccacaggcttatttccccttcatgtaactagtgtgggcgttgcctttggggagtcctcagttctatgcagtgtggtgaggatctctgagatgccactctcccttgcttggagcctaggttttctctcttgttctctttcaccaccacgtgcataacccttaaagatcaagttctagctgggtgtggtggcttacacttgtacttctatagctttgggaggctgaggtgagaggatcatttgaggccaggagttcaggaccagcctgggcaacatagcaagaccatgcctctacaaaaaataaaaaattagccaggtgtggtgtcgtgcatctctagacccagctactcagaggccaaggtgggagaatcacttgagacccagaggtcgaggctgcagtgagctatgatcgcaccactgtgctccagcctgggtgacagagaaagaccctgtctcttaaaaaaataataataataaataaaatcaagttatttgctatctgggatcagcaccacgacaaactaccaacatgagtgctgccgggtcagtcagggtccttgcccggagattaaaaccacaccagttattttaacagataatttgatagaaagaaccagtaactaggtgttactagaagactaagatatgagggagaagcaaccgcagggagtagctaccactcccagggttgggggaacaaaagaaaggagcaggaattattgaaacgtagatgtttggaaactgggaggtggggctccaggagctgaaattcagatcgtttgaggagggcttcctcccccaccggctgctgagaggggctgaatgaggctgtttctggaggtattgggacactgcaaactggattcatctgctgctgcaggcaggaaccactgcagcagcagaagcttaactgggggtgatgctcacaggatctgcaatgcacgagaagctggtccttcctccctcctgcagccttgcaaactctctctcttgccccccctattggcagagcctggtcacgatcagctagggaagcagaaaggtggtttgccaagtgcgggcccagatcacagagatgagttgtagagggtaggtttgagctgagaaacaatcacttaatacttagtgcagctcgcctgactctctggattctgttttctcatttccagcctctagtaattccccttgcctttccgctgactcacctgtgcatttccaaaaggtgtttgaatattgtgccagtttactgaatattctctgccgggaaagttccttaggacatgtagcccgctgtattgccagatatggaagactccatgggagaatttagataagggtcgctcacatctggaggataaagagatccctctggggcctgtgtcagggcaggactgactcaaggcctagaaacaaagggtctggagacatctaggcccaagctacattctagtgactcccagtcccctgtgtgggccctgtgccctcttccccagcccctagaagctctcatctaagccaacctgccctggttctcatgcactgtggcttctcccacccaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggtacctagggtgggagccagggtgcagagtccttggtcctgggcaaggagggaaataagggccaatattgagtcccatagggctgggaggagtagacagctggtgtcccatgggattatggggaggctgggtccctgcgttccctgaaatgggtttgggatctttcctgtaatgagaagtttcatctcccggagggaatctaggaagggtgaactgcagcatctcagaggggaatcggaggaggggaactgacttgttagagaggtggcctagtagagtgggcctagtagttaacatcaggagatctggcgtctgattactgagttcacgtcctggctataccactttttagctgtgtgatcttgggcaagtgacttacgctctctgggcctccattgcctgatccttacagggttgctgtaggttaagggatgctaaaagctgtggtaacagtgagactggagtatgtgatgatgccacacactaaaggtgtgcttcttgcccaggtaactgtcctggggagtgtttagcctgtcagctggcttctccttatgaggtcgtgcagggacccagacttctcctattttctggctctgcatccagctggcagaggagagagcctggaacacttctgtgttctggaagtggcacgcagcactccctcccattccacaggcaggagtttgtgcatagggcagtgaattcgctgggacacctagtagactctgccaattgcccaaagagctaatgcgtgaaaagggcttggagccagactcagagttagggctcagtcataacagcttaatcctataattgtcatcaccatcgccagggcccctccttcaacatgggtgttcatgagagggaaggagccaggaagaggtttccctgagtgaaaagggtcttgggccctggcctctgtccttgggccagactccctgactcccacccctcctttcccaggactccccctttggcttgagttttgtacggtttcatagccccccagacaaagatgaggcagaggccccgtcccaggtaagctgtacctgtcactccccatggccttctccctgcctctccacccccacctgccagcagcccacctataatactgaccttgcgggaccttagaaggtgacagtgaccaagcttggccagttccgtgtgaaggaggaggatgagagcgccaactctctgaggccgggggctctcttcttcagccggatcaacaagacatccccaggtgagctcggacaacgtgggtcctgagtgagtagggttgagacctagactcgtgggtctgagggtagagggggctggggctcagattcctgggtctgagggaggagggtagtggagtcctggactcctgggtctcagggtggaggaaggtgggcctggcctcttgtgtcctgagggttgagaggtctggaggctgggactcctggatcactggtgggttttggcaacaatattctgtgtcccatagataggagtgaaagggtcttggggctcagccctctcatcctggatccactttctcccttcatagtcacagccagcgacccggcaggacctagctatgcagctgctaccctccaggcttctagtgctgcctcctcagcctctccagtctccagggccataggcagcacctccaaggtgaaatcatcagactttggtggggtggaggaggagagaagctggaggcctcaatccatccccatcccctcagccccaggagtctcccaaagggaagaggaagttggatttgaaccaagaagaaaagaagacccccagcaaaccaccagcccagctgtcgccatctgttcccaagagacctaaatgtgagctaactagatcccttgtttccacaggggcctgtgctcctgtgtcctaggggaagcggggctggagcctgctgtcctgaatctgagggaggaagggctgggggcctggacccctgggtctgagggaggaggggctgggggcctggattcctgaatccgagggaggaggggctgagggcctaaacccctgggtctgagggaggaggggctgggagcctggacccctgggtctgagagaggaggggttgggggcctggatccctgggtctgagggaggaggggctgggggcctggactcctgggcctgagggaggaggggctgggggcctggactcctgggtctgagggaggaggggctgggggcctggacccctgggtctgaggggggaggggctggggcctggattgctgggtctgagggaggagggtctggggcctggactgctgggtctgagggaggaggggctgggggttgacccccagtggtgctaacctaatctactctttgtcttctccagtgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatgtaggcttgcgcccccctccctgcgccgctgcagtttctcccccagctccctgtgtctcctccaccttgtgctttctctgtgtccactatgctgcatgctttctctctctctcactcgctttctttctcactgcattctgtagcctttgtcttctctctgatttttgcatctctcccttggtctccaacctctttttgtttctcccacctcaatctcatgatctgtctgtctgtctgtctctctctctctctgtctgtctcccctgtctcattcccctttgcccctcagatcacacctaactggcatcttcacttctgccccccaccagctgtgcctttgccaacacccccaagtacagccaggtcctaggcctgggaggccgcatcgtgcgtaaggagtgggtgctggactgtcaccgcatgcgtcggcggctgccctcccggaggtaaggcctcacacgccaaccctgctccttatcctgtgctgggcaatgccaggaatctggaggggagtcagactggggcctgccagcggagaacacaggtggtcccagcccagagccagcagactactgagaggagcggggcaggggctggggtactccagatgagggaaggaggacctgcctgggaggtcacagagggctctgtgaagcctgcttatcagaaaaggctggaggagcagtttgtgcaaaaactcaggggtgggagaacaagtgttagggtccatattcattcattcaaagtgagtcccggtgcagtggctcacgcctgtaatcccagcactctgggaggctgaggcaggtggatcacttgaggtcagaagttcgagaccagcctggccaacatggtgaaaccccatctctactaaaaacacaaaaattagctgggcttggtggcgcacgcctgtaatcccagttactcggaaggctgaggcaggagaatcgcttgaacctggaagccaaaatcgtgccactgcactctggcctgggtgacagagcgagactcccatctcaacaagaaaaaaaaaacccaaaaaccaaaatgagtcccagaagcccctgcttggtgccaggctggaatgtgcaaggctgaggatccagtcattgagccctgcccttgaaggcttctcactttgatgagggatcagaattgttgtaacagtgcagtggaagccccacagggtggcccgcagagagcgaggggtcttcaaggtccaagagaggtttttcaggctgaacagaggcagagaacatgctgggcagaggagacaaggtcaggtcagcctgttgtctgcctggagttgtaggtgaggctgagcttacacaggggcaagaagtggcaggaaaaatgggactggggcattaggaaccacagaaggctttggactgagcaaaggctagctcatatctgaggtccatgaattggaggggagactggattgtactccatggcctgagtgtgttcagaagttagttgtacctggtgtatttgagaaattatttgccttgggggatagcgaggctgtgaggtgggtgggctcaggtcagaaggggcttccggagcccaggctacacactgggctccatgcagcttcacagaaccctcatctgttattcaggaatccaaacatctctagaagctgaaagttcttttctaggttcagcacaaactcatttcgctgcagtcatcctgaactaatgtgaggctatttgcggacttttttttttttatccccttaagtgtgtcatggtcttaactgcagaaatattagtgggtttgatcatggggtgctcccccaggccctcctgggagtttatgtaacaatctgtatgccagccatttgcctctctaaaacctgaaagattcaaaattctgaagcccatccagctccagaggcctcctcttgtgagcagaggggagtcacagaaggtttgatgggggcaggggcaggctctgttgggagggatgaagtgtcaaggggaggctgcaggtggggactcctgagtaggctggggcctcaggaacagaagaggggatgggctggtgctatatctggggcagaaggaaccagatttgggttattatctgcctgggagagcttaaggagggcatgaaagaaagggaaaaagacaaacagtgttggatttgcaactggtcttaacaaaaagaattcacaaagcattttatatttttaaaaattctggcttgtactcatttataaactaaaaaaaaataactatatgatgcaggcaacgtggtgagaccccatccctacaaaacatgaaaaaaattatccaggtgtggtggcacatacctgtagtcgtagatacttgggaggctgaggtggtaggatcacttgagcccaggaggttcaggctgcaatgagccatgattgcaccgctgcactccagtctaggtggcaaatcaagaccttatctcaaaaataaaaatttggctgagtgcagtggctcacgcctgtaatcccagcactttgggaggccaaggtgggcagatcacgtgacatcaggagtttgagaccagcctggccaacatggtaaaaccccatctgtaccaaaaaatacaaaaattagctgggcatggtggcgcacacctgtagccccagctactctagaggctgaggcaggagaatcccttgaacctgggaggaaggggttgaagtgagtcgagatcatgccactgcactccagcctggggacagagcgagactctgtctcaaaaaataaaaataaaataaaaattcaactatagaaggaagaccccaagaggatgactctccatacctaataagcacaaatttagttttttttttaatctttgaatagagcactttgaagaaaaagttaagtaaacctgctattgactgttaatgaactactacattttaaatcctctgaatctcctgtaggcaccgttttatgagtgtgacttacctaaacagcatttcaccagcttgaaaacaaccaaattaaatgcagaagggtcttaacatgtatgtctcagaaaaatggagctaatacattcatttgtgtctgcataccttccctgtggcttagggcagattaaataatctctctgtgccttagtctcctcacctgtaaaatggggccaaaaataggacctaccccaggattcagtgactcagtatttgtcacgtgctacctggcatgtaggaagtcccatgtaagtgtcaacctgctactgttgtgtttttttttttttttttttttttttgatcattcttgggtgtttctcacagagggggatttggcagggtcataggacaatagtgaagggaaggtcagcagataaacaagtgaacaaaggtctctggctttcctaggcagaggaccctgcggccttccgcagtgtttgtgtccctgggtacttgagattagggagtggtgatgactcttaatgagcatgctgccttcaagcatctgtttaacaaagcacatcttgcaccgcccttaatccatttaaccctgagtggacacaacacatgtttcagagagcacagggttgagggtaaggtcgtagattaacagcatcccaaggcagaagagtttttcttagtacagaacaaaatgaagtctcccatgtctacttctttctacacagacacagcaacaatctgatttctctatcttttccccacctttcccccttttctattccacaaaaccgccatcgtcatcatggcccgttctcaatgagctgttgggtacacctcccagacggggtggtggccaggcagaggggctcctcacttcccagaaggggcggccgggcagaggcgccccccacctccctcccggacgggaacctgctgctgttgttagagctaggaaaatccttttcctggaatgttagtggcttaaggaaccatgattatagtgttgtagtctttaaaatgtgtttgctttgagattttccccttaaatggtgggtattttcctaatgagaaactgcctttgattcttaaaggagaaagttctgatttttcattcctttctgaattgagacatttcttccccaagagggaggggaattctgggtactgtggttcatgcctgtaatcccagcactttgggaggctgaggtgggtggatcactcgaggtcaggagttcgagaccatcctggccaacgtgatgaaacctcgtatgtacttaaaaaacaaaacaacacaaaaaacacaaaattagccaggcgtggtggcacatgcctgtaatcgcagttactggggaggctgaggcaggagactcgctcgaaccctgggaggtggaggttgcagtgagccaagatcacgccactgcactctatcctgggtgacagagtgagatcttgtctaaaaaaaaaaaaagcggccaggagtggtggctaacgcctgtaattccagcactttcagaggctgacgggggcagagcatgaggtcaggagatcgagaccatcctggccaacatggtgaaaccgtgtctctactaaaatacaaaaagttggcggggcatggtggtgtgcacctgtaatcccagctactagggaggctgaggcaggggagtcgctcgaacctggaggcagagattgcagtgagccgagatgaggccactgcactccagcctggcgatggaatggactctgtctcaaaaaaaaaagagggaggggaagaaagggggtacccaggtctgcagggcaggtggccagactgactgggttcactggggccttcctgagctgggagagaatgggctgggaacaagaccatgaggcccactagagtgagtattttagtaaatgccaatggctgttgcctcctgaacgccctccccacttcccttgggcctgtttgtctgaggcccgatttgtcccctaggtacctcatggcagggccaggttccagcagtgaggaggatgaggcctctcacagcggtggcagcggagatgaagcccccaagcttcctcagaaggtctgatgccccctgtccagtgggggagggtgtagtgggaggatgacatgagtccgctgtggcaccccaaacttcccactcttgcctcttgcaggtacccccccaacacacccacactgttcctgccctcctcacccacccactctccctccttagcaaccccagaccaaaaccaagcccactcaggcagctggacccagctcaccccagaagcccccaacccctgaagagaccaaagcagcctcaccagtgctccaggaagatatagacattgagggggtacagtcaggtcagactctgagggaggaggggctggggcctgggctcctgagtctgagggaggagggcctgcggcctgggctcctgagtctgagggaggaggggctggggcctggactcctgagtctgagggaagagagcctggggacctggactcctgggtctgagggatgaggggctgggggcctggactcctgggtctgagggaggaggggctgggggcctgggcttctgggtctgagggaggaggggctgggggctggactcctgtgtctgagggaggaagggctgagtcctggactcctgggtctgagggaggaggggctggggcctggactcctggatcagagggaggaggggctgggggcccagacgactggatctggagggcagttgaggctgggggcatgagatgcctgggtctgtgccatactgggagagctgccagtcttcccaggagacaaggcagccttgcattgactgagcttctacttgcagaaggacaggacaatggggcggaagattctggggacacagaggatgagctgaggaggtagggctagggctgggggttggggtgtccctggccttgggtgtaggggaggctgctctgcatgctcactctctactcctcttggcacccccagggtggcagagcagaaggaacacagactgccccctggccaggaggagaatggggaagacccgtatgcaggctccacggatgagaacacggacagtgaggaacaccaggagcctcctgatctgccagtccctgagctcccaggtgggaaatccccccatccctcctgaagtggcattttctcttctcagttctcagctgggacttgccctggccagccctggggtcactgctgcccccgtgtcttgcctcccctctccttcctcaacccactccctgcctcagcaccttcaggttctgccaggcttgttcctttcctttcagcatcctctctgtgacttgcctttttctcccctccagatttcttgttctgaccactcccctcgcagccatgtgccaggtgtgacctcctttttttcacgtcaggggtgagggccccaccctcatgctagtgcttcacttgctcaggtgccgttctgttggtctggggtgaagccgggcacaccaggtgacaggggcactgctctctgtcaggccctgggtgggtgcacaccagtgtctgctttaacatcagccatcactctggacgtggatgctgtctgcacacattgtgtgtttgcatttccagtgtaaaagaataagaacaaaaggaaatggggaaactctgcagggagttgtgggatgaggggcagggaggcagagcttcttcgagaatgaagggagcagaggaaagacagtcacgggctgtgcagaggtgtggttctggggcttccagaagagccgtttccacccagttcctcgtgggtgatgggcaggaagatgctttgattctcccaagcccctaaagtggcatcagcaaattgatggcctagagagtcaccttaaaatggaaagaaggagccaccccaaaggtcagaacaagaaaggcactggttggaaaggagagcaaaggtgaagaagtggcagatactgacgttttcagcctggactaagctcattaagtggctccaggcaggccaggcgtggtggctcaccctgtactttgagaggccgaggtgggaggactgcttgagtccaagagttcaagaccagcctgggcaacatagtgagaccccccccaacccccgcctttacaaaacattttaaaaattagccgagcgtggtggtgtgctactcagtagtcctggctactcaggaggctgaggtgggaggattgcttgagcccaagagtttgagaccagcctgagcaacatgtcaataccccgtctctctacaaaaagtttaaaaattagtctggcttggtggcatgcacctgtagtcccagctactggggaggctgagatgggagaatcacttgagcccaggaggcagaggttgcagtgaggcaagatcacgccactgcactccagcctgggcgacagagtgagtccttgtcttaaaaaaaaaaaagagagagagagaggtaagtggctccagcctgtcggtcagaaacaaatcacaataataggcattgtatcttctaccattaaagcaaaccaaccaaccaaccaacctacctccccaggaggctctgatgggccgctgggcagggtccactgcctgccatcaatccctgcccacatgtggacagccctctcctcagctgctgggtcagcctcgtcactcctgtttggtgcctgggaactcctggggcctcatgcttaccttagcccccttctctcctgcagatttcttccagggcaagcacttctttctttacggggagttccctggggacgagcggcggaaactcatccgatacgtcacagccttcaatgggtgagtctccagggactggggtggggaaggggtgatggatccaagggaacgctcagggacctgctgggaggggtgggggtgtgggaaagaagaccatcaggaggatggagaagggccatgcccagcaggtgggcacaggtcatggaatccgaatgctagcttgcccaccaccggcagcccagggtgcattgcttgcctcagtttcctcttctgtatggcgaggatccctacccctacccctgcttctgaaagggacagcctgaggattagccactgtgggagctctggtcattgtggctgtggcaagatggatacatgaaagaatggagcctagaggcaacctagaggcgcataggtggggacagtgtggggacagccattgagagtggctggggagtaggacgtcagtgctgattccctgatgtgccttctacctcttttcttctctcccgccagggagctcgaggactatatgagtgaccgggttcagtttgtgatcacagcacaggaatgggatcccagctttgaggaggtgagtaccaaagaggcagagaatgggagacccgggcacacctttgcatctcctccgtcctcccctcgatgacacattcccgtatggactccaccccaccctgcaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctcatccaagagtctcccaaaactctaagaggctccctgggacctggggaagaatgctgggcacctccgtcagagatctggtagagaaggaactctttgtctcttctgcttggccccttatccctgtgttggcaagaggcagggaactgggaatctgaccctcagcactgcccctcaactttttctggccctctgagccacacctgtatcttggctgtccctttgtggctggaggcctgggtacccatgaggcttgtctctctcctgaagcctcagcgtccccaggccagggatagtgcctttcctccagggttttcagaagtagctgtataatgaatgtcaccactgtggttttacatcacctaatttaggaggtagaatgggaggaagggacattttaagcaacctacccaaaccctgcacccccttcaaggctccaccacatttaagtgggaattgaggtgattgtgagggaatcagggcagaggatgggatggtgctctaggcagaggccatagcatgggccaggaggtgggaagcagcctgaggcaggcagaagagcattgctgcctttggcaaagaggctttgggggcagatttagaaagccaggcacagtccttgcagctctgctgtccagtgtgatcaccactgggtacaggtggctatttaaattaattaaaatgaaatgaaatgaaatgtaaacttcacttccatagtcacactggccatgcatttcaattgctcagtggctattgtattaggcagtacagagaacatttgcatcagtctagaaaggtcttttggacagggctggcctgaaggtctgcgaactccaggctgagaagcctggactttaatctgagggtgggaaggttgggagggggtttgagcaggacagaggccagggtcagaggtaggtttgagatctgacctttgggtaaccttttattggacattccaagccctttcccaacttttgcctcatcaaccaagggctaccagtctcactcctgtctctttctggacctttgtttttgcatctttaagatgagggtggtttattattattattattattattattattattattagagacagggtcttgctctgttgcccaggctgaagtgcagtggtgcaatcattgttcactccagcctcgaactcctgggcccaagcgatcctcctgcttcagcctcctgagcagctgggactataggcatgtaccaccacacctgataaattttctattttttgtagagatgggctctcactatgttgcccaggctggcctcgaacttctggcctcaagcagtcttcccgccttggcctcctaaagtgctgggattacaggtgttgagccacactgcccagctaagggtggctttagacttcatgttcactcattcgtttgctcattcacactcccaccgataactcaccatgttagttttgtactactgctataacaaattatcacaaactcagtggcttaaaataatagaaatttatgatcttacaggtttggaggtctgaagtccaaaatgggtatccttgggctaaaaatcaaggtaggcagggctgcgttccttctggaggcttgaggggagaatctgttttcttgtcttttccagcttctagaagccacccacattccattcaccttctatattccaggcctgcaatggcctgttgagtccttctcacatcccatcaccctgaccttgactcttctgttccatacttccacatgtaaagatctttgttattgtaggccaggcgcaggggctcacgcctgtaatcccagcactttgggaggccgaggggggtggatcacctgaggttgggagtttgagaccagcctgaccaacatggagaaactccatctctactaaaaatacaaaatgagccggacgtggtggcatatgcctgtaatcccagctacgtgggaggctgaggcaggagaatcgcttgaacccgggaggcggaggttgcagtgagc

SEQ ID NO: 16383 - DNA, 21723 bp, Human
agagctatcagcactcccatgtttattgtagcactgttcacaatagccaagatttggaagtactctaagtgtccattagcagatgaatggataaagacaatgtggtaatacacataatggagtactattcagtcataaagaagaattagatcctgtcatttgcaataacatggatggaactggaggtcataatgttgagtgaaataaaccaggcacagaaagacaaactttgcatgttctcacttatttatgggagctaaaaactaaaataactgaactcacagagatagagagtagaaggatggttacgagaggatgggaagggtagcgaggtgggtaggggggatgtggggatcattaatgggtataaaaaatagttagaggccaggcgcagtggctcacgcctgtaatcccagcactttgggaggccgaggtgggcggaacacctgaggagttcaagaccagcctggccaatatgatgaaaccccgtctctactaaaaatacaaaaattagctgggcgtgatggtgtgcacctgtagtcccagctgcttgggaggctgaggcaggagaatcgctggaacccaagaggtgaaggttgcagtgagctgagatcgcgtcactgcactccagcctgggtgacagagtgagactccacatcaaaaaaaaaaaaaaaaaagttagaaagattgaataagacctaatatttgctagcacaacagggtgaatatagtaaaaaataatttatttgtaccttcaaaaataactagacaagtataattgggttgtttgtaacacacaaaaaataagtgcttgaagtggtggataccccatttaccctgatgtgattattttgtattgcaggcctctatcagaatatctcatgtaacccataaatatatacacctactctgtacccacaaaaagtttttaaaaagaaaaataaatagcaaccgaaaaaaaaagagagggagaaaagaaaaaagaaaaaaaaatcaagtgcctggctgggtagaataaattctaaggccacaatgttactgaccatgggttttttggctctcagtgtatagaaattgacacaaggccaatagtcttcccaaacatgctttactggaacttacgccctggcataagggccacaacaaaagagagagcgaattctctggcttgctgactccttggaaaaaaccggtagggatttttttattaggcaaagcacaggaattgacgtcagaggcaggatgtgctgctgggcaaagcatacgagaagtggggtatgcaggtcagcattacttggttgcaatggttatcttgaggaatgggccaactggtggtctggccagtggcaacaaggctgtaaatcaattattcagcattccttcccaaggtgggacacccggcaacattgtttatctcctaaggccagttcctggaattaagtgaaaggatgactaatggacatgttgtcagtgaggtagtggtgtgggttttgtgaccagtgggaatgcacgaaagaatgctttagcggggagtgagctgaagccaagccccatccctactctgtctcaaagtgagttcagaaaaggggatttaaagaattctttttttttttttttttttttttgagacagagtcttgctctgtcgcccaggctggagtgcagtggcgccatcttggctcactgcaagctccgccccccgggttcatgccattctcctgcctcagcctcccaagtagctgggactgcaggtgcctaccaccaagcccagctaattttttgtattttttttttagtagagacggggtttcaccatgttagccaggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctaggtaagtctgttgtctgcatgtctccccactaatgtgagtcatatagatggagtctcagggcacgactgggttttgtgtctctcgttgttgcttcacagcccttttggcatcacccatttatttaactaggataaaaacgaatattggtatagcgattccacagtttacaaagtgcttttgtatccactgtctcacttgatcaagcaaaaggaaaccagaggaccggagtgctgtcctgagtctaccttgatttgctaggcgacttgagggagacttttagcctcaaagggccacttaagtggaaattctaaaacagtacctattctgatcctaactcaagggaatgctgtgaatatgcatgagataaagacctcccaatatatgaagaactgggtgatttttggagaaagacattatatactcaatttcttttttaattaactttccttgaaagtattgcttaatagtttttacattctccatgtaacagactttctggatctggtgttcagtctgtacaccagatgtagatcttttttaccttctcctagaccttaaaattcctggcaacatgcctccaccctggattggggaataaaaaatgaaaagttttttttttttctttttgactttaaattttattaaagtttgaggtttttcaaactgatgtgctttatttaaaattcaagtgagacatttttagtctttttgatatttatattttctttgtcactatgatgtaaattacagggatttggggaaaatatgggatttttttttttttttttggagatatagatctcactctgttgcctaggctggatggagtgcagggatgtgatcacagctcatcatagtctcgaactcctggactcaagggatccttctgcctcagcctctccaataactaggtcttcaggcacacgccaccatgcctagctaattttaaaatttttttgtagagatgaggtctcactatgttgtccaggctggtctcatcctccaggcctcaagtgatcctcctgccttggccttccagagtattgggactgtaggcatgagccactgtgcctggcccagaaaagatgttttaaaaaaacattttgagggaaaagttgtgaacagtagtggtctgtctttgaggatcgccagcacagtcccagggaagacaatgtaaatttgactctgcccactgccatgagatgcctgatctctcctctttgttcctcccactaatccagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacaggtagagaaactggtgtctacttcttggcttttgaaggtacctgagtgatggttggcaaaagcaacagacagatagggaccaaagagaaatccaaatggagaatgagtggtaacgagagagcgagagcaagagagatgagataggcccatgtgtgtgcatgttagtaaatttgtgtatgtgcacgtgcatgtgtgcaccagagtaatggaagacacagggagagggttgaagaaatggatactgagcaaagaggagtaaacccccaaattttccaggcctttggggacaagagcagtgtgcagtcaagtaccttgggacctaggtttaggacagctgcaagtaaaaggctaacccagcttctcaccagcagcttttggatgtcagtgcttgtcccttgcctcactgccatgctgctgtagccatccaagcctatagaacttggctgtgagtgtggctaatgctgacatcaccagatacaaccaaaatctgactaggtttttaaactgaggtaagaaacataaaggaattacttgaaaagaatttattaatcaccatccatgaaagtagactttgtatactcacaactaatggtcaagatcttacactaccacatctacatgtaaatttatgcaaatgaatctcatttgttcatgtaaattttaatttcttccaacacgagaaattggcaatagcctattagccagaggtagccacgcctgcaattcactgtctttctcatatccttatgcacttccatcttctgctgattgtctgacaatatccagtctgttccccaactgaccattcactcctggagcaacatttctctgctgctatgcatattgctgagaccccacagacttctttgcaagctgcataaaaagatgaatgtttgcaattatagtatctgcaaataaaaataggttttgttcttctattccaactttatgctttttatttatttttctgcccttattatgttggcaaaaactttcaatacaatattgaatagaaatgatgacagcagacctctgtgccttattccatattctaggataaaaaatgttcaatgatttatcattaagtatattaactattggtttttcatagatattatttatcagactaagttctgcattcctagcttttttgaaattttaatcaaatgttgaattttgtcaaaatttgtttgcatttattaagatggtcttatgattttcctcctgtattctgaaaatgtgaattacattggaaaattttgaatgttacaccaaagtggcataaactacttggtcatgaagtataattgagctataattttcttctagtgtgcttcacaaattttgatatcagcatgatgctggctggagtcataaaatgagttgggagtgatatcccctcttctattttctgaaagagtttgagtattattagtataatttccttcttaaatgattgatagcatttaccagcgaagccaggtgaatctgaaatttttgtgcgagagaagactttattaaaaacagtatttctttaatggttacttggattttccgtttgttcttttgtctgttttggtaagtggtacttttcaagaagtttgtcctttttatcttggttgtcaactttattggcatttttttttttttacaatatccttttaataccttattatgtctgtaggatctgtagtgatctctcctctttcattcttgatattggtaatttgtcttgttttctttctgttgtcttgatcaaccttgctacagattgatcattttattaatcttttccaaaaaccaacttttggctatgttgatttttctctattgtctgtccattttctatttcattgctttctgctcttatttttgatcactttctttcttctagttattttaattttaattcttttctagtttactttatttttttctagctttctaaaatgtcttgtttttaattcttcttttagcttcttaagttggaaacttatatcatttatttcacatatctctttttctaatgtaggcatttaatgctgcaaatttcctttagcactgttttaactgcatcccatgattcttgtatgtggtatttttattattttcaaattcagcatattgtctcatttcctttgtaatttcttttttgaccatgaattatttagaattatgttgcttaatttccaaagtattgggatttttctagctatcttattgttattgctttcaaattaaattttgttgtagtcagagatttattttgtggctctgcatatggtctatctcagtaaacgttctatgtgctttctacattgaaaagagtgtatattgttcagttgtagatatagtttctataaatatcaattaagtcaggcaggttgatagtatcattcaaattttctacatccttactgacgttttgtttactttctctgtcaattactgagagagagtgttaatgtctcaaactatgattgttgatttatcctttgctccctatagttctgtcaacatttgctatatgcattttgacacttgtttttagctctgttatatacatttttaggattgttatgtcttcttgatgaactgaccactttaccattgtgaaatatctccctttatttccagcaatgtatttgtcttgaagtctactttttctgatgttaatatagctacatcacccttcctatgcttgctgttttgcatggtgtggtgggcagcctctaagatggcccccaataatccttgtgtcagtattttcacctttgtgtaatccccttccctagaatatccactggatttagtgattcagtactgacaagtttggtagaatgcagcatagtgatgggatatcaattgtgatattaaattaaaaggactacagcaccactacacacctattagatctaggccagaatctggaagactgacaacaccaaatgctgatgaggctgtggggaaagaggaactcttatttattgttcgtgggaattaaaaatggtgtagccactttggaagacaattcgactattccttgcaaaactattcaatctagcagttgcactccttggtatgtaacccagaaagctgcatgtattacactcctcagtatgtaacccaaaaagctgtggtatgtctacacaaaaagctgcacacagatgtttatagtagctatattcataattgccaaaaattggaagcaaccaagatgtctttcagtaagcgaatgaataaataaactgtggtacatttagacaatggaataatatccagtgctaaaaagaaatgagctatcaagccacgaaaagacatggaggaaatgtaaatacaattactaattgaaagaagccaatcttaaaaggctacatgtatgattccaactatatgacattctggaaaatgcaaaactagggaagaagtaaagaagataagtggttgctaggggtcggggagggagagataaataggtggagtatagaggattttttagagcagtgagactactctgtacagtactataatggtggacacatgtcattatatatttgtccaaatccatggaatgtacaataccaagagtgaatcttaacgtagattacagactttgggtgataatggtatgccaatgtaggccttctgcttgattttgcggtgaacctaatattgctgtaaaaaacaaaatcaatttttaaaaaatgacagctttttattgggtattctgtctctatctcactctcttgtcctggggagtgagcttggaaccaaatttcccccagttgaaccagaaaaaacagagaaataagtgtttgtcatttttagctgctaaattttggggataatttatcctgcagttacatataactaatatacatgatatatctacatatctttttctacccttctgttttcagattatgttttctctttttaatccagactgacaatttctgcctctaactggattgtttagtccatttacatttaatgtaattactaatattacagggttgaatttaaatctaccatcttggtatatgatttctatctgtcccatctgattgttgttcacctgtgtctttcttcctgttttcccttggtgaatgcagtaatttttagtattccatttagtataagtgtacatatttttagtatttattttttatctcccctgttaacctcttctgtgtcttgtgtgagtttgtgtggtttttctaggaattgcaatatgcatccttgacatatctattgtctcatgaaggatgtaagatattccaaaagtgtaatttccttaaccgactttcctggcccttatgttcttgtcatgtattttatttctatgtataacactataatacatatattgttattagttttgctttagttagtagtgattttatttatttttattgtcttatttttaattttgatttttaaaataaaatttaccatctttactatgtttaagtgttagttgaatagtgttaagtatagtcacataagtcagtatacagttttaaacaatgtatataacaatatatattaaacataggaattttggactgaatgtttttatccctccctcccaatttctgtgttgaaatcctaacccccttatgatggtattaagaggtcggggctttgaaaggtcattaggtcatggaggtggagacttcatgaatgggattagtgcccttataaaaggaaccccatagagctctctagctctccttctgccatataaaggtacaatgagaagtcagctgtctgtggcccagaagagtcctcatcagaccctgaccaggctggcatcctaatctcagacttccagcctttagaattgtaggaaataaatttctgttgtttatgagccacccagtctatggtattctgttacaggagcccaaactaactaaggctatattatgcatatatttaagatcttttatatttacccacatatctttcttctctagtgtttttcattcctttcccaagatctgttcttctgtttggcatcattttccttcacctgaagaacttattttagtattagttataatgcagttctgctggagacaaattctcttaacttatcaagtcgggtaaaaagttagtaattgttttcctccctgctaacttgaggaatttaacaatttttgataaccaaagtcccctggcatctctcttaccagtatttattattgaaatctgagattttaaagttcaaatattgtaatttaaagtattatttttatattttctttcaagatcagtttggacatttgcttttggtttgtaatcaaatttagaattatttggacatatttggtgctcattttatacaatttttctagatattgagtctttaattttggttcatctgtcaactgaatagatcttcaaatatttatttcaagaggaacatacagtgacgtgttttctaagtccatgcatatatgagaatgtattttgtcactcttacacatgaacaaaatcataaaattgtttaaatattgccccactttttttctgacatgtagtaagaagttgagagaggctattctattttttttagacagggtcttgctctgtcacccacactggggtgcagtggtgagatctcactgtagccttgacctcctgggctcaggtgatttcccaccttagcctcctgagtagctgggactacaggtccacactgccatagctggctaattttttgtagagatgggagttttgctctgttgcccaggccggtgagagcctattttcatatgcattttaacctgtatacccctgacttagaattttatattggctatagccttcaaagtggggctatattcttcaatataaaaataatttcatacaccttttttttctgttgactatgtgattctacagaatgaaattgatattaactagaaacaattgcagctatgacaatttggacaatatctaaagttatttagtaaataaggaaattcccagggtttgtagaatctcagggaaactttgtaataagtaaataaatcttcagtcactgttagacaacacaccttgccaaagtccaaatcatctgtcaagaaggcctttgaaactttgttctcactttctgtatccaccaccggcctttccatctcattcaaaaataaacccttacaatctagcaggatagtaaaagcattacttatctcacacctgaaatgtcagcttggaacaactagctcttgagacactgtcccctcccaatcactctgttggacattgcatttttggcagtaaatttctgcattcttatccttatccttgtgctagatcctgtggctttaattattttaagaatgataatgatcctatgcaactcatgtctttcctgcatcttcaagtagctttatcaacctacaacctatttccttcaagatgatttcttctttatctgaagttttttcttgtgctaaaggctgccaaagacgtatgtactgtctcctgttcttctacctctgcatttaaataccactcattttaaattagctggccatagtggtgcacacccgtattcccagctactggggaggctgaggagagaggatcacttgagcttgggagatcgaggctgcagtgagctgtggtcacattccagactggctggcagagtgacactctgtctcaaaaataataaaaaataataataaaaataaataaccctcatttttacaactatccaaaaaagttttaagaaagtcaaacactaagatacaattactcaagcttatacaatgaacagaggaaaatgagctctttccttaagaaattgtagaagctgcattacttaacctatggttcctggaacttggaatgcatagcttaggcttgtggtccctggactagtagtttgacaacacgtgggagcttttagaaatgcaggctgtcaggccccactagctacctacagaatcagaaccttcactgtaagatctgctaagggtggtatgcacattacagtagaagaagcactggtgtctggagcagggcttccctctaggtgtgccagggcacacacacaggtgggtgggaatcagttgcaggcatgctgtccaagctgttttccttggccctcttgacagcaggtggggcatggaccacctcctggttgcctctgtagagagtggctcctcctttttttttttttaattttttattatactttaagttctagggtacatgtgcacaacgtgcaggtttgttacttatgtatacatgtgccatgttggtgtgctgcacccattaactcgtcatttacattaggtatatctcctaatgctatccatgccccctccccccaccccacgacaggccccggtgtgtgatgttccccaccctgtatccaagtgttctcattgttcaattcccacctatgagtgagaacgtgtggtgtttggttttctgtccttgagatagtttgctcagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttataatcctttgggtatatacccagtaatgggatggctgggtcaaatggtatttctagttctagatccctgaggaatcaccacactgacttccacaatggttgaactagtttacagtcccaccaacaatgtaaaagtgttcctatttctccacatcctctccagcacctgttgtttcctgactttttaatgatcaccattctaagtggtgtgagatggtgtctcattgtggttttgatttgcatttctctgatgaccagtgatgatgagcattttttcatgtgtctgttggctgcataaatgtcttcttttgagaagtgtctgttcatatcctttgcccactttttgatggggttgtttgattttttcttgtaaatttgtttaagttctttgtagattctggatattagccctttgtcagatgggtagattgtaaaatttctctcccattctgtaggttgcctgttcactctgatgctagtttcttttgctggcagaagctctttaatttaattagatctcatttgttaattttggcttttgttgctattgcttttggtgttttagacatgaagtccttgcccatgcctatggcctgaatggtattccctaggttttcttctagggtttttatggttttagatctaacatttaagtctttaatccatcttgaattaatttttgcataaggtgtaaggaagggatccagtttcaactttctacatatggctagccagttttcccagcaccatttattaaatagggaatcctttccctatttcttgtttttgtcaggtttgtcaaagatgagatggttgtagatgtgtggtattatttctgagggctctgttctgttccattgttctacatttctgttttggtaccagtaccatgctgttttggttactgtagccttgtagtacagtttgaagtcaggtagtgtgctcctcttaacctcagcatacctgacagaagaaagcttaggcccctgtcgaggtggcagttctctgaggtaaatgctctctgtgcaaagacctccatttctatttaaaaagatgtttgtatgttgtccaaaaatagacacagttgtgccaaatgtgttccacaaactagtgaaccacttctattccaaagcatctctggactttcacagcttgcaaaaggatattgataagctttttcaaaaccaggatcttgatgatcatgatgattgtttcagtgatacctaggaaacattcccgccttttacaaggatgcctctctcttaaataggtgctcttgccaccttatctccccaggaaaattcacagggcaggttaagaaaccttcaactagctatttcctcaattgtaaacatttctactcacaggtctcagagcacttcaaactcagtgtgtccaaaacagagctaccatctgctccagatctgctttatttctggtattcttagctccttgaatggcaccatcatataataaattggacaagccagaacctggaagtcaatttgtcctttccctctctgtcatgttccatatctaacttaacatcaagctctgtccattttacttcctgacttcctctgtaacccatttcttcccgtgtttaccatcacctggtctcagctacccctgtctccctcctgactggcctcccacttccactcttgcccctccactcaattcttctctgttctgcagcccaagtgaccctctcaaaatgtaaatctgatcatgtcactctcctccttagtgctccctagtgactctccagagcttttggaatgaaaagcaaaattcctgtcatggtccacaaagccctgcctagtctggctcctgccaacctatttccccacaatccagccacgttggctctctcctcctgtgtttcctgccaccacgtggcctttgcacttgcggtttcctcttactggaatttcctcccgccctccctgcttgcttcagtctggttaactcctacgtatttatcctctatatctctgcttgcccgactcctttttggaggagcttttcctgatcctctaggtcaaggggagctcccaacatctccccattagtgccatgctcctttccttccttgcatttgtcagttttaatttccactcctatgagtgatcactgggttaatgctttctcccgccacccacccgtctacaatctccatgaggttagaatctgtttctcatttgttcatccttgtgtccccagtgcccagcctatttcctgaacatagtagaggttcaaaacatatttggaaaatacatgaatactcacattttgcttttcagacttttcctcctagaatatcattcacctgattcgggtgtggggtgtggtctctgtcaaagatgcactaatgattgttccttgcccgtacaattctcacagtgacctccacgcttacttagccttgatttccttgacctgttttgatggttctttctcaggagagcctgcaggaacttctgaggatggggctttggggatgtgaggacaatggaaaacagcttgtcagggagatactgatgcactgccagccttgctgagacagggcaggaggaaccgcctctaaatctcaggatagttcacctggaatgtgggaagacattctcagaaagggttcttcccggggccctcctcttcatcctttcttgcctccctcccttcctccccatacccctcaggcttttatagatgcatatttacagaggacagggctacctttttttgcatattgattcttttgaaagggcagacctttagaactaaagaaatgaccacaccgctgttagctttctgcaaaacagcatagcactttcccggtgtgtgtttattacctaccccatgagctaaacatgaggcaaagtagtaattggctgggtctctggtgagtccatttccctgcgttgccccgaggtgtatgcaggctttacacagctaccttggcaactgacttccccaatgtttgctgtgtgtccaaggacaagcagggatctatgacactgggtgtttctagcaaatttccctctcaaattggcacattctctgtgagctttggagacttcacagtgtggctcacagtttgggaacaatttgcatcatcatctgactggtaagttctagttctgtggtaactcaagtgtttcaaatagcttaatacgcaatagggcacggaggttcgttctgcttctgttggaatcaaacacacatttccacaatgttcccgttatacaggatcatcccgaaacacatcccccagaacactatgttgtcactactctaccttttgatatacactttattattattcctatgtgcagataggttacttaagtttttctgttctagattagtttgtctattcaaatacatgtttctcacacacttctacagtgtttttctttttgttgttattcttaaagtgttctatgaaaacttccatgttgtatcaaggctgggtggtagctttgtaactagtttcccaccttagaatgactgtctgctttgtccaggactgcaagggggacttagaatatgggatttttcagtgctaaaactagaaaagtctgagacaaatcaggacaaagtggtcaccctgctaccatttctagccttgataaaggagcaggtagacccaaccaaggataatttttgttttctatgtagataccagtttagtggttggtaggaattcccccaaatcaacaccttgctaagctcatctctctctctctctctcttttaatataacagcttattgagataaaactcacataccatacaattaatgcacccatttaaattgcgaaattcagtagtttttagtatactttcagagttgtgcaaccttcatcacaatcaattttacaacattttcataattctcaaaagaaatcctgtacccattagcagccactcccatttctctccaaatccctcagctcctggcaaccactggtctgctttcagtctctgtagctttgccttttctggacatttcatataaatggaatcatacaatatgtggccttttggttctggcttttttcatttagcctgtgtctagaaggtccatccatgttgtagcatgtgtcagaatttcatttctttttgttgccaaataatattccattatatgtatatatcacattttatttacctattcagaagttgacggttgcattgtttgcaccttttagctgtttataaacattcattacaagtttttgtatgtatatatgttttcatttctcttgggtatatacctagacagatttcctgggtcatgtggtaactctatatttaaccttttaaggaactgccagactgttttccaaagtaactggactattttacattgtcagcagcagtgtatgtaggttccagtttctgcaaatccttgccaacacttggtattatctgtcttttttattatagccgtcatagtgatgtgaagtggtatctcatggttttgatttgcatttctctgatgactgacaatgttgagcatcttttcatctgctaattgctaagctccttaaatggaaaattataggaagcataaagcatgtttgcaaagaagtgattatattcgctaggattaagattttaagtgaatatttaagatgcccatgactagtgtccactctctcgaatcaagttttatttaaaccattgacttttcctcataactggaaatggtcccagtgaaagtctccctcacttgctggaatgtggggccatctctgctgtctgtcaagccttgatgcccaagtggccattttctcctggagtctgcatcagatggtagagtgtgtgtttcctgagtgtgagactggatctgctccacaatgctttgctggttaactccttccaagagtgcaatacccaggggtcactcctactcttagtgctctggggcctgggcccttaacacactcaatgtttcttccccttttctcacttatctgatcttctgctacttctttctcctttgtccgcccctgctctctggtttctcttgtacactctgtttatttaattttgatcatttgtttgtttgttcctttcttcctcctttaacaaattcaaataggatacaagccactctgtcccatctcctgcccttgccttctcttctttcattcttttattaactgatttttctcttgagaaatcaccactgggtcaggtgtggtggtggctcatgcctgcaattccagcagtttgagaggctgaggcaggaggatcacttgaggccagaagttcgagaccagcctgggcaacatagggagaccctgtctctataaaacataaaaaaattagcctggtatggtggtgcaagcctgtaatcccagtgctttgggaggctgaggtggggaggatcccttgagcccaggagtttgaggctgcagtgagctgtgatggcgccactgcgctccatcctgtgcaacagaacaggaccctgtctctagaaacaaaacaaaacaaaaaacccaaaacatgccattgatttggcagaaaaggacagggttcctggcaaggctaccaaaaacatgatctctgtcagaaaacatactatctgcaatatttgttggaatctgagaatgggaaatgtagctttcttctctccaggagtgccctgttcacagctgtgggataatgatcaatagttcctaaaaatatctatggaagacctcaccactcttattgatcagcaactactgcaaagataatgtttcagcatttgaaaccccttattattaatacttattctgtatgggtcaagtagccgctaacttacagtttggcagatggatcaagtataataataataacctataaatactaataaatgagccagtatagtataagtgagtactatactaagcagtgaaggaagaataatttcatggagggaagtccacggtagaagcaggctgctaggtattattatcgttttcacatactattcactttatgaagagatttaacatagctcagggtaatatggtctcattcaaatgccaaaatgacccctcagttcttctttctctcctttcccgatagaggtggccctaaggacacacatctgggacaatacggccatttttagccttgacccaagagatctgggttccccatgactggagtggaaaacaatgtctgtgggtttgtgtttttcagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtccagttgactttagtccttgtttctaactgccaagtcatgtgctgagtagaggctcagtggttggggcccaatggttcatctaggacgggactagagaggtcagtctacaagcaatccattgaccacttacttggtgctgcacacaaatgttggtgctatgggacccaaagatgagcaattagtattccagtcttcattgcctgtgcttacaaaagaagacctcacttccctaaacatctagttatggcggctcaagcccgtacctgcctacagagaagtgtctgcagttactcactattagtttcctaagggggcactgctggctccttctctcccaggaatgggcttctcctattctttaactcttgccttctccctggagaggctaccaaaccctggcctctgccgctgttcaggctgccatgtgggtatagctgtttgctagactccactctggcctcaggggccagagaacagctgtccagcatttctgttcatcccagcaatccaaaaaaaaatttttttaagctacaaagatcactccattttcaaattcagactctgccacttattagctgtttctcattaggcaagttatataaccttgcagtgcctcactttcctcatctataaaatgagattaaaatagtctttttattaagagaattaaagtgaattgtggccaggcactgtggctcatgcctgtaatcccagcgctttgggaggctgaggcagacagattgcttgagctcagaagttcgagactggcctggggaacatgcaaaaaccctgtctgtattaaaaatacaaaaaaattagctaggtgtggcggcatatgcctgtggtcccagctactcaggaggctgaagtgggaggatggcttgagcccgggaggcggaggttgcaatgaactgagatcgcaccactgtgttccagacagagtgcgatgctgtctcgaaaaaagtaaaataataaataaataataaataaaataaaataaagtgaattgttacatgtaaaggacctagaatattgcatggtgcttgataaacattcagtaaatgttagttacaatcattattattatacgcatcatcgttaatattagttgccaaagcagctgagaaaagatggcttattctccaatcaggagagaggattcctgttctcggctacaggcactggactctttactggcattgcctttgagagaggctgtgatacaactcagtttctataccacatgctgccaattcctttttgatttaagaaatctctagcaaacatttagcactctccaagcatctttctttcatgcaccaggcacaagaatgaaaatgaaatcccagtgtcagctgactcaacagccctcatcttcatagtcccagaaacaccctaagtgctcccaggtccttccaagggcagtagtgtacctgcaccagcagtccctacccagaatctccctgttgaggctctcctgctcaggctgtgatgctggggcccctgagcccagcctgaggatgctggaaagggaccaatatgccctcttttgagaaggatactgcccatgcctaacactctgctttagatgcctcagagccatcctggtttcctcccagagtggtaagaaacacttttcatttattccagggattggtaaacttttcctgtcaaggcccagatagcaaatatttctggctttgtgggttatacagtcttaattgcagctactcaactctgcagttgtagcagaagcagctatagacagtatgtaacaaatgtgcgtgtttgtgttccaataaaactttatttataaaaacagatggatggatagattaggcccaagggttgtagtttgtagacccctgatctagacccttaagtagccttgtttgtgcctgaagtttacagatgatccccaacttatttttattttatttttttgagatggagtctctctctggagcccaggttggagtacagtggcaagatcttggctcactgcaacctccacattccgggttcaagtaattctcccgcctcagcttcctgagtagctgggattacaggcgtgtgccaccatgcccagctaatttttgtattttgtatgttagccatgttggcaaggctggcctcaacctcctgacctcaagtgatctgcccacctcagcctcccaaagtgctgggattacaggagtgagccaccatgcccgaaccccaacttatgtttgacttacaatgtttggactttatgatggtgcaaatgttatatgcattcagtagaaactgtacttcaaattttgaattttgatcttttatttttattgttacaaaattggctttgtgtttgatgatgttgcccagtttttggctaatgaaagagttctgagcatatttaaggtaggctaggctaaactatgatgtttgatacattaggtgcattaaatttattttggacttatgatattctcaacttatgatgggttattgggctgttacctcatcatctgccgaggaccatctgtatacattttcttgtgaacagtctggtcagtttcttcttataggagctcaaggcaagtccaaggggctggacaaaaaataggcagaatatggtttcttctgtgctccatccctgctgtagcactctctttcttgctcaatctcccaatcaaaactcctccttccaaatggcatgaacccaggaggcagagcttgcagtgagccgagatcgcaccacaacactccagcctgggcttgggtgacaaagcgagactccatctcaaaaaaaaaacaaaacaaaaaaaagaaactcctccttcctcccctagtttgaagcattcaataaatacaaacagaaaatcagaaaacaagggtggtgggggatggcagatgaagtgttacctacactaatatttctcaaactgcaagttgccattcatcaatgtatcataaaatcaatttggtgcaccaaatccacattttaaaaatgaatagagaataaactagaaaacaga

SEQ ID NO: 16384 - DNA, 12257 bp, Human
ccataacacatgaggattattacaattcaaggtgagatttgagtagggaaacagagacagaccatatcaccagccttcatgtttgtctttccctcttgaatgtgagaccaaaggggaaaggaccatgatatgttttgactgaacctctggcacctagagcaatgtcgtccgtatatgtttgctaaatgaatgactagatgcactgcttgaggattctaacaaaagataaacttagctaaataatctgcaaataatcatccttgattatttttctaaccttaaacatttgtattaattataataatatcactcattatttgcttaccatttgccaggctatgttccatgcattttccacattttctctcacttaatgctcaaaactgtgtaggtacatactattaataaaattatttcacatacagaggaaccaatgcatagggaagttcattatcttgccaaggaagggaagtttaaaatgctaagttcgacattctcattccagagcctatgctctgggcctctacaatgcaatttccctcaaaaataaaccctccaggatgggtgggtggctcatgcctgtaatcctagcaatttgggagaccaaggtgggcacattgcttgagcctgggagctgaagacaagcctaggaaacacaaggagaccctgtctttacaagagatacaaatattagctggccatggtggcatgtgccagtaattgcagctactcgggaggctgagttggaagaatcatctgagcctgggaagtggaggctgcagtgagccaaggtcaaataactgcattccggcctgcacgacagaatgataccctgtatcagaaaaaaaaaaaaaaaaaaaaacagaaagaaaaaagcaatgtgaaaagaaggacattaaataagaaaagctttaattctggtgaaaaatgtttctatttcttaaagcaaaaatgtttcacagggacatacattacccacaactttcccaagagctatgaggtggggtcaggggaacagtggttcacatactccaaaggttgtgttacttttctccgtcaagctttctaatgattgagaaactcttcactgtgtgaatttaattgtacacatactttttcaatcctgtcttactctccaagccccattcccctcctaccctgatctatccaagggctggtgaagaaaatttcccatggatacactacctgatgcaggctacagttctgattctttaatgggaagaaaaataaagacatgcatatgcatgcacagtgagtatttcccaatacatgtacaggccctgccaaaaaggaaggcgaagcatactttcagtttcagtcacacaagaagggaggagagaaaagccatggccggtgagtcttttactgttccaagaacaggtccctgggaagaaagagttttggaaggggctggctcttctggaagccataattagcatctgtggaagtttacttgagtagaagcaaggaaaaggggggagagggaggagagaaggaactagaagattcttgcagactttagaaaggaaaggcaagcccagaaaggaactgaggctttaggggaagcctgatgtcattttgcaatcttaattaaactcttacttacatgttgaaagtctgacagagggtacagaattggcacaggaggagtactagcagcagtggttcctaaatgaaatgggctatttctgcttcattactttattaaccagagttaaataaacatgcgacataagaggatgatctctgctttccagggactgatgtggaaatggtaaactcagtcttcaggtcactccatgcacatgtatggagactattgagggaaacaagtaggacagcaatacagtaagaagagggattacccaactgtgaggagggggacatttcactgatgaaatctaaatgaggtcactttctgttgattacatgagaggaatatgaggctgttttcatgatgtgagaaatccttgtgctctaaacagacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcaggtaagggtcagtgacttacactcaagttcacctagggcctgtcttcgtgcctaacatttgatttctttactagtcatgttaattggaagaaaactttcttatttctggcttcagggccatatttctgtagcagggtccctattgcatgtcccttgactctcctttgattcttttccttaatcctcagtggcactcttctgattaaagctcatttcctgttctgagtatgtggtagctcctttactgaagctcttgagaaccatctgaaaagcttcatgctgtgttttccagtgttcctggcaaggcaaaatatttacctgtggatttatttttgctgagtgcaaggggtctgtaggcacttatggagttgtaaagtcacatgaagctttaaggtttataatcaaatactttttataacttttctccaaaattttaccctcccaaaagaataaaatatatttcaatgatggcgatacactcagagaacacattgaacgtatagaaaagtgaagatttctaatgggctcattcctccagttgcctccttgtattttctttgagtaagatcacctggttgcctgttaccaggctgtgggtcatgctgtgaggcctggaaatcctccacttgcaaccctcctcaggcccaatacagggctcaggaactgagctggccaaatctcatgaccacttggacctaccacgtggtgaggatgagagttctggtggattcccagtcattgatgtctgtggcacttcctaaagccacttcagagggagatgttctttgaaagcaaaagccttctgttctaagggttagggaaagcttatgcctgtctaagcagacattgcagatgtttctgttttcatctatgtgtaataaacacgtatttttctaccaatgcctctttcattttctacctcccaccactctctaaattaaagaacatctttaacattatttaatgtcagtcagtcagtcagtgttatgggagaaatttttagtggggagtgttttacagattggggtaaagttttccagagatgataagtgactacttcaataccctttatcttttcatagatcaaacatctggaaattaccttaatatgcaagactctcaaggagtactttcttcctttccaggtaatgctgtttttaaaggaagagcattctttgacccacatcttccttgacattaattttgtaggatcaaacgtgggtaaatgggctatggagaattctcatagattggtcatataattttctttttgtaatctattctgcttttgtagaaactgtttccacagcttcattatccacatttatattaaaaattctgaatctgtgtctcaaatcctgattacccaaataagtaccaaacttcattatttaagcctactgaaatattcactcccatctcccagagacaccttattctaaactttcccagagctgaaaatgctatacttccacaccctgcttctcttccggttttgtgtaacttggttattggtgccaccgtcaccagttgttcaaaccaggaacttgaaactcatatgggacccttccttctcatgcacctctaacattcaacccatggccaagttttatgcaggcttttctcaaatttggaaccatctctctatttctacttctattattttattaaagaacccctattcccatagtgcactcttaaacttatatctgaaagcaatgtagaggctaggaatgcaaattatttatcaagttcagatattactctactgaatttattaaggttgggtatcatgaatattttcttaaatgtttcacagcatgggatattcaatatataaagaaatactgtattctctactatgaaaaaatagctcaaaaataacctaactacttctagtttttttctattgttttcacacttctttatgaagaaatccaacattttatccaacaaatgattattctataattttttccaatatatctattctaattcgttcttctccacatcagcacatttcatgctgcctttgtttatctaactgattgtataacaatttttcaaatttgtttttaaaattaaatattattttttgccttaatagcttctaaaagatcctccacacatctagaaaacttatttctattttaaaacaaaggttacattaatttctttaacaaggacatcacattgttggattgtgttgaacctgtgatgaaataaaaggctcaaggattttctcacataaactctgtgaaaacatttcctcaagtgtctgtgcaatgaatgtttagtgctataaatccatctagtgtgtaccttgattttagcatttatcattatatcttcattctacttcatatattcaatattcatgtcctttcatatgtatacatagaaggaagagatcctgaaggacaggacaaagattcattaaaaaatattcctagtgcttactaccatgtatattaagtaaataaataaaaagataaacatgtattttaaaaaatattttagtagattaaattaagacctgatcccattaaattttatcctagggtttgaatattttgaaaaaagtttatattcttaactattttatctcacacattttttgttttctgagtgttttatcaggcatagactttaaattttccctttctatgttagtatctaaaatgcttgtagaaaggctgatcctgaaatatgaaagaagatacttgtaatgcatacctggaaatctcttgcttgaaatgtgctccattaggagcaaactcactcagctgtgttaatgatgtagatcaggattgtcctcctcagagtgcatttcctcttctgtggcttcatccataggtgaggctgtaacaaacacaaagtggaacaaacagggatgccactgttcatgatgttctttgtctcttgcagctcctcaggcagtgcaggacaacccagctatgcccacatcctcaggctcagaagggaatgtcaagctttgctccctagaagaagctcaaaggatatggaaacaaaagtcggcagaggtgccatgctcagaacccaaggatagagtggggtgaaagaaacacttcaggcagttctgaaatgcagtggcttattcttagagccaacctcattgagcagttctggagaatcatacttctgctccccttacataaaggatttctatatcctagaatcccaggtttatagaaagaggtccaaattggatccacttccggggtaaataacatcagtgatgacagctattgaatgcttattaagaatgggcattgttctaagcattttgcacatgataatatataatttttaaccttaaacacaacccattttagagatcaagaagctgagacgggattgttaaatatttttcccaaagaaaaacaatcagaaattggaacaatcagttttagaattcagtcatttttgcttcaaagcttgtgcatctttcaaaatcctacctatcaagaacaacgaagtcagaagctcagctgccatctgggcatttgcaatgtccatgcatactcttgaagcagcattcaattctgttcccccttttcaatgtatggttcatggggtttggtatcttgataggactaaggaaggggaagctgtcataaaccaggaagggaaatatttaattggaaagaacaaggctgttcattcaaattgcatttcctacagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggtaagttctattatacaacagaaacaatggttatgcccttcgtataactgaataatattagaaagcttggttgtaagaccaagaaatgtaatctcttgataatctaaaatacaaacttgccatgagagagtgctggatactacatggtcctttgtaacataagagtcatgcagcacaagcctggtataactgaattgggaaatgttttattgactcagtaatgccactgtctctctacaagataactctggatgacttcctataacactttccttcacctttcttgaaactaagactaaatttttttttggcaccctgttgtttgtcacggaattccttaagaaactccttaagtatttatttattgactttccaaggtaccatgatagttaattacatagtcgaaaatcagtgatatggtgtctttcaggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtggtgagtgctgatgcctttgagaacaccagacaatcaaatactatcctactctgtatgcatccaagaatttttggtttcttttggtttgtcttttaatgtcaaagaacacatactgtcagtattcaagaatgcagcttctgtgaattgaatggctggttggtagatatttattccatatttaagcttgagattttgatgtttggaaatttttacaatttgtttgatggttagaaaagataaacattgttgaaaagattgtaactgaaatgcatgtgtctatttgcatgtgaattaatgatagagcaaacacattaataaatatcattgaacagaggctaggaggaaaacatcttctcagccattggtagtagtaacaaatcaaactgtgtctttccagacagccctggtgtggtgtggtttaaagattcagtaggagtttctggaaacctatctttaccaactacagaagagtttgaggatgatgctattaagaaagcccacatagagaaggattttatcgctttctgctcttccacaccaggtaacaggtttctacacaggacatctttgttggggctatcaatagaaaaagtgacaataacccactagaggtggtgattaacaactcaagaccaactcaagctttgttccaagttatacacagaattccctttatccaagagagcaattttgcatatctgttcaatgcattactaattaaagaattcatctatgtttcaaaatatttttggaactttgagcgatagcagagaattaaatggaagacggtatgtgctgtagtacattagaatctgactctgcatagaaaattctgccatgttgagatcattcattagtccaatttgcccagacatcaaatatttataggagaagagtaagagcaagattctgaaaagcagaacagcaagcgagacactttggggccctaaattaaagtgggttttacctagaagcatgaagtgtgtgagacagaatatatttgaatttttctaaacgtatgctttggagtaagaatcttgctattattgactgacccagacatttagtattttgtaaaacagttccactagttcctcctcgggctttccttgaattgctgactaatatgtgaatataaatattatttttctaaggatttaataaattaatatatttgaaatattgggcacgacacaaaataaagcacacattaaaaaactgctattatttaaaatgtatatatttgataacttaattcagttacttttctaagcaaggtttaaataaaaattatttaaatcctttcattcaccacctttggcagtttcctgagaggacttgcattctcttggtcacctctggcccaaaggccctgtctctgctcaaatagttaagttttctaaaatattttctaaaatgagatatcttctttcagaagaagcttggttctacattgggttgaacatgccctgatgtagaactcaataatttttttttcccaatgatcagaaacaatgacactacccaaaaacaccatatattttcagcctgagtacgtatagcagagtttaatattagacagaactgttcgttagtatcgtttgatcccagccttccacatgacattcaccgctctctaagtagctctttgtaggcctctggcttctcattatcaatctggctgatttatgtgtctttcttttctttcactttccttactcctaccttctagatgactgtcagaaactccaattcagttatctataacttccatgttaaacctatctccacattctgctgtgccaatcccaaccacatcatagtgatctcctgaagaaaaataattatctacttccttaatttcacaaaacatttgcagagatatctgtctccacgatatctttcacttacttccttttactagaacaagtctcagttaaaggcttcatttagctgagatagctgggtttctaaatagaattttattattaatatatactttatgacctttagaactggctaaaatgtgtcattaaagaatgtgtctgtcattacatacagagctattgctgctgcttttctcttatgacttcctttgcataattttatgccttcattacttctgtgtctactatgtaataaattaatatttttctttaatatttctcttcttcataagaacttttttcctccaatatactgtgcttatttccttatctactcctcctagatttctacttttgttctgttttatgatttttatagttaactttttgtgtgtaaatatcttactgtcaatgttatttaatttcgattaatcttttatgaagtacataaattgagaatttgataatataattaccccatgtagactgagtattgcatatcctgggttatctcaaacacttgcgtgacctcagatacctcttgtgtatggagttattaccatcccctgtatagctagctgagtctattaaatatcagaatgcataattaacttaaatcacagtcagtaataccactttgggaatgcacatttagatatttcatttccaaatcccaatcactcccctctaccccattccgccttttccttatttgctactaaatttatgatttcaaacatccctcagctggagtataaatactagggtttcttctctttcttcaggcaagagccagtcttgagatttgaaatgtgctttatccatagataatgtttcttggagacatcccacaatgggctctgtttttattggaagactcattgaacatatgcaagaatatgcctgttcctgtgatgtggaggaaattttccgcaaggtaagatgctagtggatgctattttcactctacttccctgaatgcttggctattgcaattggaagcatagaaagcagatccagacaagtttatcttccaataatgctcttctttccaaaagagttttggagttctttggagagtggacaaacccaggagcctaatccaatctattaagacccacagccttgagaaaacaatcatttagtttcaccccgctcctgccctgcagagacaaatgaatggactctaatttacctgtgtctctcatggctattagatccagcagcagatttaaaatgccctgaggagggtcattcaatgcttacatacatatatggttatacttgttgcagatggaagtactttttgtttttgtcacttattttgctatatttgttgtagttttttggcataactcaagaaattcttgaaaaaaaaaactcagcaaaaaaaagggctacagactttccttactcttttaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcgggagtgtgggaaggttgaggaaagggtactgaaagtccatttgagtcaagaactctaggtttacaggctgagaatccttaatccaaaaatttgaattttgaaatgctctaaaatccaacactgtgtgagcgcccacatgatattcaaaggaaatgtttattgaaacatttcaaattataggtttttggattagggatgctaaaccagtaagtatacagctgaattccaatatacaaaaatatctgaaatttgaaatacttctggtagcatgcattttggataagggataatcaagccatatacagaaaatactgaagtaatgcctttcttctggtcagtgcagagcacgttgctcttctcccaaagtttttcatttagaccccttttgagattcatctgatattggcctagaagtggccgtaagactacaaaccctcacttttggatgtttctctccttcacctcagcagggtatatttaaacatagcatgtggtctttccttttaaaattgtgtatgttcccattggtggtataactttataacttgcatgtctttaacaaaattctttcctatgtttttttttttaattatttctttttctcataggaagtgaagagatccttctgtaaaggtttttggaattatgtctgctgaataataaacttttttgaaataataaatctggtagaaaaatgaaaacttgtcctcatttttctcccacactgaagaaacagggactggaacttagagtgactaaggaatttagagtgtttgacttaatctgtcagacccaaactggctattggcacctttctttcccagaacttaaagtaaaataaaatataaaaatttaaaaaagaaaatcagacttacaaacatagcaatgttattaattactttcttgaacaaaaatttattttgtgccatttttaaaaaaagaaaaatcgtttgctgggctttctgctttggggatgtgatataagttacagcaggtatctgacttcaaataatttagagctcagcaggagagacgggggaagacagctagttatgacagcgacagtgtagtgtgataaagaacttttcccaaatcccacagtttgctactgacaaatccatgaacttgcatgtttctaccctttgcaaaagtatttaagacaaagtaagttttgaatcaaccctcagtagttcacagacttcttgaaaagataagacagccatccaaaatgaagcgcttggcagatggtgcctgacaccctgaagaaactctaggatgcatggtgtgcacagtgaagtcctggcatggtgcagagaaaacgagtttggggtgaaatcatgcactcagggatgttaagatttagggaggattcgaagaactaccccttacttgcaaatatgtttttttctaatatttaacagattaaatgagagttaatttctgacttcttaaacaccttcatagttgaacacattacagtctctctctctctctctttttttttttttttaccttttattaactgtttctctgggcatatctcttctgtgttatcatgcatactctactacaacctgagactacatctgtgatcagtctttgctcagagaatatcaaaaaggagaagtgaattgccaccctaagtaaaaattaactgttaaagcagttttagtcagttgaagaacagcattccaggaagtagataagaggattccttcagaactgtctccaatcaaagcgtaagatgacagggagatggggaggagaagactccatcatgattcctcagcacagtttaaacaagaaatacatttattgaataaacaatcctttccttgtttctttttgctgttgttgttgactttgttgagtatcagttggttataggtgtgtggctttattttggggttctctattctgttccattgggctatgtgtctgttttttttgtacgaataccttgctgttgtggttactgtagactt

SEQ ID NO: 16385 - DNA, 30006 bp, Human
gtgtgtttatgcatgtacatctgtgggtgtgtatgcatagtgtgtatgtgtgagtttgtgtgtgtgtgtgcatttgcatctctgtgtatatatgcatgtgtgttaggggcaggcacacaggcctgttggtaaatgagacacaaaatacctacaaaatacaaaatgtgagacaggaaatacaagccccagttactcatttttcagtgcaacagacataagattaccatgtgaaattgctatgaaagtttccgaaagcttcctgtcaattcgtagtgagcagctagcagaggagtgcgggtccctggagcctgcttgtgcaacgctgagctagtccaagggggaagaatggggtgcatggctctcagctgcagaccagcctggaacctctccagcctgctttagcagagacttgttaagaggtagcagcaggtggcaagattaggagccggagtagtaggctaaggctgcacttccagggacacactgcctctgccaccacccgtgccacgaaaatgggagcccaggaccctgaatctctagcagtccgtttctgaatcagttaccttgggtatgtgcctctggttgatggaaactaacttgtagccctgctgggtgagagcctcacatcgggacatgtgacagctttgttgaaagtagctttggaaacgcccaccacgtggggccactcactgtaatataaacggtcatgcatcactgagcaacagggatacgttctgagaaatgcgtcgttaggcgatttcatcactgtgggaatgttacagagtgtgcctacgcaaacctagatggcagagcccactccacacctaggccagatggcagagcctgttgtttctaggatgcacgcccgtacagtaggttactgtactgaatactgtaggcagttgtaacaatggtgagtatttgtgtattcaaacatagaaaaggtatagtaaaaacaatggtgttatggtccgcggctggctgaaacgttatgtggtgcatgactgtaggtataaagcattacagttgtttgatttttctctttttctcacccacagtcttaaggcacctcttatgccttttgtctgggatgtcccgggcagggttggaacgtgtggttaaggcatggcggaaactgctttggggacagacgatggcctcagcttgccttggggtgtcagtgggaaagataggagctgcccctttgccttcgtgtttcttcgtaataatctcagatgtacccgtctggtgggcctctcctagaaaaagccccggtgctctttgctcctgcggtgtttctcaggagggttgttgcttctttgtaatggtggggactcagggaagggacgcaggcagagggtgatgccacatcaaaaagggacccttggctgggtgtggtggcttacgcctgtaatcctagcactttgggaggccgaggcaggtggatcacctgaggtcaggagttcgagaccagcctggccaacgtggtgaaacccggtccctagtaaaaatacaaaaatacaaaggtggtgggtgcctgtaatcccagttactcagtaggctgaggcagaagaatcgcttgaaccggagaggtggaggttgtgatgagccaagattgcgccattgcactccagcctgggtgacagagtgcgactccatctaaaaataaactgaaaaaaaacaaaaaacaaacttgggccatcagcttcttggaaaggctggtgtgaggttgaagcatttgctggtgcctctgctcaacgtttttgtggtgaacctgagcaaagaggttatcattagtggattttactgccttacctgggtgggcactcccttgggaggtggatggacatttgcagctgagcccaggtgggggaattgcgctcactccgccttcagaattccaaaggctgggcatgcatcttggcttcctctaacccatgtctttctctaggtggccacagcagagtgtcattaagtatctattctttgcttttgttctcagggcaggaagatcccaacagtttgcgccataaatataactttatcgcggacgtggtggagaagatcgcccctgccgtggttcatatcgaattgtttcgcaagtaaagagagccttcctttttcctataacctccgaagctttcaccgccactagcaaaacatgagagctatttttgagatacattaaagtgtcaaagtgtcactgaatatcttcctacttaagataagtgtgtctcccttagaacattttccctattcgactatataaatctacattcttgacccttctgaatgtttaaagaacctcgggctctgaagagattctctaagaatattttgtaagtggaagtttttgatgcatgcaaaaaattggcaggatgtttagtgtttaaatgctaagcccgatatataaaggagcgatggctaggtgtgtgtggctgttgcacaacccattaatcaatgcgttgaagcgttcattttaaggtgctacaggcttaagtgtgtactcctttggattttaggcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccaggtaagggtgttctcgcctgcagaggtgagttctcagatgccccggaacacccttggcaaaggcaccagagctctctgattgcagctgattctcggggggcactgaagccagtctgagccagtcacaggagggccttgaggagatgctgagtatggcctgggggtgtgggagaggaaggggctcaggaaaacttctgtaaggagccagataaaagtttttaaaataatgttttaaatgtttgtcaaagaaagcaatagatttgtaaagaaattagtaggtaagtagtgaaaattgattctccttcccattcccaatcctgtggcaactcttgttacagattttatttatcctccacagatacatcatgcgttcacaatgaacatagaatttactgggttttagactgagccatccttaacttgtcaacagttactttgaaaacaaaccagctctcccaaattggggttttgcggggttatgagatgtgtttcaaaagaatgtttcgtactttaaacatcttggaaaacttgaattaaaacagagctaatggatttcttctttccagaccttctcagagcttttagtatgctagtgtgcacgtggcttgcctacaaaagggtgttgactgaactatttgcccaaattataatcatttgagtatacagctttttgtgggggcaggcagaactgagacataccaaaatcagtttgggaaatgctgtatttgaaaatgctttctatttaaatattctctttgcaatcatttttgctctgttgatttgcttagcaaagtcttcatgtctgggacaatatccatttcttactgactcatcaaaaacccccactcgacacgtcgatgagagaggttttgtttgctgtgtggcatgttcagtgaaagcgtggtttccagtttcttcacatccttataattttctagacttcagatggagggaacaatcagaggaggctggaatcctgcctctgaccaaggaaaagaccagaggctgagccaggtggggtctcttgtccagccctctgcttgcctcgctttacctgggtgtgggctgagtaattccagacaagcgtggaattaatctggctgtttgtgctgttcagtggcacgctggttacacctccttctggaaacaactctgcgtgtgctgtttgggtggtaggattccgggtctccttctccgtctttttataacatcaagttgctgcccagctcaggctcctttacggccagtcttcagaaaaccaccagctaacacatttactaccctccttccccgatgttcctgtagcttctctatggctgggtggccaggcatggccgaagaggctctgggtagatataggctctgtgcccggtgtgtgtaactggccttgagtgaggctgcagttgtgtgttatttctattaggtcactgtggaatttctagcgacaactaatctttcaaagtgtgtttattggtcacaggattattgggccagcctctgccttcattctttttcacctaatctgcataatagctgtgttatccccattttagagaagaagaaacaggggctcagagaagtctagtaacctgtgtgaggccacacagcaaacacctcatgaccctgccctcctaaggcagcccatggctattgctggagggatagaggccggccccgtggtttgatgggacagcttgaccttaaacagcccatgggaaggcgggtgcatctggtttaggaacaggctgctagaaaggtatccaggatgtggtagtctcaccggaaggagccagtcagaatagcacagcctgtggccacgcgtgggacctgttcagcctcatggagctttgggaggcagccagcagcagggcatgggctgtgtgcaggcgaggcgctggcctggacgccgcccccactgcgtaacttcgtgtttggaatgcgtgggcacataccgtgcggctgcttctggccgggggatattcttttccaattttgagccaaggtggagactgtctcctcgtgccatccctggcatgtcctggcaagacgtgaacgatctcaatagacgagctttgcagagtgtgtctgacctgactcctgctgtcttgggagtttagctcttcagccagcagcatgctgtttgacatgtgtttcaagccccccaagaaagggtgcttgaaatttaaaattgaactgatgtggcttttcaaaatggaattggaaatgaaaggatattaaattgcagacacccacacaaaagactggtttccactgactaaactgcttttttttgctgatagtagttgaaagtagggagagtaacagcatctcttccagctttttctcttttgttcccttgttttgatgatgggttatttcgggggaagctctggctggccttgctttgtgtcatcttagggataacaaagaggatgaaagagatcaggaaaaccgagaaggcagaacagaaccagcagaaactgtgcttgaggaatgaaaatcacctacacggctccttgtcatatgagactgtggcccagcctcctgcaaagccatttaagagtaacccagtgaagctggtgagactgcctgccgcgtccgtgggcccagtgactaactcggtggcttatcatctgggcccagctcctcccctggcatcctgatttcacttggaggggcccccgttgtccttcataaacatgtttatttcattttatttttatgttttgagacagagttttactgttgcccaggctggagtgcagtggcgccatctccgctcactgcaacctccacctccaggactcaagtgattctcctgcctcagcctcctgagtggctgggactacaggcgtgcaccaccatgcctggctactttttgtatttttagtagagaccgggttttgccatgttggccaggctggtctcaaactcctgacctcaggtgatccacctgcctcagcctcccaaagtgctgggattacaggtgtgagccattgcgcgtggctgtaaacgtgatattcttgagactttcagtgaaataagaattgccacggacatctgtggtcattgtccacttgccactcacctacccccttttctggcagcaacagccggcatttcacatgtccatcatcggacagcgtaggtgggaccatcagtcatggtgtcctaccctctgtggccaaggagtggacacaggacccagttagggcaagcagaggctccccttggaatcgcaaagtgaagctggatgccacccacagagactaacatggtgaagctgctgtagcccctgctgttgagcccccagcactgcctgagttcttgcactttgtgagtccagtttaatatctgcttttcctcccattcttggagctcccctcacatctccagtggcttgaagttgccagagatgtttctgggcttgtgaccaaatgactccttttctgcttctcactgctgagcagacacatgtgcgctcactttgcctgctgagtcttgggacccggaagagcttttgggagacaatcacggaccagccccctcttgcctgccctgctgtctccctccaagcaggaggtgagaaggtgtccacctgcagccccggccaggcatccctttctgtgcttctgcccaaatctgaaattcccctctccttgggacccacgactggggccagcctgcctggggagggaatcccagctgcagaaagtcgggacagtgtgcgtgtaaacatgttaatagaaagcagctttgagggcagactagttcagcttcagttacaaactctttccaaatgcgtttaacatgagccactggctgtgcgcagcatatgtcaagctttcatccaatggtggcattttgtccctgcggggtttttttttcctgagcagtttggggcaggggtggggacagggagagagaaaagtaaaaagagagcagtttggtttcttcaggctggagtacaaggcagaggtaatgggatgtattgaagaaggtaggagggaaagttactttagctacagctatttgtccagctgtgctgattaagaaacttggagaaaagcatctttggaatcatgtccttcccatcttatatacagcctttgcagatttcctgctgttctgagagagatctgaactccttaccaggaccttgagggccccacctgattgggcacccctcactctctctgcccctcctccccttcccctcctcccctcctttctccacccccacctgctctgctcagacaccccttccttggttgcttcccacaggccagggctgtcccctggggccttggctgttcccctcccaggagcgcccctctccagctcctcatgcagccaaccttcctgtccttcaggcctctgattaaattctgccttagacatctctccccaccccgctgtgtgaggtagcgccccatgccccagtcccctcaactccactgcctcactttggggacacatcaccccagggacaactgcattccactcttggtttttccctcctcgtctatttatcacaatttagagtcgcctcactcatttgtcaaatgaagttcatctctgcagctggactgcggggttgggggcacatccggctgtcggtcctcaggtaggaggtgcttggcaaccttgttcagagtaggacgttcacagctgtctgccccggaggaagcaagggcacccgccacatggatggaattgaggggaaggcacccggggctcctgcatcgagcttccctcctatattcaatgaggaaatgaccctgcagaaggctggctgcagatgcccctgcctcccggctttgcctgcttggagtttgatggacacgtggtcctgtcagggctacagcaggtctatggtctttggtaacggaaagcgctggtgaaacagtgagctttcccgtgggtgcttttccctgacgccaacaaccaggtaaatatttggaaacggccttgttgaggcttgtgaggtggttttcctccctcccctgtaggcctgcgccacccccccaaccccacgaccacctttgggccagatggcacccacagacctgtttgaagtggccacagagggagccctctgggcgctggggccgctgtgtttgcagagggtcctcttactgctgagctggctggtgcagtgagaaggaaggccgacacccctgatcctcatcaagttcagacgggggtcactgcgggttaggggcctggggccttttacatgtcccgggagctgctgagcaggccactcttctccaggccaccagaacttggccctgcgcatggtgaatcttccctgagtcagctgagtgagggggttcaggcagccccccgggacatggcagtggcggggagtggactggggtggtgcttgccatgactcacgccggttctcctcaggcaaccggatggtcagatgcgctgactcagtggcctgagctcgtccaaaagcgaatcagagaacacagggcctgggctcacccgctgccctcttctggagtcatctgtcactcatcctcatgaaggaagcgcctgggagcctggaatgcacatcgcactgccccagctcccctcttgtttctgtgtttttccattttggattctttcccccaacgccttctgtactgggcattttgtggtctcttctttttctccgagaactctgagggctaccattgcatttgctaatgatgccacagacggtgttgacgttatgaggcttctattactgtattgatttttaccatttttagggggacgggaatcaatatttcatgagggaatgtgaagccagacagtgaagtagaagctggcttttattttgtgccaggctttgtccagaggcgggtggggacgtggctcctaagctcttgattgcagctccttctggcttgggaaacgtttcagttccccaaactctcagaactggatcccctgtgtgttctctggcccggattcaagaacttagttgattgtcaaggaaattctttggctatatttttctcttaatatggtaatgccttttttcactctggcactctcttttcagggaattggattaagactattatttatgggtctgacaaagcagttcccaagttgttgggactggatttgtttaggaatgtctcctgtcctcttcattgaggggggaatacaaattgcttccatttgacagtttatcaagtgtgtgacagagtatcagagtccagggttggccaactacagccagtagtccaaagctggccctctgttgttgtaaataaagttttattgggacatggtcatgctcacttatttaggtagagtgtatggctgcattcagtctacaccagcagagttaaatagttgtgatgaagaccacgtggcccgtgaagccaaaaatatttgcttcctggccctttacaggaaaaaaattcccagccccagtggcaggcaattaacaccttgtcctcgaggagctgaaagtggctggaggcaggaatgcttataagaaccaagcgaggtgaagcactaggtggccgcggcgagcaggaagagaagctgattttgtttgccctttcgtttgccagagattgtgggttttttttttttttttttttgcagagatgaagctttgatcttgtcacaatagcagagggaggccttatttttgtctatttctctgtgacattggtagaaaggactttgtcagaattccaagctatttggcaattatccaattttgagatcctaatggatctttcgaggtctagtttgttcattcttttagtgattccttgttaattccctgattttataaatgtgtgttgaacatctgtcttggccaaatacttcttaggtgctgaggatgcagcaatagtgggcaaagccatggggcttaagatctagtgtgggaaatgggtgatgtaaagtaaatatggcgataagtacagtgcacgaagcaaacaagtgaaggggtagaaggtatcaggctgcaaagacagcagatagtgtaggcagggaatcttatctgagggggtgacatctaagctgagatggaaaggacagtgagagccagccaaggaaacaagttgggtgacaagagttgcaggtggagttgcttaatttcccacttctgctcagcctgcagatcctggatcttggactaattgcaaactgtcatttcctcgtgagtttattagaaccctccagaacaagtttctggttagctagtttctctgtgtgttgtctcatttcttgttggttctggttctttggggttcctactcatactctggaaagctccagtgtcttaagtagtcagtctcccaagagtctgaaagcacaaagattcacaatgatacgatcacctctcaatcatagcagcattgatgcagttccgtagctggtttcctaaagccatccagatctctttctgtggcaagagagaaataagaccttctggtgaattgaggactaattatcctaataaacatgcgaattaacagttcctttggttaaacaaagcaccagaatctgataatgggaacatgtgactcatggtatttccttctttgctttatctaccaggcagctcacagaaaccactggccttccctgtgttcccattttatgtcataaatatatatttaattaacttattataaaaggccctttgttcattgaccatatcaaattattcttatatagaagaggttatacatgttttaaacattttaaaataaatctgaaaagaatgctacatcctgggcaacttccctgcatttggggctcaaagaagctctatgtggttatgggtaatgaggagccagagtgccttcagggcagttcagcagatgctgaaaggctgctgtgtgctgttcgctgggcccaccaaatagagtaggactgagcccctgtccaccatgacagccgggagatacaagctgttccctttgcctccctgagccctgagctttatagcctatagacagctgaaaagcaggctgcatccgttacccagtcagttacccagacccaaatgccaggccttggctaaccccagttattacctaattttaatatcccaatggatgttttaagacctggctggttcattctttcatttatttacttattcattgattttgtaaatatttctggagcatctgccatggccacatgctgttgtagcagcatcagccactctgaagttggtggatgaaaggggatgcatcaaaggcgctgatgtatggaggagacgcaagttagacttgaccaagacaatattattcctcctctggatgccccgaatatatacagtcattagctgtcgggcccccatgtggcactgttgacattttgtggtttaaacactgaagagtaagggaatattggaaatggcaaacatctgatatagtgtaaaggagactaaatattttgatggtgttcataaacaccgaggaggaaagtcttttcatttttttcatttgtgtgctctctctttctctgtttttgcacactgtcctctgttctccttctccttctctttttccttttttctcccttcatctccccatttatctgatctctcccacctgaaccccttctaccctgctgccctcctgtccatcctaccttctctactcccctccctagacagtagtaatcacatgtcagttggagaaacatgatggcaacttggtcacaccgttcttctcagtctgtatatgtcggtgatctcagtgcccatctggcagatccttcctgccctggctcttctgctcactgcgaccacccttgactttgtgatcactgataaccttcaccttctctaatctaaatcccaagcttctcactcttggtccaccacctcccagccttgtccgttctgaaccctgaacggaagctgaatggaaccctgaacggaagggttctgaagctgttcagaaccctgaatggaagctgaaatatcaatgggtcattgcttttcacagtcctctgtgaaagattactggccaagccagcatctggagaattcctggtccaccacctccctgtctggagaagctggaacagccagctgcatgagcatgtgacccgtgtactcacaggccctgtgccctgagctcgctgttttaattttatctttgaatttgtatttttgtgaataagtccctatgagctaatggagcatgctcagggaacttggggctttagcttaggctggattcctcctgctgcctccccagtccctggtcccctgagaactccagccccatctgaccttcccttccctgtctctatgcaggggtcattgctaccctctatccctggaaaggatgtaggcacagggcagttctaggttccagcttgggcaccgcttaacatcttggtggtgcagggatcaggctgatgataccgtggttgttctgtgggctactgggcagggtcaagccactcccaccctgatccaggtacctaatgcacccgacacagaagcggcagtgtccttggggtcatccattatccatgtgttggaggagtgggaccctagggaagatgcttggctcgacttccccacccctagccagggcacaatctgaggtccaggggctggtgggcacaatgccaagtcgtgaggcctccagtgtctgcgctcactgtcccataaataaccacagtaataactagcaaatcaaaaacattgtgataggtcgagagagacagcatgtggaagaaaggaaaaagctttctattttagtacctttaacagtgctttctgtatgctttatgaacaaggagcctgcatttttattttgcactgggctctgctaattttgtagctggtcctgccccctagtagctcaagtcagcaaatctttggttcatctgagtccacagtccactgacccgccctttttcacagttcctcccctgcccatgtgctcacttccctccttacccagcttggcgcactccctcaagcaagtctttggatgctgacatcccccgtaaacaacccttctgcggcctggtttgattttccttaggagacatgcaagttctatagcactgtttcttgctgggtatggaggatgtgctattttgtccattgcatattttttaaagaaaatgaaaggttagcataactgtttccagaaggcacattgaatcactcagttgagtcccagccagttgctgcaatgttagcctttgaagcaaacttgaaccaacacaggaccagcctagaagtcccagcctccagaaatgatgcagtggattctgcagattcagcaacaacaatatttttgtaactcaagagcacttagtaattttcaaaggagagaaagaagtaattgacttggcttattaggttgaaaaagagttgccaactttttctttggttttgatgttattggtttttttttatttttcttttctccaagcttcagggaatgagattgaatgagcactcaagtgctactaggcagaaccctgaatggaaggaagctgaaataccgatgggtcattgcttttcacagtcctctatgaaagattactggccaagccagcatctggagaattctaggaatgccccctcctcttgcagcagtataagtttgcggggatcatctgaccccattggggagttgtatgaaaaaggggatttattagggaccctgttgcctgtttggatcttacttacatttaactattgtctgctaatggattttttggaaagcaaccaggttttccgtaaagaatagctaattgtcagagctgagatgaccattggagatcactgggctcaactccctaattttagaggtgctaaaaccgcaatccagagaagctaatcaagtggttcaaggttgtagactgagttcatataggaccaagacccagcccagatgtcctactgtctgggacagtgttctctcagcatacgtggagcctgagggggtaatgtgtgtgcgtgtgtgtgcatgtatgcatatacacataggtgttttgcctaagttttcacttctgccccaccttggttgatcttggagaatgagcctgaggcgcgctgtcaacctgggggcctcattcagcacaggcccaacttttctgccctgggggagttccagcagttatggttcatctgtggttcagttatggaactcacaccacacatagtgcccccaaaaccgaggctgcgtgcacagacctcccctcccttcccgtggtgggcccctgcttgggttcttcctaaacttcccctttgccctgctctgtgttataccctctctggtcccctgtccctgtggagtgatccggggcacaagggcagctgtttccccgctgacctctgtgtgccctgaacatctgggaggtggggagcaggctggtgagaagaacacctggagtggaggttggggtcagggagggtcccagtcccggtaccacccccacctgctgtgggacctgcagtcccctcatcagcagaacggctatgaagccatcctgcccatccacagggtggtgggtcgtgaaggctgcatacctggcagagcgggagaagctctgggaagatgctggacacgcgccgtgggagtgatttccctgccttgcccagattctgctcccatcacctgaacctgcctgtcaccaccatggaactgctgtgaccattgctttccttttaagcagattagcagacatctcctgctccaccccgccaaacaaacaaacaaacaagcaaacaaacaaacaaaaatgtgcatgagggagtatggacttgtagagtcttttctaaacattgttaggtgcttgtattgggatcctctcttaaaatgaaccatattccccaggctttggatgacactcatggttgcccaccctccaacttccttccctgctggcagagccctgggtttgttttagttccaaccctgaccccaccgcattcctgactcaggcaaattcgcagggtccaatgcagtcaggggagccacgttccctcctccaacgagtgctgaggtcgctgcttgattggatactgccgatgacctacgaggaggagggtgccagggcgcttttgggactttgcttttctggagagatgcttccacagcatggtcatggacacagtcacgtcttgatgtgatgtctggaatggtggtggccgtcttgtggctgtgagaataggctgaggttgattggatggagggaaggaaggagccttgttcttgatgctgtctgtgagccttcgagttatcagcctggtaccacccagcccttggacagatatctactctacatactccatttggagttttttttttttttttttttttttttgtcacttgcagttgaaaacaccctaattgatacacacaaactatttttagtgctggtctgtgtttggcccttatggaagactctgggctgagctgcccatggtgagggaggtggactttgtgttttcttactgctctgtgtcctggtggcttgtttgtgtctctgcccatgagacaaaagccgagagggcaagggcagattttcttaatcatatgttccctgcaccaagctcataggagacactcactgaatggttgttgagagagttctctttcacggaggcaatgttttgtgaaacgatgctgcttgttgttgtctgttggttgtaatatgcatgaacactaagagccatctttaatcatgctgtgggccgcctcttccaaggtgttagcattactcccactacctggtcagcatcctgcctatggctaggactttgcaatttacatagatatggtggggagacctggagcccatggccaggactctgacaccctcactggatctgtttctacatctacctggatggccgtctaggacattagaggatttgtgtcttcctaaagtccctctgttgagagacttctggctctgttaagaggacactatttagcattgtgagtccctgcaggctgggggccagtgggcgtttttcttctagatgccccctctcttcttctggcctcccaggcttcctgctcctgagattgtgagaactggcctgtgctgggctcactgcagaaagactgtcgtccccaaaggttttgcaccaaacttgagctacaagatcttttagggggacctgagatctccgcctgggctctatgagagcaggcatgggttgtttttgccccgtcactgcagtcatgcccacacttgcattttcttttccccccagcagtgtgagggtctggcatgaggagtgggactcgcgtgccctctttcttctcctcttccctctggccttttcatccgtcagtgggggacagatgtttgccctgtttacttctaggcttactgtggggctccagggagatggtgaagtggccaaggagaggagctgccaccttcaagacggcctgtggccggtgccgctttaaagggagactcagaggtgctttgctgtgggtggcgcgggaaccagcctggggacagcagtgcagaggccttggactcagagtgcgtgggccccgcggggcttcacggcgcctgtggctgtgcacttccagccatatctgtgctgcatctcttccacattcccccatggagctgatgtctagacagctatggaattaaatgctcaattaccgagtaggaatttggccagcagaggtatagctgctgagtagacagactcgaggtgaggctcacggctgagaacaggccccatctggctttggaatgagctgaggtgcccgatgctcctgcagccagtggctcctgtggggagctggggccgtgacccccaaaaggcagcttgacctcatggaccaccataaatctggcctggtcaacatctctgccagacatcattcccttgcaaagatttctgcctgtgattggaattctggatgaacatgtactgggcgtgtgggtctgacagctgggaagcttgttctcttgtttagccaggctgcccatcatctgtaagcctcagtatccacatctttaaaatggggggaaaatatagctcaactcctaatggtgccatgagaatactttgtcacctgccaggcaaaagcttattcctttcacagaaatccagggtttacaatgtgagacccctccccactccgccgcatgtgtctgcttgcttttttctgtcttagggttgcccttcatgagctaggaaatgtctgagtggatgaaaacctaaacgagatgatcactggtggtgcccattggtgcagcctttgcctaaatggctacttacgtagccacatttcctcgtctgtgttcaggtgaggactggttcctgggcagactgcctgggtttgcatcacgggtgtccatcttgtcgaagctcatgtggtcacccaagtgtgactgagccaggcttgcccacggggtgctctgggccccattttcggcagcaggcagcgtcccctggaggcctggccctccccgggagcatggggagtagcgcctatgggcaagcagcctgcagcctccatccctgcccgggggctcccccgccccagcctcacagcttctccaaaagtgtttgtctccttgccgcatcctctaggcctgagctcagacggtggaaaagaagagctggaaggagagttgcctttcagtctctctgccttctgaggtctcctgagacatagagcctgggcctgcctccctttctaggaggcgccgaggggtggtaagaataggggatgagtgagatgtgaattaggatccccacagcaagccctgcctcgtaactttctgatgggttttcaatgtgtggtgaagcagacgcctgctgggcccccttcctgagttgagtttgacctcctgcctcctgtctgtctccttgggcagccaggccaccccgctccattaacctgtgccaccccatccctttacctgtcgcaagcccagccctgaaggcctcaaaggcctggtcttccagccagtccagggcctgaagggatggcagtgtccctggtggacctcccctggtgtggcctagtgcacatcccagccctgcctcctgccccgcctgcacgccatgagtgctgaagtcatgcctggcaggggctgctggcccaggcccagagtaaacacactgcgctgagctcgctggtgtgctgctggatgctgatgagcttgaggagtgtgggaagtgagcatggggctgagtagagatgctgcaggcctgcacctccccgcagctgccctgcatgctccagcctcaggcagccacacagggaaagggtcacccactgtcagggcagacctttaccatggctgggtgacacgggctggctgtggaaaggtgtttggtggttcccgctgttggatttgcacaggcccagatgctcacagcaaaaccaacacctagatggtgcttacaggagccagcgggtattcaaagagctgttcagatcttaagttgcttcattctcacagtggaccattgaggtagctgtacgttagtcccattttccagatgagaaaactgaggacctgagtggtcataagctcaggccctcatctaaatcacgcagcctggccccaggtgtgtgctcttgaccatggacagtgctctcctggtcctcttggtatctgtgatctgagggaccttcctcttcctcagtctcgtatagtcagttttaggtcttggactctgtcttcatatccctttctcccttcgtgagctttctcacccagcaccttccttatttggtgtgtgttgggggatatttgtggtgtggcgtggcactgtgtagtggatgagagagtctgtttttccgatcccagtcccaggtttcaaaccctgctctgtctcgagtcacccagaatcttggaccctcagtttcctcatctgttaaatgggcatggtggtcaccccacctcatcagctagtgtctgctccatccctggtggaggagatgactcaagtaacccctgggttccacctgccccaccccactggtcccctggctctttctttgttgagatagacaaatgtgaggctctggagttgcagttcccacgagggctggggtggctgtctgatttctgggcctggtccatgttgttcagggcagctgctcgttctaagtgaataaaggctgaaggaactcgggaggtctgcttggctccgaggaaggcagagagggaaagggccccgatgccttccctgatagagctagggaggcccttctgtggttccccccagctccttggcctgggtgaccctggagctggcttctgttccattttgttgtgcagagttgtttgagactcctggctttgcctggcctttgtgggacgctggagatcagggcttctggagttggccaattagcctgcccagaccaggaagcacaggtggctgacagagggccgtttcaggagaggagagacagcctacctattcggtcttgctgtcttgggtcctggaggccttgctgtccccatgctccatccctgcccctgaccagtgtggccctgtactcagcataggcgtgcacctgagtcagtacagttccctgcccgcagagcaccccaaatattccaggcctcaggacggatgtgcacatgatgagtcggggcaggtttcactgcctgtagcttgggatccttccctggggcttggttctctagggccatccccagcagtctcaccccaaaccctaaattcatgttgtcttcctctgtctcttggcctcaaggtttcagagtgagtctgtgctgatagcttcaagatgtgatgagaccccgacttggcctccagttacctccccacggtttccttggtgtgtgtgtggcttcagtgttcactggctcccgcacggcttgcaatgtgtggattacgggtgggagggaaatccagtcctgcccgcagcaaagggatgttagttgtgagctcagttccccaccgggcctggtgtttccaaatagcccgtcactgtccctgcttggttttccatgatatctgtgcctttacctatttggttaaattaaaccaactcagcaacgccagccattgtggtttcagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaacgtgagcctctgtccctctgcgggtggggattggggcagagttttgccagggggagaggagtcagcataggtcttagcccctgactttgttgtagtctgcgtgaagggatggaactagaccaagccatgtggattctagtgccagcagcatggcaggggtcacatggcggggacggtgacaccggagcaggtggacagccagcctcctcccaggaggaagaagttgtattgggtgctttagggtgattgcagttggcttctgggcttcagagagaaaatctccctgtttacggcacctctaaaactttctgaaaattgttaaggtcatttttttccggcaaaatattaggttaatgggaatgaatctcagagaagaatcgtgccccccactctaggcaccgtgctcaggaaacgaccaggcagggacatagattgaaccatgttatgacacgatttgtaaccttttcatttctgtttaattgcagtatggaaactcgggaggcccgttagtaaacctggtaaggtcttttaaacctatgttaggtcatttgtttttatctatgtatacgctgttttttgtttgtttgtttgttgttgtttgtttttgaggcagggggtcttttcaaacataaggttgccaaagtgtattataaattcctttaaaatggctctgtaaatgtactgcgtgcttgcaaatgaccctacggatcttttctggaaagagtaaggcaggccggaggtgagggttggaaatgttatgccagagaacacacttgtgtctcagagttacaggtaaacaccgtgaaattcagggccaatgcaggagtaaggtgaaggtcactaaaaatgctggccagtcaccgaaagcacctcctccaaattaaatctcctgggctgctgaaggagctggctgggctcatacacattttctcttggccaggaatcctcccttaaggcctggctggaatgaggaggagttacccacccacaaagatatcacttaagtcttcccttaaatacttgagcagaaaaagtgaagccttagaacacagaccagcagagctagagggcagctctggggccatttatagagggcagctctggggccatttatagagggcagctctggggccatttataggggctgtctttagcaaggcccagtgtgatggcacctcctagatggtgccttggcatcaggtactgacatctcagcactcctgggaagtgtgcacttggcagctttctcttcccagcagaggggcagctgtgctcccagctctgtcctctgcctccccgcgcagcacttggggatggagtggagatggctttgctggtaatgaagcatgacagccctaagctctagggttgtttccccctgaagtcagcagagtcatcttaagatcattagacatgggagaagcaggaaggtgtgggcagccacctaaaggagtttgagcctttggaaacgtattccttgtgaaacaggagcaaatcatatcgtgcattttgaaactatctgtgcttaccgtgaggtgagcacccagtgccgacctggagtatgtgcgattcttccacagctgcgcgtggctcgcgctgcctgggtgtcctgatgcctctctccctgctgccacggggatcccctccttgcatctccccacttcgatctctgaaatagctcagggacttctttcaggcatattctctctgggtgtgtacctgccggtaaagcttcacgattcagtaagccgtgtccttcttgcttttcaggacggtgaagtgattggaattaacactttgaaagtgacagctggaatctcctttgcaatcccatctgataagattaaaaagttcctcacggagtcccatgaccgacaggccaaaggtaggcaaggcccacacagccctggggactccggagatggggcctgaagctcagctgccctttgggacttggggaagggaaaagcggcagcccctaggactagccaagccgtctctgatccagaagtgaacgggaatgcacattactaaatccctcgcagaaggtcacagacatttcaccatttttgtcctctgatcatggcaatgtcacttgagtcagtctaatatgtaccaggcatgatcctaggtgacttctgtacattatttcactttctttatgtatgtcacttaattcttttgccctatcagttaggaattactagtcccattttgctgatgagaaaacggttcagggagatcattctgcaaacgtttattgccccatctgctctaagtcaagcagggagcttggcagtggacagctcaactggggcctggggctcaacaggggcctttgccggtgtgacttttatgttctgttgggggatgggaaggctgacagtaaataatcaaacacataagatactattagtgctcccaagaaaacggatcagggtggccgtcaagggagcgactggaggggcagctggtggagatggtgtggccaggaaatgccttccaagctgaggtctgagtgaggaggaaccagcgggcagggatgtggggggaacactccagaaggaaagacagaggactcagcatagttgagtgagcacaaggcccctgaagtggcctgagggccggagcacagtgacagcatggagttccccggggtggaaagaggccaaggccgggcgagcaggctcacagcaggccgtggtgagggacctgggttgcatcctaacgacatttaagaacagggaagtttatgatctgattgatgtcactgaaaggacactctgatggctgcggggagtctgctggaggggttgctggaagttggggaccggttaaggggctctcccagccatctggatgagacatgctggggtctcagacaagggtggtggcagtggaggtgggacagaggggtcacattccagatatatatggggggtagagcaagcttggggaagggccagctgtcaggatgaggccatgaggaattaagggtcatgcccaggtacctgaccattaattgaaacaatgggactttcccaaggtcccccagaggggaggggtccagaccaggatttgagccgcaacctcagtgtacccttctgtggcccttcctgcaacctgggggattgggcccccggcccctggtgtccccagcacccccaccaactgggctgaccttctgctgtccctttgttgtctcaccaggaaaagccatcaccaagaagaagtatattggtatccgaatgatgtcactcacgtccaggtgggtaaacaggatgcgtgtctgtgtcttaaattttaataaacctgaacttcagaaggtgctcacgggcacccctgaaagagaaaccttatgctgccttaagacgtctcagtttctgcttataatgaagtagcatcgggaaagaggacaggtcattagccttggcccctttgtttggttttaacctgtgtttttgcattctgagctggttttcttcactggcagcaggccctccggtgtagaaggttctgccctcctctttgaaggcaggcctgaacagtgtgtgcgtggtggggctgttgattcactctggctcacgtcttccttaccccacattctgttgaaacccacattccaggagggccccaagcccctcccgcagctctaggcactctgctttcgttgctctgcagctcgtgggccgcggctccaggaatgccagggcaggtccagcgcagggaagtgaatgactgatgtgcttgttttccccgagctggtggaattgcggcctgtggttggcaggctcatggcatcctggtgttctaaactggatgaaaaattctggtgtaatctcatgagtcctggtagtagactcacctggcatggctaaaactgtcagaggtaaagtaggtaaagactagaatatagtaacagatagattaatgtgttcattactatgatgaattaatgattcactcactgtgaaagtattaatatattttgatacatgttatgaatggtggtccctttcttagcactccagaagatggagccatttgtcaaggttaaagtgtcccctcagttgtttgcctttggaactacgaggtgtagggaaagatggtaagcccttggtgcccagcttcctgggttcctgtccctgctctgatatgtcctgccttgtgaccttgggaacgatatgacccctgagtgcctcagtttcctcctcttcaggatagggatgacagcgcaggtgcttctggtgtgtggccaggctcagatcagggagtggtggcaggggtcaccagccacagtgatgccagccactatgtatcacacgtactgggccaggtgccttactgggatgatctcatctgatcctcacaactcatgttgtagggtactgttattatccccattttgcaggtgaggaaatgaaggcacagagaagttaagcaactgtcggaggtcacacagctagcaaatggccgagctagggctgcaaaccaggccaaccactgtactttactgactccttagtaatagctactattaattaagaaataataacaatgatgatggctgggtgcggtggctcacatctgtaatcccagcactttgggaggccaaggcgggcagatcacttgaggccaggagttcgagaccagcctggccaatttgtgaaaccctgtttctactaaaaatataaaaaattagccgggcttggtggcaggcacctgtaatcccagctactcgggtggctgaggcaggagaattgcttgaacccgggatatgtaggttgcagtgaactgagatcgtaccactgcactccagcctgggcgacagagcaagactctgtctcaaaaaaaaaaataaataaaaaaaataaataaataataaagcactttccttgctgttaccaagtaaatctttgactctggtagacaggcaattttaattttaaaataggatcagaattcctggaggaattttaccttagacctaaggagaagacgggaactggtgagagctgagttttgcgtgaggaaggcctggtgtttcttcacactaacacgggtgctttttctctggagcagcaaagccaaagagctgaaggaccggcaccgggacttcccagacgtgatctcaggagcgtatataattgaagtaattcctgataccccagcagaagcgtgagttagagtcattttctcttttcccaatattcttgttgttcctgtgggggtagcaggaagagggagcgctgttccttttctactggctcagatgattatgttgatccttgacagacgtggtcggacgttgcttgtcattcctgctggccaggccttccgacctggctcggctcgggactcatccataggagggtgccttctgtcttcaaaagtccttgctccacgaggaccctccagatggacagagcaatagcagactcgtaatgagtctctgagatggcccggctggccagagagagggtttcaggaacagtgtccccaagccctcacttggtggtccttttctaggcttcaggacccttctcttcctggagtcttccagaatgtctctgacaattaggcccatacctgtcaacacctccagaaaaataacccaagtgatatcaaagtaacatgacaagaagtagctcaaccatccatcagggtttgttacctgtattggcggaatatccagagaaaagtgctagaccagggaccagcaaatgtgccctgggggctggatctggcccactgcctgcttttatatggagctgtgggctaagaatagtttttgcattttatttttatttttacttattttttattttcataggtttttgggggaacaggtggtatttggttacatgagtaagttctttggtggtgatttgtgaggttttggtgcacccatcacccaagcagtgtacactgaacccaatttgtagtcttttatccctcatccctgtcccagcctttccccttgagtccccagagtccattgtatcattcttatgcctttgtgtcctcgtagcttagttcccacttatgagaacatttaaatggttgaaaaaatcctgaaataagaatagtattttgtgacatgttaaatttgtatgaaattcaaatttcagtgtccactgtaatttggtttatgacatctatggtggcttttgtgctggaacagcagagttgagtagcttcaacagagaccatatgtactgcaaagcctaaaatatttcctatggagccctttacagaaaaagtttgcagacccttgtgctagcccatgaaggaccatgacagcgttttgacgctgagctatataagagctacagttatagtggcaaccacacaaaggaagtgcctcttaacagaaacattccgcccacccctataggaactgcattctgagttgcaatacccattataagcaagttggccagatagtggccaactatctggcagatatctggccaactacgtggcagatagtacctggtacatccttccccactttggggtcaatcttgacctttgatctccttggggtcataaagccacacaagtgttagtaggcatttctacagtggacacaatggatgatttagcctaaaaatctcaaaaggagcccagcatcctggcacatgcatgtaatcccagctactcaggaggctgaagcagaaggatcccttgagcccaggagttcgagactagcttgggcaacaattgagaccccatctcaaaaaaaaaaaaaaaaaaaaaaagagtggggaaaaaagaacattattaaaaaaaaaaaccttaaaaagtaatccaatctaccgatggtttattttttattttattttattttttttgagatggaatcccactctgtcacccaggctggagtgcagtggcacaatcttggctcactgcaacctccacctcctgggttcaagtgaatctcttgcctcagcctctgagtagctgggattacaggtgcccaccaccaaacctggctcttttttttttttttttgtaattttagtagagacggggcttcaccatgttggccaggctggtcttgaactcctgacctcaggtgatccacctgcctcagcctcccaaagtgctgggattacaggcatgagccaccgtgcctgacccactgatggtttgaattattctaagttcgccaccgtccaatcctgtttgctctgggcttttaggttctaagctgtgcctctgtccatgtaaagtcagaccaggaggaatggaaacacgaaacattgccattgtgtttccctttgtgttgcagtggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattgctttctgtagtgcttattttcctttcccaagagcagctcgttgcagtctttttggaatgattctaatgtcagtgggcccctcattagactgcattgtccacgcaggtttgagctcttagtcttatgagttatttcaaaatcatcccatgggatttaccagggttatgaacaactctgcttggacaccctggctttatgaagcaggacttgaggacagttgcactcgcatccggagcttgtcaaatgaaagagagtctgttgacctcatacagcatgcaattagtcaacaaagattttctgggtctctgctctgtgccaggcattgtaagtgcgtggtcagtgagagcaggaaagacgcaggctctccctctgtagagcttcagttcagaagccaagtctctttctgaaagggagacagctcaggagaccaggatgcaaccccagaatgggcccagaatgcacacggctgcagctgacctcatttgtcctgggttgtgaaataagaactaggccttaagccttggtgagtttagaggaggactccccttgaagtgccctcaaacaggtacagctagaagcagctgtaggcacctttatctccatgaaagctttccgaaagtttgggaagctgacccaagaggacttgcacagctttagcttggaagtttgcacagacctatgtccctgtggggagcacacaccagagagtatgctgtttacgccaagagcagcgggtcaaagctttccaactgtcagcagttaaaaggagggccttggaccggatggaggttctgttctcccaattgagagctgaatccttcctccatccacagaggcataaggtccaactcataactggggaggctgcggaaggccgaagggccaacttaaatgcaggggcggtccagttgagcacagccctcatcagtgttggtgctcggcggctgagcagcttgtggcccgttgcaacactggcacgtctcttcgctctctggttgaatgacctagtagagtcaggaaggaaccagcgagtcctttggctgtgggagtgtgttttgcattccctcccttctccattaaaggtgatgactcagaatggcttgtggcttcaggggttcattctcagatgttttgtatgtgggcctgctttcctgtgtggtccccggagctgaggtgctgccacaggtggggaggatgccgtgggtggcattgaggtcagacccagccccggcccgagcctgtctgtcttcagcctgttaggcatccgggagatcactgatggttcttctggaagaaactagcctggtgatggaccagcctgaggcctctgtaaacactctgcaacatctctgcaggacactggatggggttggagttttgcctgcatatatggtcacatacaggacagaaatggcagcttgccacattgttgcatatgacatgtttggttacatggttgcacttacccatgagaccctgtgtcccatgggggctgcttgtcctggaacccccacctcacatttgaagacctccagaatagttgtttcttctgcttgctttaggctgtgatgcagggttttgcaacataaattagtcttaaagcctggaggcagagcactgagtcgaaagagcatggcttttggagttatagatggatttgggtttaaatccagtgtctatatatcttactggctgtgtgaccttgagcaagtcccttaacctctctgtctgtttttcatctgtagaatgccctcagttgggtccatctctgcttccatggagctcagtttctaattcttcttggccacttctggtccctccaaggtcactttaacagccctctggctggtgggcccgcacctgccccctgttctggctcctggagaacttcctgcttaccaaatgtgggctcagcagtgcctcttccaatcccagcaccctcagctctagtcctctgcttccagcttctgcaaaactgtgagccaaccacatggctgggct

SEQ ID NO: 16386 - DNA, 18888 bp, Human
caagagtggctgtgagattatacatggtttgacttgtcattggtagacttctgttgaaacatgaattaactagtcttttagaaagtaagtatagatggaataagtatgcctagtttttggcaactttctcctaatcatgaatttatctttaagctttttttttttttttccttccagaggtgattcctatgcacatgctctaatttccttttaattattagtttctttcatagcttagtttttacttcatggcttatcaggatgcttaatggtaaattgggtacaaagaggtgtgtgaagccttgtggaggggctagttttagggctgggggtgactggggagagtagctatggctctgacttatgtgatggggcggcagggtaaacaccagcctgctcagtgatgtttagactttaacactcatacaagtaacggattgtagtttgtagtttgactctctctagtttctcagttaccttttgctaacaatagctttttcgtttgtttgtttgttttttgagacggagtttcactcttgttgctcaggctggagtgcaatgcgcagtcttggctcactgcagcctcgtcctcccaagttcaagcgattctcctgccttagcctcctgagtcgctgggattacaggcatgcaccaccacgcctggctaattttgtattttcagtagagacggggtttctccatgttggtcaggctggtctcgaactcccgattcaggtgatcgcctgcctctgccacccaaagtgctgggattataggcatgagtcaccgcacctggtcaacaatatcttttatgctacaatttttcaggataagttttgtagaaacaaccatcctagcagaatagattgttttgtttgggaatctcatatgtgtgtgtgtgtgtgtgtgtgtgtgtgtgtgtgtgtgtgtgtgtgtatgtatttatgtatgtatgtatatgttggtctaattcaacttgctgtgaacactttaaagctattataagttaacatttttttcctagtctttttgcctttcacctttgtttatgataaatttgacctacagaagttttagatatttgtggctaaataaaagattttaggctgggcacagtggctcacacctttaattcgaaaactttgggaggccgtggtgggcagactgcttgagcccagagggatggacagttcctctgtctcctgccccatgcctagtctctggcagtcttctctgatttggtctccctgcctctggtctctgccctacagttgtagctgtctcatagcattgtgcctgatggtattggactgtggtaggtgcttaacaaatacttagtgtttagcaggtactcagtcaacacacagtgcattagctctggaaagagtcttactcttattgattggttggttgattgattgcctgattgacagggtatcactctgttgcccaggctggcctcaaactcttgggctcaagtgatcctcccgcctcagcctcctgagcagctgggggctacaggcacaaaccaccacacctgactcaagattctcactctttttttttcttttatagagactatgttgcctaggctggtctttaactcctcggctcaagcgatcctcccatcttggcctcccaaggtgctggaattacagatgtgagctatcacgcctggccattttttttttcttgagactgggcctttctttgtctcccaggttggagtacagtggcacaatctcagctcactgcagcctcaacttccgggctcaagcaatcctcccacctcagtctcctgagtagctgggactgcagatgcataccactacacccagctaatttttcaattttttttagtgatggagtcttgctctgttgcccaggctggtctcaaactcctgggctcacgtgatcctttggcctcagcctcccaaagtgctgagattataggcataagccaaggattctcactcttaatgcattctcttttctttggacagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtacgtttcaaattaatccgtcttttcccttttcttgaaaccttttataaaaaaaaattgcttccatattttcacaatatacatttttctagatgtgtttaatgtgtatattgcagacatggttaattcttcttcttctttttttttttttttttgagacggagtctcactctgtcacccaggctggagtacagtggcacaatcccagctcactgcaacctctgcctcccaggttcaagcgattcttctgcctcagcctcctgagtagctgggactacaggcgtgcgccaccacacccagctaatttttgtatttttagtagagatggggtttcaccatgttggccaggctggtctcagactcctgactttgtgatcctcccaccttggcctcccaaagtgctgggattacaggtgtgagccaccacgcctggccagttaattcatttattgagtgtctagtgctgctgtgttaggtgctatggaggcttcaaagaggaaccattgtctttgtcatgtagaccttaccaagagggaatgcaagagaaataaggaaagtactatcatattgctgtcatttttttcttttaacttttattttggcatagttttagacttaagaaaagttgtaacaaatagtactgacattttccttttatacttctcccagattttccaagtgctaactttttgctgctttggtcttagtgtgttcactcccttctcttctccccccgccgcctgcatattctacattgttttctgaactgttttgagaggaagttgcagacatgacatctcttcttttttttttttttttttttttttttttgagacggaatgttgctttgtcacccaggctggagtgcaatggtgggatctcggctcactgcaacctctacctctcggtttcaagtgattctcttgcctcagcctcccgaggagctgggactacaggcccacgccaccacgtccagctaatttttgtatttttagtagagacagggtttcatcatgttggccgggctggtctcgaactcctgacctcaggtgatccacccacctcagcctcccaaagtgctggattacaggcgtgagccaccgcgccccgccacatgacatctctttacccataaatacttagtgtgtctttccaaaaacgcaatgactttttgagatagggtctcattctgttgcccaggctggagttcagtggtgtgatcatggctcactgcagcctggaactcccggcttcaggtgattttcccacctcagcttcccaagtagctgggactacaggtgtgccttaccatgcctggcttattttttgtagagattagattttgctatgttgcccagggtgatcttgaactcctggtctcaagtgatcctaccactcagcctcccacagtgctgggattgcaggtgtgagctactgtgcccagctgactttctcttttataaccatagagtaattgtaaaaatcaagaacttaacactggtacagcaccattagtctagagacctaatccagatgtcatttgttctcttttataacaaaagaaaaacctccgatgagttgcattcagttgtcatgtttagtcttctttaacccagaacagttcctcaatccttggttgtcttggtcttctttccctttgtattaagtatcttgtggggacagagtgtaaaactctgtaaatatccagttactcatgaacttttactcacaatttcagcatccactaatgattcttgcctgaataaatgattacggtggtagttgccaaatggtgatttaatctacaatttggaataaataacagccttaaccaaataaaaccaaagtttattacttagctttgtaccagaaaatgacaatataagagtatcacacattttggtcatttgcttgtattttatttggtaccagtactgtagacatatcttcttttgaactattgaaaatctgtttcatattacatgacatggcaaccttgtttttactttcccactagcaatgtatgagagtgccaatttcttcagatccttgtcaaaagttgtttttttaattataaccatcccagggagtatgagatggtatctcattgtggttttaacttgcattttcctaatgattagtgatgttgaacatcttttcatgtgtttcttgccatttgtatatcttctttgaagaaatagctattcaagtctttccccattttttaaattgggttgtttgtccttttgaaattgagttgtaagaattctggatattagatccttatcagacacatgatttacaaatattttttttccatcctaagggttattacagtctacttctcatgatttttgtctgttatgtgtaacttctgcttttttatttttaaattttatttattttattttattttttttataggcaggattttgctctggtgcccaggctggagtgcagtggcacaatctcaactcactgcatcctctacctcccaggctcaagcaatcctcccacctcagcctctgtaacgggaccatacgcgcgcactaccatgcccagcatttttctgtagcgtcagggattttgccgtgttgtccaggctgatctggaactcctgggctcaagcaatccctgccttggtctcccaaagtgctaggattacaggcgtgagccacggctccctgcctaacttctgcttttaaattctaattttggatcctaaatcttagaattaggtaaaggttttactccagagtttataacctttttgtgttatttttgttaaatgtgtgttttgaagctgggcagataaaatacaattcttagtaattccttacaaaccaaagtttattatgcctgagctaaaacaagctttaactacaaatatgtattaaatagaggttcatatataggcattcagagggcttgctagcactcttaatttttggactttatgccgtatagtaattgtctaaaattattttcctttcttatgtattttaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggtaaaacatttcctttttttgttaaataccctcaaaaataatctttttattttctgatagtttaacattttaaaaaaatctgaacatttttctctcctgataggagtggaggctggagagactgcctgtaaactagctcgtaagtggggctataccgtgaagggcattcagaaatacaaagcaaagattgtttttgcaggtatgtgaaattaaatattaacttctatgattgaaacatacaatataatttactgtggccaggcatggtggctcatgcctgtaatcctagcattttgggaggccaaggcaggaggagtctttgagccctggagttcaagaccagccttctgggcaacatagggagaccctgtctctatttaaaaaaaaaaaaaaatatatatatatatatatatatacacacacacacacacacacacacacacttatatattttatatataaaaaacatatatatatgtgtaaatttactgttttaatttgctgatgaaatacttgtaatatgttttgcctggtacatgatacgtatttgctgaatgtttcataaaaatttatgagggatttcctcttcttgggattatttcttcatatatgagatttttctttctgaactccatattcctctcatttgcctgtcagatttttttcatagcagttatccagttaattagatagtctcactggtggagggtttgtgttgggtgctggggttgggtgaagttagtgtggggccatggcctacatagactgtggtttgaatcttgatattggaggtcctgttgtgccatgttcctcttagaagctgttgaaaagaggaggcttggagttgcccttgttaggtttctgggactggatgaaaggaataacttgaattttggttagggagactagcaattaattgagaagatgtagtttgactgttgggttctttatatgatattcaaatgagaggttctgacttgttttttaagctttatttttttaaaaaacaagtatgtgtacatttgtcactataatggtcaaagttcattcttgtgatagttgaaatcattaaatattctgccttgtgaacacatgcagttaaatgataaaccccataacataatagaatccagagttcaaccgaaggccagaggtgattggtatttgaggggacagattggtattcccaaagaagaaatcttagcaaaactctgtaacttgccatttaaaaatcttgtgctttcgttgtaggacaacataactgtctcttgcaaacaaaaatggtgtttctggtgattttcattcttatagactgtgtccagtctctttcttaatagcaaagggtgcaaagatgttttcacctgagtattgaaagaagctggtgagtcagtggggtggagagacagaggaagactgtccctaactgtaagtcccttatacctgcagggtaagtgactgaggatgaggttcctgaggctaggcaggggagagcaaataggcttatggtctaatcagtgcatttcttcttaaacaaacctagtcaaaatcaatgtgctattttttgtggacaagtgaaagaagagattacttgtgggtaagggatgctggtgaaagaggctttgcaagaatagtatttagaaacgagatgaagccaaaatacgataatccagcactgattaatggagttgctgctggcagaagtggtgagaagataaaaacatgatgtcacaaactcccaacctctctgttattttacatggtgtctttccttcttgaatgtcatcctctctgaaattatctagctcacttgctttactggtttatgtcaggtgttttctccctgctagaaaggaagctccctgaggatagggatcttgccagttgtgatcatgatctatttcccaacttttttttttttttttttttgagacggagtttcactcttgtcacctagtctgcagtctggctcactgtaacctctgcctccagggttcaagtgattctcctgcctcagcctcctgtgtagctgggattacaggcgcccaccaccacgcccagctaatttttgtatttttagtagagacagggttttgccatgttaaccaggctggtcttgaactcctgacctcatgtgttctgcctgcctcggcctcccaaagtgctgggattgcaggcgtgagccactgcacccggcttccccaacatctttattattattattattattatttttattttttgagacagtcttgctctgtcacccaggccggaatgcagtggtgcgatctcagctcacagcaacctctgcttcctgggttcaagcgattcttgtgtcttagcctgctgagtagctgggactacaggtgtgcactaccatgcctggctaatttttgtatttttagtagagatggggtttcaccatgttggccaggctggtcttgaactcctgacctcaggcgatctgcccaccttggcctcccaaagtgcagggattacataagtgagccactgtgcctggtctattccccaacatctaaaacaatgcctgacatagtagatcctcagtcacctttattaatggataaaaaatattccagcagaaagggagacgtctgtcatttagcatcataaaggattataatatcaaggaaggtaaaatggaaacgtgtttggattgcttgaggatcttttctccaaatgaaattggaaatgcattctgttgttagcctgcagtattggagttttgaaaggaaaaccgctaattgtctatgaaggatattctttctcatatcactatcataaatgcaccttctctagaaaacatgcattcaagacctcaattgttagggcttggttttgggttggggattattgaaagaaaagtaagttatctatcttcaggggctatatattccagtcaagaggctcagtagagagaaatgcctaaaataggaattacaaggccagacttagtggccttgtgtcataggagccatggtgtttaatatcagactttgttttaacaattgaaagcccaccgaaggtgcactaaagcaagcccttgatttattttttgagtcaaacttcttgtggtgttttgcggggatagtgcttattgaattttgggtttctttgaaataatcactgtttgtttcccctttgtagctgggaacttctggggtaggacgttgtctgctatctccagttccacagacccaaccagttacgatggttttggaccatttatgccgggattcgacatcattccctataatgatctgcccgcactggaggtatttcactagcgtcatagtgctcagctcattgggaatagaaattaaagctgttgaatatatgaattaaaagtacattatatgacagtaatgcaaatttatctcacttaagttaagccacgatttcagacttgttctcagtagcgatcaattagtttccaacacagagaaagctgagttctgtgatctactctgtacagccagccaactactttagatgtgtgtccttcataacagttaacttcggtatacctgcttacttactaggtaaaatttctgtttttagctagctttttaaaattatgaagtggaagactttttaagaaagccttaagttggctttaaaaggctatttactttagatttaatttaagtaattaatttctttttttgagacagagtctcactctgtcacctaggctggagcgcagtggcacaatctcgtctcactgcaaactccgcttcctgggttcaagtgatcctcctgcctcagcctcccaagtagctggaaccacaggcacacaccaccacacccaactaacttttctattttctttagagacatggtttcgccacgttggccaggctggtctcgaacacttgacctcaagtgatctgcccaccttggcctcccaaggtgctggggtgacaggcatgagccactgtgcccagccagatttaatttaggtacatttgtgtattagaaaacaggctgggcatggtggtacatgcctgtaatcccagtgctttgggaggccagggctggaggagcactttgtgttcaggagttcaagaccagcctgggcagcatagggagagcctgtctctacaaaaaaatttaaaaatcaaggtcaggcgcggtgactcacgcctgtaatcgcagcactttgggaggccgaggcaggcagattgcttgaggtcaggagtcgagaccagcctggccaacagtgaaaccagagacagtggtgaaaccctgtctctactaaaaatacaaaaaaaaattagctgggcgtggtgctgtgcgcctgtaatcccagctacttgggaggctgaggcaggagaattgctggaacccaggaggcagaggctgcagtaagccaagatcgtgccactgcactccagcctgggtgacagagtgagactccatctccaaaaaaaaaaaaatgaaaataaataaaaaattagctgggcatggtgcgcagctacttggcaggctgaggcaggaggatcaccttgagcccaggagttcgagactttagtgggccatgtttgtgctgctatactccagcctgggcaacagaatgaggcaaaaaaggaaatgtaggctagtgtaacttaaaggtgaggtatttggagcttctgataattgaatggcagtgaatttgaagtcagaatttacgttagtgcgaaaacttgatttgcatacttaatgtaaaatatgtgtggtatatgctttcagatttccaagtgtggtagaaaggaagttattaaaacttattcctgtttcttctgtagcgtgctcttcaggatccaaatgtggctgcgttcatggtagaaccaattcagggtgaagcaggcgttgttgttccggatccaggttacctaatgggagtgcgagagctctgcaccaggcaccaggttgtcacgttagctgtttgtgataaggctgaatgtcgagttagctgtttgtgatgaggctgaatgggctcctccccaactcctctctgaattctgctgattggataaatgcaaagattaaattactttccactagagggcgatggcattctaagagcttaagtacttcctagtgcttagaaacctgcacagaagcagactttttcctgtctctggccttgtcctgggccctgtgcagaactgcagacctggtcttaacagcgtttccttcctcgctgctctaagagcctttcactctgagcccccgcaagccctttgttgtattctctcctcctttcccccagggctaatagtagtatattttgtttaccatttgagagtttctgtcacatattaaatgcttgtggaataaacaaatgaattaatttcttcccagagggtagttaggtccagaaaagccatacaaaaccctcacctttgcatcagcaccttttcactatgtagagcagggcagaatgggcctctagggagatagtggcctgacaaaggaaatagttggtgagtctacaagattcttataggatactcttgaaattgtgtgcagttaaaacatttttacaaatttgagggcacatcagaattacacatttattgttggtggggggacagtgaaataaggatggctattttccctgtggaaacgaaagtgatcactaataggggtattttttttccccaataggttctctttattgctgatgaaatacagacaggattggccagaactggtagatggctggctgttgattatgaaaatgtcagacctgatatagtcctccttggaaaggccctttctgggggcttataccctgtaagtttcatgttccccctctttccatttcctactcttgtaaaatatacccctaaagtatttatacatcaactgattgtgacaacaatgctttcagattgtttgattttaccaagtgtgctgcaggccacccggaatatctgtaataaaaacatttaagggaccagtgtgtgacccacttacttattgcctgaagaattgagtgtgccttggaatttgctatgacattggatttgggtggaaacagtttacccccaaaggactcctgtagactcctgtccttttttccagtgttcagaaacatggcatattactaattgtttaaaaccatgactggtgaacaaagagactgagaaaaattaatgtttgttgtagttcatgtcttgggtttgcctttcagagccagtaattgttactacatcagaggtctctgaagtatagatgtttttgctgaatagacaaaacttttgctaaaaagaatgctcagctttgttttttaagcatttaaacaaagcatttcatctcgacgttggaagtgattgtgaaattatatcattgcagaaatagcttttctcttttagttgcaaaattatattgttttgtgccattgaagtgtacctaaagtatttgtaatgttttagggtatgactaagtcattaggttgttactggtagttaggttggcagatgtaaactctttcgttgaagtcattaagtatcagtttcttggccgggtgtggtggcttatgcctgcaatcccagcactttgggaggccgaggcaggcagatcacctgaggtcatgagttcgagaccagcctggccaacatggtgaaactatatctctactaaaactacaaaataaataaataaataaataacatgtgtggtgtggtggtgggcacctgtaatcctagctacttgggaggctgaggcgggagaattgcttgagtccaggaggcagagattgcagtgagctgagatcacgccactgcactcaagcctgggtgacagcgagactctggggaaaaggatgcttagtagaatgcttagtgctgagaaatgacatggtgaattgactgtctttcaggtgtctgcagtgctgtgtgatgatgacatcatgctgaccattaagccaggggagcatgggtccacatacggtggcaatccactaggctgccgagtggccatcgcagcccttgaggtaaagactgatacagccacacagtgtctattctttaaagcaatgttgaagtgatttttaatttgggcccactggtataataaaaaattcaataagaatgccaaatattagaaaacatgaagtatagaggaaaaattttaggaacaagatattctcaaaaagtaatttaaacttggcctagtagactggatttcctccgtgggcttcctgagttcacagtcacctggcgctttgagttcttcggccctggctggccctcatagaactctcaactgtgacccacctaccagacccgtctttttgcttagcaagcaagtcttctttcaagtgtggatttataatgttttcagactgattttttaagtgcctgctgaaggtatacaattattatgtaatctctgaggacagatctttgtgaggggggaagaaactattgcagtttaggaattacatttcgtccattgatgtattcaattaatgacagtatgtgagttgcattaaataaactttaatccttattttgccatgaatgattggcaatagatttgtgatgaaagcaagactctgagctagtgtatgtttaattagaaattaatacaggctttgaaaaatagcaatgaaagttaagttcctctggtcttttatctagtcatgtttttcctgtgtttacagtccccgttgtcctccaaaaaacaaaaaaaggacagtcttaatatttgtataatttttctttaaacgtaggttttagaagaagaaaaccttgctgaaaatgcagacaaattgggcattatcttgagaaatgaactcatgaagctaccttctgatgttgtaactgccgtaagaggaaaaggattattaaatgctattgtcattaaagaaaccaaaggtatggagataaaacatttactcaagataattttttaaggaagacctaaaatacacttggtatttaatttaattaatttatttatttttcgagacggagtcttgctctgtctcctaggctgcagtgccgtggcgcaatcttggctcactgcactctgcctcctgggttcaagcaattctctgcctcagcctcctgagtagctgggattacaggcgcctgtcaccacgcccagctaatctttatatttttaatagagatggggtttcataatgttggccaggctgatctcaaactcctgacctcgtgatccacctgcgttggcctcccaaagtgttgggattataggcgtgagcccaccgcgcccggccacactttttttttttttttttttttaagatggagtcttgctctgttgccaggctggagtgcaatggcgccattttggctgactgcaacttccgatgccccggttcaagcgattctcctgcctcagcctcccgagtagctggtattacaggcacgtgccaacacgcccagctaatttttgtatttttggtagagatggggtttcaccatgttggccagggtggtctcgatctcctgacctcgtgatccgcctgcctcagcctctgaaagtgctgagatgacaggcatgagccactgctcctggccacacttggtattttaattgggtgttgggatgttctgtttgaaactgctgactgacataatgaccaaaccttttagacagattattgtctgatttataattacattaagagtataaaaaatatagctcttttctaaatgaaggcacatttaaccaatttgacccttgttcctttaagacacttatttttctgccttaaattagtcatgcagtatttagagagttcaagtttttttgttggtgagtctggacttgaaagtgtcctctttgctatccttccctccctcactttgatgctttgtgtcagtagaggttataggagcagcagaaataatgatatgaatgacagttatggggtcaataataaaaataatgctggctgtcacttaattgggtgtttgatgttttagtacatcctttgtaacccttaggtgttccttgctggattttcttgtgataactcttccttttaaagcaacgattccaacctcccaaccttggctgcacttaaagaatcacctgaggggccaggcgcggtggcttatgcctgtaatcccagcactttgggaggccgagacgggtggatcacgaggttaggagatcgagaccatcctggctaacacagtgaaaccccatctctactaaaaatacaaaaaaatagccaggcgaggtggtgggcgcctgtagtcccagctactcaggaggctgaggcaggagaatcgcttgaacctgggaggtggagcttgcagtgagctgagattgcgccgctgcactccagcctgggcggcagagtgagactccgtctcaaaaaaaaaaaaaaaaaaaaaaaaaaaaatcacctggggagcttcttaaaaaaatgagtcaaagcctggccttaccccagggattctgatttgacggatctgggacggggcacaggcattagcaatagcctttaaggtgattctgatgtgcagccaggttgagaatcgctgctataatatgttgagctcaggaagcgagtccctttttggaatgtgtagtgttcactgggttttgagtattgcccattttatgtcagttaatcatctgtatcatacccaagttcttttttttcttttttagaattttatttattttatttattttattttttgagacagtgccttgctctgttgggctggagtgtctgtcgccaggctggagtacagtggcatgatcttggctcactgcgacctccacttcctgggttcaagcgattctcctgcctcagcctcctgagtagctgggactacaggcatgtgccacaccacgacaggctaatttttgtatttttattagagatggggtttcaccatgttggccaggatggtctcgatctcttgacctcatgatctgcccacctcggcctcccaaagtgctgggattacaggtgtgagccactgcatccagcctatacccaagttcttttgcattagttccttgtgtgattaatacagcagccttagcacattttttttttttttttggcttggtctttttcatttatgaaaaactatgatatgtctaatcatatcattcaaacctagttatgtgcttgctgaaaagtgaagagtaacttcatttttaggagtaaaaacaaagcaagcttgcagctccaagcttccctttcttttttttttgagacggtgtcttgctctgtcaccaggctggagtgcagtggcgcgatctccgctcactgcagcctccgcctcctggttcaagcgattctcctgcctcagtctcccgagtagctgggactacaggtgcgcaccatgatgcccagctaatttttgtatttttagtagagacgggtttcataatgttggccaggatggtttcaatctcttgacctcgtgatccacccacctcggcctcccaaagtgctgggattacaggcataagccaccgctcccagcccaagcttcccttagttgagcaagttctgttaattttgttttgccaggctgcactttgcccatacatatggcaagggatgtttaaacgtttatctttgagcatgtacgttttactatttttctttagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtctgttttgtgatgattattcaccttaaaaggaagaagctgaggcaaaattaatatagaatgtttaggtgggccaaggttggggactgcagctcgggacacacttccaggttgccctggagagtgctccagagaacacttcttaaagaaaaaaggatagatcagctgctcttataccctctactgacacaaggtgaaggggtgattacaaaagttgtttatcaggaattctcattggcttacagaactaaccttggttagtgattggctatatgctgttgaactacagggtatatggcatttgatagatacttggcttcaagaggtaattatgtagcttgggagagagtgacctgactatgatttcattctattgcctctctgggcctgataatttagtttttattttttgagatggagtctctctctgtcgcccaggctgcagtgcagtggcacgatctcagctcactgcaacctccacctcctgggctcacatgattctcctgtctcggcctcccgaatagctgggattacaggtgtgcaccaccacacccagctaattttagtatttttagtaaagatagggtttcattaagttgaccaggctggtcttgaacttctggcctcaggcgatccccccaacttggcctcctaaagtgctgggattacaggcatcagcccctgtgcctggcctgggcctgataatttaaaggggctcacgttcttcagttacaagatttctttattccccatgtcactatgctattactgcagtgttatcagttacatttttttttttttttgagatggagtcttgctctgttgcccaggctggagtgcagtggcgcaatctcggctcactgcaagctccgtgtcctgtgttcacgccattctcctgcctcagcctccccagtagctaggactatagatgcccgccaccacgcccggctaattttttgtatttttagtagagatggggtttcactgtgttagccaggatggtcttgatctcctgactttgtgatccacctgcctcggcctcccaaagtgctgggattacaggcgtgagccactgcgcccagcctatcagttacatttttaagctttttgagatttatttattccatgtgttttcttttttttgtattcctttttttttttttgagacagagtcttgctctgttgcctaggctggaatgcaatggcgtgatctcagctcactgcaacctccgcctcccgggttcaaatgattcttgtgcctcagcctcccaagtagctgggacaataggcctacaccaccatgcccagctaatttttgtatttttagtacagatggggtttcaccatgttggtcaggctggtctcgaactcctgacctcaggtgatccacccacctcggcctcctaaagtgctgggattacaggtatgagccactgtgcccggcatattccatgtgttttctaacagcatttcaactctgatctacagaaaactagaagttataaaaagaatacatctaaaagataggtctcatacttccctttcaaagtagcgcgttctctgtgcatatactaatgtttatcatttttttaaagttatcctttttatatgtggtgttctgcaactttttcttttttctttcttttttttttttttttacctgaacagagtattttggatgtttttccgtcttattctcaaataattagtatttcatcatatatgggtatactgtaatttcatctcatattgggaccatttgacttgaataaaacttgtgaccacttcatatcttttcacaatggtgcaaaagtgcacagtgtttctatggagtaaatccctagaagtgacttgcttttcaaagaaaaaaaactcaagttaattgtgtcacattgctccctgcctcccccaggttctaaaaagttacctcttagcagtatgagagttgagtctttggtactctgtcagggtagtgctctgtcactgaatgactacgtttaaat

SEQ ID NO: 16387 - DNA, 5592 bp, Human
aaaggtaacagggtaacaaggaggtaaggccctaggctgccatcctgaccttgaggaatggggaacctagtcctacatcagatccaaggggaacttgaaagcattaaatagatccacattcctaaagcataggtattagctgaggttctcttcacctctggtccctccaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcaggtgaggatgggaatcgagtttatacctccgtgtctccctttctgcgtgattcttactccagtccatttctccttgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttcttattgtttatgtaggtatatttcctatatgggcatttttgggtagattgggaggggtggtgggggtacttcctccaacaggatgcctatctctctgccccatcagaccccgtctaacaagaagtgaacagaactgagaccaaacagaacatattgaataaatatttaaatcctgatactagaggtggcatggagggccacaaaattgaagttatcctgtttcctggcatgggaacaaactttcaaagagtcaccgggtgcagtggctcatgcctgtaatcccagcactttaggaggctgaggcaggaggattgcctgagcccaggaattcaagacagcctgggcaacaaaacgagactccgtctctacaaaaataaaataattagccaagtgtggtggagcacttgtagtaccagctacgagggaggtttagcagggaggattccttgaacccaggagttcgaggctgcagtgagctgagatcacactactgcactccagcctgggtgacagagccagtgacacccggtctattaaaaaaagaaagaaagaaaaaaaagaaaacttttaaggggtctaatttcttcacttttccattctccctttgtcaggtaggagaagggagtagggagtgactggacctggaaaggagggctgcagtagctataatattgacccctttcctttaaaaatcctacgccggcacagatttcccagacgctctctaggtggcctcagactccacccctttggtcttccgcttctggtttccgattgtagtgtttaaatctcgcgcgctttacaaggattggctacatcagcggatagttggcagtctgcgtgctacccctcctcctcgccttttctccccgggcaaaaggttttcaaattcgaccaatcagcgggcgcgctccctcagccgagccgcgacacccaagggttaaccgcaaccaaccggaggcgggtattggagaaaagagccaatcaggagggcgcagaggtgtgtcctgggggcttataaaggcggcctcgcggcgcgcgcgcgacagcagttacactgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaagccctttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgctgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaatggagcatttgttttcattttgcaagagagttgtagaattagtgactttctatactttcctgataataggggtgggaggggccatgcaatataaacaggctctactgttaactgaaggggcaaaccataggaatttaagattgtggctctgtttcttggtgttcctgggagacaatttattctgtgtgaaatgaaaactattgaggcagaagcagaaaggacgtaccaggagaactctgggcaaaagtcccagcctctgaggtaaggatgaaagggctttgtgtttgttcctatcttcccgccaactccacacgcgcacacacaacaccttcagaactggtttattagtaggattggttacattcaaaggctgttgcttggacttctctaaagagatgaagcccccacatactgaggaggcaaggcagtcatcaaggccccaaggtgaggcaaatccctggaaggcttgaaccctgcagttcagtctcccggggtaatcactccccagatagcagtgagaatggggcactgaggcccgggatgtaggcactggacagcagcaacccaggcatctgtgccccacaaaccagttaatgggcatcgttaagctgccgtgcaacatccaggatgtttttggctcctttgctcagcaacaagttggccaggctgatgcccaagttctgggcagccaactggggccctcgtggaatgttacgagcagtgatgcctaccaactgtgggtcatcctcagggccatcttcatgctgtatgagggaaggaggtgggatttggtgagaacaagagattatatgcactcttgtttattaccccctcgccctccagctttggtacctgggcagggacatggatggtagcctgcatggtctcttgtatgctatctgagccgtctagactccagactcctccagtcaggtacagctggggaagaaaacagttgcctcagcacagtctgagaggggactacctagaaacctgggatgcacaggaagaaatgccacagtcctcctttccctggcttcccgcccatttccccccacttacttgcccatccttcatagctgtatgcacggctactggcacactgcagcctccttcctgtaacaagaagttcttgtgagctgcaagggctcttaacaccaccctgtgaccacagacctgaggacatcactgaaaaggcaactgtgggcccagacctggtcctatccatacacaacattcaacaagaatgagttagcactgtatacagagcattcatgtaagaaatcttccctgccacctttcccagctctccaagtccccagccctccacaggtggagcacaggccctaccaggtgcctcaggaaggccctttcagcgatgcagcgaagcagagtctcgggatcgtgcagcacacccaccagatccaagatgtcctggtccttggctcgcacttccacgcccaaggccccctgatggaaaaacatcctaggacatcaggcctgatctttccccaaccaatggcgcaaagcatgggaccacctctatctacttgctccccagcgccttttggaccggtagcatcccaaggtctgcccctccctgagaatgctattctggggaagcagatgcagaaggttgtgagacaagcttcttggttgagaacaaagggaaggcatatgtcaccatgtggcttccctggtcaagtgtacctggcccacagcatacatgcattcctcagggtgcaggatctgtggaggcggaacagggagtcaaaagggtggacacgggggtgtctaaaagcacctggcagtgagatgggagttccctatcatctagaaagcctgggtaggcctaagtgtgagtctggcctctttttttttttttttgtaaattttctccatgaaagcctagagtctggcctctgattcacaatcttcccagcctacggtgttagaggtggggtggtcaagaagtgaagacagatggtccttgactta

SEQ ID NO: 16388 - DNA, 12665 bp, Human
aaaattaaaaaacagtggcagtattgtagctgctatgctatgagtagactttgcatctactgagctgggtttgaatcctagttgtgctgtttgacttaaggcacatcttaccttctcaacatgtttttttttttttttttgagatgtatttttttcagtgggtttttggggaacagttggtatttggctatgtgaataagttctttagtagtgatttctgagatttggtgcccatcacccaagcagtgtacactgtacccaatgtgtagtctcttatccctcaccctgctcccaccctttccccctcaacctgtgtcttcatctgtacgttagggattataacacctatgctgtgtggctattatgaaagcctaaggatcaaataggtgttcagttctttgtacagtgctgagcacatgggtgattttttttttcttcttaagacagggtctcaccgggcgcggtggctcatgcctgtattcccagcactctgggaggctgaggtgggcggatcacctgaggtcaggagttcaagaccagcctgaccaacatggtgaaactccgtctctactaaaaatacaaaaaccagctgggtgtggtggcaggtgcctgtaatcctagctactcaggagggtgaggcaggagaattgcttgaacccgggaggtggaggttacggtgagctgagattgcaccattgcactccagcctgggcaacaagagtgaaactccatctcaaaaaaaaaaaaaaaaaaaatgggcgtctcactctgtcatccaggctagagtgcagtggcaccaccacagctcacagctacctcgacctcctgggctcaagcgatcctcacacctcagcctcctgaatagctgggactacaggtgtgtgccgccacacctggctatttttgtattttttgtggagatgaggttttcaccatgttgcccagggtggtctcaaactcctgggctcaagcaatcctcctgccttggcttcctaaagtgctgggaatataggtgtgagccactgcacctagctgggtgattattaataatcatgattgttaattatgttcatgattacaggcgcggtggctcacgcctgtactcccagcactttgggaggccgaggtgggcgaatcacctgaggtcaggagttcaagacctgcctgactaacatggagaaacctcatctctaccaaaaatacaaaattagccgggtgtggtggtgcgtgcctgtaatcccagctactcggggggctgaggcaggagaattgcttgaacccgggaggcggaggttgcagtgagctgagatcgtgccattgcattccagcctgggcaacaagagcgaaactccgtctcaaaaaaaaaaaaaaaattatgttcatgggaaagcacttttcctaacaagcccttttctcactacatgtagcgtttgtgctcccacttcagttacttgtctttaggcatgacctttaatctctctgaaccagtttcctcattttaagaattgaaatgctggctgggccagtggctcacgcctgtaatcccagcactttgggaggccaaggcgagatgactgcttgagtccaggagttcgagactagcctgggcaacatagtgaggccacctccccgctgtctctataaaaaaatctagaaattagtcccacgtggtgatgtgcgcctgtagtcccagctgcttgggaggctgaggtggggggatcgctgaagccgggaggtcaaggctgcagtgacccgtggtcatgccgctgcactctagtctggggacacagtgagaccccgtatcaaaaagaaaaatgctgcctatttcaaggttgtagcaaagctaagtttgaacagagcaaaggaagcgccatagaagctgcactacttgctcatgtcacagctggggaatggggaggtcgaatggggaggtccactgtcgcaatgttccaattcccgcccagagggagggacctccccttcgagggagggcgccggaagtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattggtcagaacggctatctttttttttttttttttttttttttttggtccgagtagcttttaaagggccagtagctcggttgccctccggaaggaatggggaaatcagagagcggtgatactgggttaagagtggaaggattgtttggaacggaactccggtccctgcgggcatctgggtgggattcccatcaggcctgggatgcacggctctagatttagtgacccagaccaagaacgttcgtctacacagacggggtcctttcattcgaggctgggctgaggcggatgcagatacggcccctttgggaagacacgttccacttttgattcataggagagagtatcagccaagcctccgaactgcacacaaacgtcttagaagtgcgccttctttttgtgttatagtggtctcccagccacagccaacgctccaagtccccagctgtgacacacctactgaattactaccgtgggtgggaggccgccgtgggcctttccattacgagcctgcttgccgagccctgggcttgtgcacagacaaactgcagagctggtggaggccactgccaggccgagataagaaagagatggggagctgctaatctccccctgtccagcctgttggtgagggctgggatctttgctcttgcagtcattccagagccctggactaggagtaggaagatctgaattgtggccccaactctctttcggttattagctctgtgaccctaggcaagtcacctcatcccttgatgccacccgttgcttctgtaacatggtcccaaaggtgcctgtcttgtccacctgataggatttttgagacgacaacaatatgcaaaagcaatagcttcaacatagaagtgctcagtgttttattttttaatgaaacggtttgacttggatatgctgtgcacattcaatgaacttaaggaattgtttgaacctagtagttctgggaccttagagtcctttctgtgggctccctgtggcccagatttttggtggccacgtttaatatcaagcctagcctaatttgcaaagggtctcccagggttaatttattggagtgatcacatggagtagaccagagtctgagggcagaaagctgtcacctgcttcggcaatagaggccccagatgtctgggtgcaaaagaactccatagcaccccgaccaacatggtgaaaccccgtctctactaaaaatataaaaattaggccgggcacagtggctcatgcctgtaatcctagcactttgggaggccgaggcaggtggattgcctgagctcaggagttcgagaccagcctagggaacacagtgaaaccccgtttctactaaaaatacaaaaaattagccgacgtggtggcatgcgcctgtagtcccagctacttgggaggctaagacaggagaatcgcttgaacctgggaggtggaggttgcactgagccgagaccgcgccattgcactccagcctgggtgacagagcgcgactccccctcaaaaaaagaaaaaaaaaaaaattttttttttttttttttacacacacacacatattttagctgggcatggtggtgtgcgtctgtagtagtcccagctacttgggaggctgagtcaggagaatcgcttgaacctggaaggcagtggttgtagttagctgagaacatgccactgcactccagcctgggcaacagagggagactctgtctcaaaaaaaaaaaaaaaaggaactacataggatgaacatcccagatcagggaatgttgactgtcgacagtatcagtatctacagtggctactgtctgatgtagaaagaaatgggatcaggctaggcgtggtggctcacgcctgtaatcccagcactttgggaggctggggcaggaggatcacaagttcgagaccagcctggccaacacagtgaaaccccgtctctactaaaaatgtgaaaattagctgggcatggtggaacatgcctgtagttccagcttgaacccaggggtggaggttgtagtgagcctagatcacgccactgcactccagcctgagcaaaacagtgagactctgtctaaaaaaaaaaaaaaaaaaagagagaaatgggacctccgtcttagactgaagaattcagttctacgtgcttagcagtgaatacttttgtccaaggtactctggcaggaggaagaggcgtgtcctcttgagttcttgacttgggctctggcctgttaatatttccatgttggtgaaaccagaggcagcactctaggtgcacgaactttaggcagcgcagcctcctagtcttatggaacatctgaggcagaagaaacctgagtccaaccttttcattttatagatgaacaaacagatcctgatgggacagtgtacccaaggtcacccagccaagaggctgagcaggactgtacgtcagatccgtttacctcagtccttaatgcatgcagtccagccagattaagggacccttaatactgtcagctttccccactgtgggatcttcatcctcttgacttcttttgtagccagacatctgggcctcttgctggagaaggtggcagcttgctgctcttagactctagtctactccatgtggcatctggatggcactgaaattttctcaagtgccttgtctgttgtagataatgaatctatcctccagtgactcagcacaggttccccagtgtggtcctggctgccctgcccctgccagctgcaggccccacccttcctgtggccaggctgatgggccttatctctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggtactgaggaaggttaaagggaccagccttggagtatttccccactctgagactcagctggccacaggccaggttctgaagttcctttcttccaagccagtgattctggttcttggacaaggtgttgaggaacactagaaacagaggggactgtgacctggggactttttctgcaggaagaaaacagcccaaagatgagagtgattcgcgtgggtacccgcaagagccaggtgggtgcaggagccggggtggaggaggtttgtcagaacagttatgatgctcacagcatcacaaattgggggactcagagggttagttcctagtatgaaggagatggggtggctgggcgttaagttccccgggaaatggcagattacattctatggcaagatcatccctaggctgggaaaattgttggagtgcagagggctcccaagccccttctcatgcccagatggaaattccagtcccttcaggatctgcctaacctgtgacagtctaaagagtctgagccgtggctgggaagggcaggactaatccaaatctctacccgcagcttgctcgcatacagacggacagtgtggtggcaacattgaaagcctcgtaccctggcctgcagtttgaaatcagtgagttttctggaaaggagtggaagctaatgggaagcccagtaccccgagaggagagaacacaacatttctggctttgcctatagctaaagcccgtcccgctgccccgagattccttctgggctgctcccagttctgaaggtgctttcctctgaatacctccagctctgactacctggattagcctggcatttaacatcttgagctttgggtctttttatgagtgtttctggtcttcctgctcgattgtatatactcagagggcaggaaccagggattatgtgcctctgtccccatcatgaatcgtagcacagtgctaggctcagtaaatgctgatcaataatgagcacctgattgattgactctctcctcagttgctatgtccaccacaggggacaagattcttgatactgcactctctaaggtaacaacatcttcctccccagttcttgtccccactcttctttccttccctgaagggattcactcaggctctttctgtccggcagattggagagaaaagcctgtttaccaaggagcttgaacatgccctggagaagaatgagtaagtaaagataggagagtgtggtgccctcccagtctcttgctgggaccctagtatgctaggtctcttgctgggacccggggtgtcagataggctgctgggcttaaaccctcagagaggctgaaggcagctcataggtgggttttttcaggcttcagaaaaggagagtgtctggttctgagccatctggctgcctggactgcaagaatggctgggggagggagggtaggagggagagtaggagggagagtgagaggagagcagttttcatgctcctgagatcttgagaaggtgtgcttcctgaactgccctaggctccaccactgaagtagaggcaggggtgggtggagaaggggtgaaggctggctgctcataccctttctctttgcccccctctcccatctctatagagtggacctggttgttcactccttgaaggacctgcccactgtgcttcctcctggcttcaccatcggagccatctgcaagtaagagtcttgcaagtaaggggcttgggcaggggtaggcatcatgtgaacctttgcctttccctttggggcctgaccctctgcttcagggttatctcctctgccctgaggagtgttgactggtggcagaaaactcaagaaataccagtgagttggcaatcgagagagaatagaggtgatctgaacttaaatctcttccctcattctgtgcccttccctcctcccccaggcgggaaaaccctcatgatgctgttgtctttcacccaaaatttgttgggaagaccctagaaaccctgccagagaagaggtaagtggggcctggataggcagcttggtgggatgtgcccagaagatgcagggatgggaggaggaggaaaggaacagtgactgcctagtgttaaaatctcattgtaacttctctctgggcagtgtggtgggaaccagctccctgcgaagagcagcccagctgcagagaaagttcccgcatctggagttcaggagtattgtatccttttagaagagtgacggatccttttggaagagtgacggagacagcagccaaggaaaaagacaaggtctagagggctctgggagtccggagagtggaaggggcttccagcaagcagcccgtggggtcagtggcctgtctgtctttccatgcactcatccgtccactcatttacagtctaatgttttcttagccccagacaagtgttcagagtgcaaggcattggggataatggtgagcaagataaacattcccctgcatatgtagagtttacgtcttacttagggataatgcagttatactgaactgaatagtgactacttctggagggatagggagtacttccttttttttttttttttttttctgagacggagtctcgctctgttgcccaggttggagtgcagtggcgcaatctaggctcactgcaacttctgcctcctgagttcaagcaatcttcctgcctcagcctcctaagtagttgggattacaggtgccaccacacctggctaatttttgtatttttagtagagactgggtttcaccatgttagtcaggctggtctcaaactcctgacctcaggtgatccaccagcctcggcctcccaaagggctgggattacaggcttgagccccgcacccggtcagtacttccatttttatatgctactatattgtcttgacttttacaatgaatatgtagtacatttcataaaactaaatttaaaaatagtatgtgctaagtgctccaataagtgaagttgggaattttctggaaacttctagttggaacatctaaacacagaagtctggggtgtcagggaaggtttctcagaggtcttgtaaccttggcaagttatttagcctccctatgtcattttccttatctgtaaagtggggataataatactaccttcctcacagggttgttgtgaagatgaaatgagctgacatatggaaagtacttttagagcagtgtctggcatgtagtaagtatgatgtaactgttagctgttaacattaagctgagagctggaagatgactgaaagtcagccagctagagagggaaagacagactcaggcagagggaaccgcacgaggccccagattgcccgacactgtggtccttagcaactctccacagcggggaaacctcaacacccggcttcggaagctggacgagcagcaggagttcagtgccatcatcctggcaacagctggcctgcagcgcatgggctggcacaaccgggtggggcaggtagggcctgcccctatcctctccccagctcatctgcatctcctttctgccttacagtcatccccaatttaggatttttagactttatgattgtgtgaaagcgatatacgttcagtagaaactgtacttagtacccatacagccattctgttttttactttcagtacagtattcattacatgagatattcactttattgtaaaacaggcttggtgtcagatgattttgtccaactataataggctaatcttaagtgttctgagcacatgtaaggtaggctaggtgtattaaatgcattttcagcttgttttcaacttaacaatgggtttatcaggatgtaaccctattgtaagtcaaggaccatctgtcttcacttcttgaccaccccacctctaacaccgtaggctgggaagattgtgaatcagaggccagactctaggctttcatggagaaaatttacaaaaaaaaaaaaaaagaggccagactcacacttaggcctacccaggctttctagatgatagggaactcccatctcactgccaggtgcttttagacacccccgtgtccacccttttgactccctgttccgcctccacagatcctgcaccctgaggaatgcatgtatgctgtgggccaggtacacttgaccagggaagccacatggtgacatatgccttccctttgttctcaaccaagaagcttgtctcacaaccttctgcatctgcttccccagaatagcattctcagggaggggcagaccttgggatgctaccggtccaaaaggcgctggggagcaagtagatagaggtggtcccatgctttgcgccattggttggggaaagatcaggcctgatgtcctaggatgtttttccatcagggggccttgggcgtggaagtgcgagccaaggaccaggacatcttggatctggtgggtgtgctgcacgatcccgagactctgcttcgctgcatcgctgaaagggccttcctgaggcacctggtagggcctgtgctccacctgtggagggctggggacttggagagctgggaaaggtggcagggaagatttcttacatgaatgctctgtatacagtgctaactcattcttgttgaatgttgtgtatggataggaccaggtctgggcccacagttgccttttcagtgatgtcctcaggtctgtggtcacagggtggtgttaagagcccttgcagctcacaagaacttcttgttacaggaaggaggctgcagtgtgccagtagccgtgcatacagctatgaaggatgggcaagtaagtggggggaaatgggcgggaagccagggaaaggaggactgtggcatttcttcctgtgcatcccaggtttctaggtagtcccctctcagactgtgctgaggcaactgttttcttccccagctgtacctgactggaggagtctggagtctagacggctcagatagcatacaagagaccatgcaggctaccatccatgtccctgcccaggtaccaaagctggagggcgagggggtaataaacaagagtgcatataatctcttgttctcaccaaatcccacctccttccctcatacagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtgttgtgtgtgcgcgtgtggagttggcgggaagataggaacaaacacaaagccctttcatccttacctcagaggctgggacttttgcccagagttctcctggtacgtcctttctgcttctgcctcaatagttttcatttcacacagaataaattgtctcccaggaacaccaagaaacagagccacaatcttaaattcctatggtttgccccttcagttaacagtagagcctgtttatattgcatggcccctcccacccctattatcaggaaagtatagaaagtcactaattctacaactctcttgcaaaatgaaaacaaatgctccatttaaaaaaaaaacaatcctttaataaaattagtccatctaaaactccccaatgcctaaggttctagtcgtggaagggttagctgcagaattccagttcagaagccaacggaggctcagtccagacagggattaaccgacttgtgctggtatctaggtgcttggattgccgagttgagtttgctggaagggaaatggggcggcgtcggggggcccgacaggcctggctgccagtcggcttccgcgaaaacgactcttgctgtccacatagccagccgtgaagccaaactgcaggcctctgccctcccctaaatgtcctcctaggaggcagtcactcgggaggaagatgtgcctgttaccaagtgcttcgtcccggccccagcgcagacctatgaatgaagatggagggagagctgatgtgaaaggcctgggtcccggccgcagaaggggcgccagaccgaaatcagcgatcgcgtctctcccaccaaagcctcccggccagcggccgcgtctgaaagtcctgggctaagcaccacgccgggggggtaccagacaccccggctgcagctgccgagggcctcactcaccttcagggccgccggcctctcggcctggactgcccacctcggccctgcgtcagagcggaaggccaagtcttccagaaggtgctgcggcctccccgcagccccttagcgactcgggatggggcggctgagtcacgaacgccgaggcgggcaggtgcggcgccgccggcctccccccggcaggctcgggtcttccgcgccacggaggtccccgaagagcgcccaagccgcatccggaaggcccgaaccctaccggagggcggacggcggacagggcagggcccgaggccgacgcggcaggcggtgcgggacgggagcgggggcgggcggggactcgaggccgggcggcgaaggcgggcgaggggaggggaggggaagggagccgcggcccgcttgccccgcagtctgaagcggctcagctctttccatgagggcggtggtggcccttaaaaagggctttgtggtggcatggggaggcctggcggccggccgcggcgcgggccctcttagtactcctgggaggcctgggtggccttcttgccgcccgagggcgccttcggccccacggtggcgctggtcttcttgggcagcagcacggcctggatgttgggcaggacgcctccctgggcgatcgtcacgccgcccagcagcttgttgagctcctcgtcgttgcggatggccagctgcaggtggcgggggatgattcgcgtcttcttgttgtcgcgggccgcattgcccgccagctccaggatctcagcggtgaggtactccagcactgccgccaggtacactggcgcgccggcgccaacgcgctcggcgtagtggcccttccgcagcagccggtgtacacggcccactgggaactggaggccggcgcgcgacgagcgcgacttggccttggcgcgggccttgccgccagtcttgccgcggcccgacatgctagcgaggtagaccggtgaagcacgacggctcaaacactagaacagacgcccgccgcagtgtaactgctgtcgcgcgcgcgccgcgaggccgcctttataagcccccaggacacacctctgcgccctcctgattggctcttttctccaata

SEQ ID NO: 16389 - DNA, 26314 bp, Human
cctgtttccagcttcccacgggggtccgcaagtccgcttctctctcccccaaatatctaattctccagcacccaggcatcagaactcaggactgtgcacttcaaacacccagcccccagcggcctagaactccactgcccacctgcctgggatccgggagacttgttctcctcaccaggtgcctggagaggctgctcacattgatgcctcggtaccttgcctctctggccaatctctaaacatacctgatcctctctttggaagctggggacctaatctcgggatatctgcgaaatagggaggagaagaaagacggctcagagggagggaggattccctctgggacctgaactggtccactcccttctgaccctccactctccacttccaacaaagtaacgaactcggtcactgatgcagccaggcaaccctgctccgggggttctgaacacgaatgccgtgtgggggttccttaaagagaccagagaccggcccggcgcggtggctcacgcctgtaatcccagcactttgggaggccgaggcgggcggatcacgagggtcaggagatctagaccatcctggctaacatggtgaatccccgtctctactaaaaaaaaatatatatatatacacaaaaaaattagccgggcgttgtggcgggcgggcgcctgtagtcccagctactcgggaggctgaggcaggagaatggcgtgaacccgggaggcggagctcgcagtgagctgagatcgcgccactgcactccagcctgtgtgacagaggtagacaccgtctcaaaaaaaaaaaaaaaaagagagagagagagcgggagaccagagacctcgcggcctcactgtacacatctcgcttacaagaaacttaaaagaggcggggcgcagtggctcacgcctgtaatcccagcactttgggaggcggagacggggaggcaagattgcttgagtccaggagatccagatccagaccagcaacacagagatttttttttttttttgagacgtagtctcactctgtcgcccaggctggagtgcagtggcgcgatctcggctcactgcaacctccgcctcccgggtttaagagattgtcctgcctcagcttcctgagtagctgggattacaggcatgcgcaaccacgcctggctaatttgtatttttagtggaggcgaggtttctccatgttggccaggctggtctcaaacccttgacctcaggtgatctgcctgcctcagcctcccaaagtgctgggattacaggagtgaacccccaagcccggcttgacatccgtctctttaaaaaacaacaacaacaaagtgtgagaagtgtgaaagacagaacgttaaaaaaaaaaaaaggctaaaaaagaattaaagatttaaatatttgtattaaaaatttaaaaaatatacattagccaggcatggtagtgtggcctgtggtcccatctacttgggaggctgacgcgggaggattgcttgggcctgggaggtagaggctgcagtgagaagtgattgcgccactgcactccaacctgggtgacagagcaaaccctgtctcgaataataagaagaagaagaaagaaactcataagaaaggctatgcaattgctaccgcgctataacttccaggcacttcgtggggcgaaaataaatgggaaaactacagctcccatgaggcgaaggggccacgatgcccgcggaagttatttttcccccggccggcagggagttgtagttatctttgaaagccttctctctcttttggcataggcgggaaatgtggcgtcaagaggctgggattccgagaaagaagcgaggctttcacgaaaatgcgagcggcttcggcaaggggcggggccgctggacgtggatgaaagctacagagccagcgtggaccaatcagacctctttggggcggggcctctgtggataagtgggcgtggtctaggggggaagtcaccaagaacgcaccggaggtccttgcccgccctggaaaacgccctctgcggtgaaggagaggtgagaggccagggttcccatactcttgggtcctagggaggatgggggccagagggctggaaaactgggtcccggaggaggatgcactgggtgccagtactttaggtcctgggaaaagaggaggctgggaccctggactcttgggtctgggggaggaggcggccgagatcccggattcctgagtgtgagagaggagcgtgttgggagccaggacccctgggtctgagggcccagactcctgtgtcggaggaagggaaggccggaggcctggaatcctggggcctgggtaacaaaatgcttgtgtcttgattcttggaagtgggggcggcgctgggggcccgaactcctggttccaggggaggaagaggcttgggacagacattatgcattatccagccctccatcccccacagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgtgagtggccctgccctgctatccagccaggtgtttgcagtggtactacagctcctgcagaccccggtgcccgtagggcggatgctccagtgacttcctggccctacagttgtagcttgttttttgcccaccattcctcccagcagcaggggtttgacttggtgaaaaactggaggtccctgactctgaggtgtggaaaatctgcatcacgccccaactaaacgtctgtttttttaagattctctccacccaagaaggaatttgaaaacaaacaaacaaaactacatttcccagtagcaccatgttgctagttcccagtagcagttgatgttggctagctggggtattctgacttcatggtgctcttgggagttgtagtttaaattacagaagggcgggtgaactgcttgtttattaattcctacatgtgtttatcaaacccaataaaagctttggtcttaagggatttggaactttggagatcctgaaggtcagtgagtgtcttgtggtccgaatcttcctatagctccccataaggataggctggtcaggccaggcgcagtggctcatgcctgtaatcctagcactttgggaggccgagacaggcggatcacttgaggtcaggagttcaagaccagcctggccaacatggcaaaaccccatctctaccaaaaatgcagaaattagctgggcgtggtggctcacgcctataatcccagctactctgggaggctgaggcacgaattctcgtgctggaaccaagagaggtggaggttgcagtgagccaaggtcacgccattgcactccagcctgggcaacagagctgagactctgttttctgagactgtctcaaaaaacaaagaatgggctagtcattaccccctggaacggatcattgcatgttcctggtccccacgctgcaagttaggcctctattctgtgaaatccttgcagacccaggaaggctttgttgagtcccatttcttttcttccattccacatgtttcctgagcaccttctatgagccgggcatagtgttgcctatgtgttgcatagttgttagggcccagccatgtgcatgccccatgcccatggactatccctgctcactgggagatggaagacaaagggcagggctctatgagagtgaacaccaggggtgacagtcagggaggaagggaggcgtgagttgagttctttctttctttctcgctctgtcaccaggctggagtgcagtggtgcaatcttggctcactgcaacctctgcctcccaggttcaggtgattctcctgcctcagcctcccgagtagctgggactacaggcgcacaccaccacgcccatctaatttttgtatttttagtagagacggagtttcaccatgttggccaggatggtctcgatctcttgacctcttgatctgcctgcctcggcctcccaaagtggtgggattacaggcatgagccacctcattttttcttttcctttttcttttttttttttttttttatttttgctgtgtcacccaagctggagtgcagtggtgcaatcactgcaatctccatctcccagactcaagcgatcctcctgcctcagcctctggagtagctgggactgcaggcatgtgccaccatgcctagctaattttttttgtatttttgatagagacagggtgtcattatactgcccaggctagtctcgaactcctgagttcaagtgatttgcccgcctcggcctcccaaagtgctgggataataggtgtgagccactgagttctgaactggagagatatgttaagtcaagagcaaggaagagaggaagtgaggggaagagcattccaggcagagggaacagcatgagcaaaggccacttggtaggagaaagcagagcaagttgaggacgtcaaggaggctgctgtggctggagcagggagagtgagagggaggggagagggggattatgtggatcatgtgggatcttgtgagactaggtaaagaggtaaagaatgtatatatatatatatatgtttaatagacagggtcttgtgctggtgcccaggctgaagcgcagtggcaggatcatacctcactgcagccttgaactcctgggctcaagtgatcctcctacctcagcctcccaaagcactgggattacaggcatgagctaccatgcctggccttctctcttttgtaattttatttatttattttttccaacttatcttatttgcttttcaccacaactctgggaggcagaggatatattgcctattttataaatagtaagagcatagaaggcccagggagagtaaagtcccacccagctacgcatgacgggggtgggactaggaggcctgggacttttgtctgtgttgttcacagtgcctggcatatgataggggcctggtgaatgtttgttgaatgaatgaatgcatgcatgggcgggtgggtagatggatgggcagttggatggatgggcgggtggatggatgggtgggtggatgagtggatggatggatggatgggtggttggatggatgggcgggtggatggatgggcgggtggatggatggttggatggatgaatggatggatggatggatggatggatggatcgatgggtggtggatggatggatcgagtggatggatggtcggctggatggatggctggatggatgaatggatggatggatggacgggtggttggatggatgggcgggtggatggatgggtgggtggatgagtggatggatggatgggtgggtggatggatggatgggtgggtggatggatggatgagtggatggatgggcgggtggatggatgggtgggtggatgagtggatggatggatggatagatggatggatggatggataggtgggtggatggatggccaggtggatgagtggatggatggatggatgagtggatggatggatggatggatgggtggctggatggatggatgggtggatggatggatggatgggtgggtgggtggatggatggatgagtggatggatgggtggatggatggatggatgatgggtggatagatgggtgggtaggatgtatgtatggatgggtgggtgggatgtatggatggatgggtgggtggatgcatggatgaatgggtggatgcatggatggatggatggttggatggatggataaaagtatgattcacagcttcccaacaagtcatgtccactctgagcacccactctgggcagtattgggctgggtgttcactgatgtgattttcatttcatctttgctgcatatgtgggaaaaggtaaaaactgagtcccttgtcagctgccccagggagcaggccatagcagtaacaggagtgagggtggggatggggatgggagcaggggctgctatgtctgtccttgttgcctcaggacacaggcctgtactaccaccggtacctccaggaggtcatcgatgtactggagacggatgggcatttccgagagaagctgcaggctgccaatgcggaggacatcaaggtgcggctgggggagtgggggctgtgggaggggtacgtgctgggagggcagagttcaggggaggactggtttctttttttttttttttgagacggagtcttgctctgtcacccaggctggagtgcgatggtgcgatctcagctcactgcacctccaccccgcaggttcaagcagttctcctgcctcaacctcccaagtagctgggattacaggcgtacaccaccatgcctgactaatttttgtatttttagtagagacggggtttcaccatgttggccaggctggtctcgaactcctgacctcgtgatcctcccatctcggcttcccaaagtgttgggattacaggcatgagccaccatgcctgaccatactggtttcttcaaaggggccacatggctccagctgtgcctgtatttgaaaatcaccaaagtaagactcagggagaagttgcttcttggggtcacaagctgggaagagctttggggaacacagaatacgtgtttagtgcagagtcccgtgggcaggctttcagtcgcagctccgccgcttaccagctatggggcctcccctcaccgtgcctcagtttccccatctgtaaaatgggagacatcatagaacctgctgcacagttcggatttggattttccaagggaaggattttggggtttggattttccaaaggaagatgtgtaaagggtttggaagagcatggtgacactccttagcaagtgttgtgggagggctgcgtcaacagaatgctcctatggtgccttctacagaggaagaattcaaaataagggaggtgctggtgtcccttacatcaccatgaactcccatatcaggcctctaggagcaccatcattgtccccatttcactgagtaggacactgaaccctcgtatcaggatctgtccttctcatggacctgggtctcaccaccatgcacggctaattttgtattgtttctagagacagggacttgccatgttgcccaggctgatcttgagatcctcccacctcagcctcccaaagtgctgggattacaggcgtgacccaccgcacctggcccctaaacatgtggcttgatgaatgacaggagatggggcagcacaggtgggcagggccttgaatgccaggctgacgggctgggagctgtccttcctggagactctgaggagctgggggactataagcagggaaggggcagtataagactggggcatgagaaagcttataagaagcttccagagaagacagagagcaggcccccaggctgaccagggtctcctctcctgtcagagcgggaagctgagccgagagctggactttgtcagccaccacgtccgcaccaagctggatgagctcaagcgacaggaggtgtcacggctgcggatgctgctcaaggccaagatggacgccgagcaggatcccagtgagcaggggcagggcgggagggacaggcagggaggggtggggaagggtggcctcactcccggcctccaggtggttgtgtgctaggcaggtgaggcctccctccccgctgcgaaatgtgctgaaatgtgcgtgggagattgccccagtgttcctcccagcatgatttaatattaacattacaatgttgtttgtttatattctgtttccatttgttgtttttaaaaatctttatcatgggctgggcacagtggcccacggctgtaatcccagtactttgggaggctgaggcaagcaggtcacctgaggtcgggaattggagactatctggccaacatggtgaaaccccatatctgctaaaaatactaaattagccgggcatggtggtgcacgcctgtaatcctagctgctcaggaggctaaggcaggagaattggttgaacccgggaggcggaggttgtagtgagccgagatcgcaccattgcactccagcctggacaacagagtgaaactctgactcaaaaaaaaaaaaaaaaaattgtcatttaaaattctggtagaggccgggtgcagtggctcacgcctgcaattccaacactttttgaggcaggagaatcactcgagcccagaagttcaaaaccagcctgggcaacatagcaagacccctgtctctataaaaaatattaaaaaataagctgggcatggtaatgcatgcctgtggtcccacctccttaggaagctgaggtgggaggatcgttgagcctgggatgtcaaggctatagtgagccatgactgcgccactgtactccagcctgggcgacagaacaagatcccatctcaaaaaaaaaaagttgaaagaacttcaaacttttagaaaagttgtaagagtagtacagaaaactcccaaacacccctgacctggcttctctagttaacatttgctccatttgctttgtcactcacgtttgggacttcaccacagtcaccatctcatcacccttacacatttcagtgtgatactcttgcataagtacagcgataaaatcgggagatttatcaggtcacactgtttttccttgctcagctaatatctttctttttttttttttgagacagagtctcgctctgtcacccaggctggagtgcagtggtgcaatctcggctcactgcaagctccgcctcctggattcacgccattcttgtgcctcagcctcccaagtagctgggactacaggcgcccgccaccatgcccagctaattttttgtatttttagtagagacggaatttcactgtattagccaggatggtcttgatctctaacctcgtgatccgcccacctcggcctcccaaagtgctgggattacaggtgtgagccaccgcgcctggccttttttttttttttttttggtgagacagaatcttgctctgtctcccaggctgcactacagtggcgcgatctcggctcactgcaacctccgcctcctgggttcaagcaattctcctgcctcagcctcccaagtagctgggattacaggtgtgtgccaccacacctggctaattttgtatttttagtagatacttgattttgccatgttggccaggctggtcttgaactcctgacttcaagtgatcctcctgtctcggccttccaaagtgctgggattacaggcctgagccaccagccttggcccccatcttaaggtctttaatgtaatcccatccgccaggaccccttagcccggaaaggtcacgcattcacaggttccggggatcaggatgtggatatcttttagggcaccagtatccagctgccacaacacccaggctcttcccgtccctcctctgcccagagcctgcccccggcaccccagtgccctcaggcccgcattcatgttcctcttgtctgctcggagcctgggtggaccttggccacacccgcccaaccctgcccttcccgtatgcaccctgaccttcttgcgtcagcatttttagaaattgctggcgtgcagccttgggacctttgtccgttcgccccgctctcccgtgacattctttctcagggctctttgcctggtccatggaccttccatctcccctggaatgtcacctcctcagggtgtcaccgccccggctgtcctgtgtgaaggagcctctgtgttatttgtgtccttggtattcctttgttcatcccttggtcgcctgttctctgtctctctagactgggtgctccaagaggcagaactcttttggttgttgttgtttttgagacagagtctcactctgtcgcccaggctggagtgcagtggcgcgatctcggctcactgcaacctctgcctcccaggttcaagcgattctcctgcctcagcctcctgagtatctgggattacaggtgcccgccaccatacctggctaattttgtatctttagtagagacagggtttcaccatgttggccaggctggtctcaaactcctgacctcaggtgatccacccgcctcagcctcccaaattgctgagattacaggcatgagccaccccgcctggcctccaagagtcagaattctgtcatcatttgattcctgctgtgtccatagcggccggcgctgggtcagcctggaatagcggctcaacacacgtccctggcacaaataatgaatttgagattcagtttgtacctgtgtcctgcacacctgtcactcctctgggctcagccagggccggagctgcctccactgcagcctaggtctcccaaattctagctgcccgtgtgtgtgtgtgtgtgtgtgtgtgtgtgtgtgtgtgtgtgtgtgtgtgtctttctgcccacttgaccaaggggtgtgtgtgtgtgtgtgtgtgtgtgtgtgtgtgtgtgtgtgtctttctccccacctaaccaagggccactggaggccagggccaggctgattcattttgggtccagcattgcacagcgcaggcctgggcccctagaagcctcgggagacatgcgtgcggtaagtgtgtgttggcagcgtgtgcgctgtcctttcctgcctggaaaccctaccccttcctgactacttggaaactcccatatgagggaggctgcacttgtttgctgaggccgctgtaaccaagtaccactgaccaggtgcttcagcaacagaacttgactgtctcatggcctgcagtcagagtccaaagtgaaagtattggcagggttggttccttctggggctatgagggaggatctgtaccaggcccctctccttggcttgcagatggccgtcttctcactgcattttcacaccatctttcctctctgtgtgcctggcccaaatttctccttccattattattttttattaattattattattattatttttttttttttccaagacagagttttgctctcgttgcccaggctggagtgcggtggcgcgatctcagctcactgcaacctctgcctcccaggttcaagcgattctcctgcctcagactcctaagtagctgggattacaagcacgcgccaccacgcctggataattttgtatttttagtacagatggagttttgccatgttgggcaggctggtttcgaattcctgacctcaggtgatccacccgccttggcctcccaaagtgctaggattacaggtgtgagccaccgcgcccggcctattattattttgagacagggtttcacttctatcctccaggctagagtgcagtggtgcgatctcggctcactgcatcctccccctcccacgctcaagtgattctcctgccttagcctcctgagcagctgggactacaggcacacaccactgcacacagctaatttttatattttttgtagagatggggtttcaccatgttgcccacgctggtctcgaatgcctgagcccaagtgatcctcccacctcagtctcccaaagtgctgggattacaggcatgagccactgtgcccagtcataaatttctgccttttataaggtcaccaatcatgttggattagggcccacagtaatgacctcatcttaacctgattccctctgtaaagacctagtctccaaatcaggtcacattctgaggtactggggcttaggacttcaacatagaaacttaggagcgtgcaatttaacccctaagattggttgatgctttatcaaaaattttgatgtttttcttttgtttgtatgtatgtatttattttatttatttatttttcagacggagtctcactctgtcaccaggctggtgcagtggcgtgatctcggctcactgcaacctccgcctcccaggttccagtgattcccctgcctcagcctcccaagtagctggggctacaggtgcgcaccaccatgcccagctaattttttatgtttttattagagatggggtttcaccatgttggccaggatggtctcaatctcttgatcttgtgatccgccccccttggcctcccaaagtgctgggattacaggcgtgagccaccgcacccagccttgtttgtttttttaaagagtggttgaggctgggcgtggtggctcacacctgtaatcacaacactttgggaggccgaggtgggtggatcacctgaggtcaggagttcaagaccagcctggccaacatggtgaaaccctgtttctgtttctactaaaaatacaaaaattagccgagtgtggtggcatgcacctgtagtcccagttactcggggctgaggcaggaggattgcttgagcctgggaggcggaggttgcagcgagccgagatcctgccactgcagagtgaaaccctgtctcaaaaaaaaaaaaaaagaaggaaaagaaaaaaagaaatggttgagtgtcatggtttttggatgtccaatggctggttcccatccttgctctgccacttgctagctggtaccctagaccagtcacaacccctcaaggggtctcagttttcacattcataaaatggggataatcataaaacccttgttgtcaggattttgtggaaagtgaatgaattaatacagttaaagtgcttagggcatggcctggcatctagtaagtaggcactacatgttagtttttattatggttattattgtaagcatcagactcagtcgtgggatcacctcctccaggaagccttccctgattgccccaggttcaagctgtcttctgggcttccctagtgctgtccgtgacttctttggatcatgtctggcccaagatgggggttctgaaagaacatgccctcaggtgttggactcttccctctcttccagatgtacaggtggatcatctgaatctcctgaaacagtttgaacacctggaccctcagaaccagcatacattcgaggcccgcgacctggagctgctgatccagacggtaatgggagtgggtccggaggcagaggattgagggtagctttgcggaaggggagaaggggacagagtcccagacgtgagccagctcaccattcctgctggtgttctctgaggttggaggctggtagagggctgagtcgtttcttttcttttctttttttttttttttttgagacgaaatctcgctgttttcccccaggctggagtgcaatggcacaatctcggctcactgcaacctccgcctcccgggttcaagcgattctcctgcctcagcctcccgagtagctaggattacaggtgcctgccgtcacgcccagaaaatttttgtatttttagtagagacagggtttcaccatgttggccaggctggtctcgaactcctgacctcaggtgatccacccgcctcagcctcccaaagtgctgggattacaagtgtcagccaccgcacccagctcttcttatagtgatacccaccgtaatctagcaggccatcatcttaactaattacatctgcaaacactctatttccaaataagatcacattctgagattccaggtggacatgaatttgggagtgtggggggagtatactgttcaacctggtattgttaactccattttacagaggtggaaactgaggcacaaagaggctgagtaacttgcccagtgtcacagagcttatgagatttggtcacaaagcaaagcctagatttgaacgctgggcaaaatagttagaaacctcttgttctttttttggtttatttttactttttttttttttttttttacctgagacagcgtcttgctctgatgcccaggctggagtgcagtggcatgatcacagctcactgcagcctcaacctcctgggctcaagcaatcctcccacctgaccctcctgagtagctgggaccagaggtgcaagccaccgcaccaggctaattttaaaaatttttagtagacacaaggtctcgctgtgttatgtgagttagtcttgaactcccgggctcgagtgatcctcccaccctagcctcccaaagtgctaggattccaggcgtgacccacctctcctagtctgaccttatgttcttggccacctagctgtacctgaaatacataaatactaagttcaccacatatgttgttcctatttacttattcctccaagatctggagattgtggaggacttgaaagaggtgggttgaagttgctattgtataaccgtcccaatctgttttgaataaagagaagaaagtgtgttatggggcaggagcagtcatggaaaccaaaaagggcgacatcaggctgtgcgcgatggctcacgcctataatcccagcactttgggaggctgacgtgggcggatcacctgaggtcaggagtttgagaccagcctggccaacatggtgaaacctcgtttctactaaaaatacaaaaatcagctgggcctggtgacacatgcctataatcccagctactcgaaaggccgaggcaggagaatcacttgaacccggaagacagaggttgaagtgaggcagtgagcagagattgtgccaccgcactccagcctgggcaacagagcaagactccctctcaaaaaaaaaaaaaaaaaaagggacattaggacacgagacgtaagaaagacaggtagaggctggggctgccctcagccaggttcagggccaagggcctgccatttacaggctggaattgggggctgggcagagggggcagaggggaatgaccctgtgcctttccccaggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctgtaaggaccccatttgtgcccatccactccctaccacatccagttcaaacgcaagacaagaaagcagttaaagaactacaattcccaggggcccttgaggcaaaaaactccctgttactgtacctggctgccccagggtctgctgggagttgtagttttcttagttttcttgcttgagggagatgatgtttgttggatgagggtaaagggatatttggttttatcccatggcatccagacttcttgctcatgagctcctggctctcccctccacagggcagccaagcccagttgaaggaggtgtgggaggagctggatggactggaccccaacaggtttaaccccaagaccttcttcatactgcatggtaaggtggggagggagttccagagccaggatgaaccctagattctgacccttctaggacctgaatgctaagaggggtgtgtctgtcccaggagggcttagtcaggcccaagagccaagcctatgtcccctggttgaccagacagccctgcctctcccgactacaaggctaggatctgcatggaagggttgggcctcttttctagcaaacaccagacctcggggttctaaggacagctggtgtcctctgtaagcaaaccaggcttggctaggcctgggccctctgcccacagcagcccaggagaagccctggtccactctgggaaccctgtcgctaggagtgggttgttccctaagaaccaggcctccagaagcctggaaaaccctttctctttttctttttcctttttttttttttttttgagatggagtcttgctctgttgcccaggctggagtgcagtggcatgacctcggctcactgcaaccccctgccctccgcctcccgggttcaagtgattctcctgcctcagcctcccgagtagctgggattacaggcatgcaccaccatgcccggctaacttttgtatttttagtagagatggggtttcaccatgttggccaggctggtctcgaactcccaacctcgtgtgatctgccccctcagcatcccaaagtgctaggattacaggcgtgagtcactgcgcccggcctcgaaagccctttctctatggtggatcaaaggcacactcccctcagtctgtctcttcctgtctggaaatgtggcctggggttgccaagccccctcaggtatgccaagcaccctgtcccagaatctgcagccggtcagataagcttagcaaggcctgactcattcattcagcaaacctttcctaagttccctctaaggaccaagctttgtcaagaccccgtggatacaactgtaaacaaaacaaagtacctccccctcagagccagtgatcaggcacacagatcataccatactttagtaactccacgagactgtacagtatgagaggtgctagcattttacgtaagctgccaattaaattaacgtaccattgaaaacaagatgcgtcctgggctgggtgtagtggctcacgtctgtaatcccagcactttggtaggccaaggtggaagatggcttgagcccaggaatttaagaccagcctggacaacaaagtgagaccctgtctctatttaaaaaaaaaaaaaagaccaggcgtggtggctcacgcctataatcccagcattttgggaggttgaggtgggaggatcacctgaggtcaggagttcaagaccagcctggccaacatggtgaaaccccatctccacaaaaataccaaaattagctgggcatgatcgtgagtgcctgtaatcccagctactcaggaggctgaggtgggagaatcacttgaacccgggaggcagagtttgcagtgagccaagatcgtgccattgcactgcagcctgggtgacagagcaacactccatctcaaaaaaacaaagaaaaaaataaaaattaaaagttaaataaataaagatacatccctatttcaggggtgataaaatagaagaacacaaaagtgcatctcagaatcaacgaaggttctaggccgggtgtggtggctcacgcctgtaatcccaacactttgggaggcctaggcgggtgggtcccttgaggccaggagttggagaccagcctggccaacatggcaaaacccagtctctactaaaaatacaaaaattaaaaaacaaaacaaaacaaaaattagccaggcatggtagtgctcacctatagtcccagctactcaggaggctgaggtaggagaatcgcttgaacccgggaggcggaaggcgggggttgcaatgagctgagatcacaccactgcactccagcctgggcaacagagtgagactctgtctcaaaaagcaatagaaagtaaaaaagaattagaagattctgtaatggggtctcaggtagtgacgtgtactacctcgcagccttgaccacccaggttcaagtgatcctccccctcagcctcccaagtatctgggaccacaggcacgtaccactatgcctggctaatttttttaatttttagtaaaggcaaggttttaccatgttgcccaggctggtctcaaactcctttgctcaagcgatccacctatcttggcctcccgaagtgctggggttacaagcatgagccatccccaccgggcaccaccccccgtgttttgttttgttttttttttgagacaggatcttgctatgttgcccaggctggagtcaaactccaggcctcaaacaatcctcctgcctcagtcacctgagtagctgagactgcaggtgtgtgccactgcgcccagctttaaagatgtttaattgtacagttcaatagtattaagtatatttacactgtcatgcaaccagttctgagagctcttcatctcgcacaaccgaaaccgtatccattaaaccactcgccctccccttctttcccctgctctctagcaaccaccattctattttctgtctctatgattttgactattttaggtacttcatgcaagtagaatcttttggtatttgtcgtgtgtgtgtgtgtgtgtgtgtgtgtgtttggcttatttcacttagcataatggtgaggaactgaagttttcattctactggatattaatttctatttcaattgccccatgtggctagtggctgctgtactggagtcccagcacagctctagagaggacatttgggctggatgcggtggctcacgcctgtaatcccagcactttgggaggccgaggtgggtggatcccttgagtccaggagttcaaggccagcctgggcaacatggcacaaacccatctctacaaataaaatacaaaaattagctgggtgtggtggcgtgcatctgtagtcccagctccttgggaggcagaggtgggaggatcacttgagtccaggaattcaaggctgcagtgagctatgatcataccagtgccctccagcctgggcaacagagtgaaaccctgtctctaaaaaatagaaaataggctgggctcagtggctcacgcctgtagtcccagcactttcggaggccaaggcaggcagatcaggagctcaagagatcgagaccatcctggccaacatagtgaaaccccgtctctactaaaaatacaaaaattatctgggcatggtggcacgcacctgcagtcccagctactcaggaggctgaggcaggagaatcacttaaaccctggaggtggaggttgcacgtgagctgagatcatgccactgcactccaggctggcaacagagcgagactctgtctcaaaaataaataaacgaataaataggcccggcgcagtggcttacccctataatcccagcactttgcgaagccaaggcggctggatcccttgagaccaggagttcaagaccagcctgggcaacatggcaaaaccccatctctatgaaaacaaatacaaaaattagctgggtgtggtggcgtgcatctgtagtcccagctacttgggaggctgaggtgggaggatcacttgagccgaggagttcaaggcttcagtgagctacgatcacaccattgcactccagcctgggtgacagagtgagaccctgtctctaaaaaataaaaaaataaaaaccttatttaatctttttaatcaggcagtccctacagaccagaataggttcagagcaactccctatacctttttttatttttcattttttttatttttagagatggggcttccctttgtcacccaggctggagtgcagtggcgtgatcatggctcactgcaacccagacctcctgggctcaagtgattcttccacctcaacccttagagtagctgggatcataggtgcacaccaccatgcccagccaatttttaaattttttttttctttttgaggcagagtcttgctctgttgcccaggctggagtgcaatggcatgatcttggcacactgcaacccccgcctcccaggttcaagctattctcctgcctcagcctcctgagtagctggggttacaggcacttggcattatgcctggctaatttttgtatttttgtagagacggggttttactatgctggccaggctggtcttgaactcctgacttcaggtgatcctcctgcctcggcctcccaaagtgctgggattacaggcgtgagccaccgcacccggcccaattttttacttttttttttttttttgtagagacggggtctagccatcttttctaagctggtctcgaacttaatgtgctcaaatgatcttgccttagccttccaaagtactgggattacaggcatgagcccctaaatttggcccctacattttctttaatcttaatcaatttacatttaaacagcccatgtggctagcggctactgtactggacagcgcagatccagagtttaggcagagaagagacccccaggcctgagccctgggccacactagcatgtggaggtcaggaagaggatggagccgtcaaaggaggtggaggggcagccagagaggacagaatcatgttctggaagccaagggcagaaagtcaagtcagatgcaggtggaaattaaccactggatttgcaagatgagggttcctggcctcctcctcaggaggaaggttgtgcttgtctgagggagccgaggaaggagggccggtggtgaggacaggaagtgtggctgaccgagcctgaagccctgcagctgtggggtctacgttggtaggagaggctcccctcacaactggagtcggcactggcctggttgtctgggaggcagaggtccctgataaccctggagctgactctgtgtccagagcactgaatgccagggccagagaatcctgcatgacagtgacccaagcatgtttcctcgaaccctccctttgatctattccattctcaaccccctggtcgctaggcagtggccctagcaacgggtctagtggggtactaaagcctgggggccaccgttccaccgcgggagacccgtagttacctgtcctctgataacagaccccacatcagcccaaaatttcttcaccagggaccttacacatcccgtcctcggtcccctgagataccttgccatcctcttcccttcagatatcaacagtgatggtgtcctggatgagcaggagctggaggcactcttcaccaaggaggtgagcatcttggaagcctcgggcacctggagggacgcccaaatcagccacttgtttcctcctgcagtccccttaaatccccctggatgggagctcagtgaaaactacaactcccatcagcccctggggcaaaaacggctcccaggagtggtagcgtgcccaaaggactgctgggagttgaagttgtcgggaatgagctcgctggggacctctcaatgctgtctgcctctcgcttgctcctgcagctggagaaagtgtacgacccaaagaatgaggaggacgacatgcgggagatggaggaggagcgactgcgcatgcgggagcatgtgatgaagaatgtgaggtgggggccaggcgggggagaggacgggcccccagctctgtcactcacccttatctggctccccaggtggacaccaaccaggaccgcctcgtgaccctggaggagttcctcgcatccactcagaggaaggagtttggggacaccggggagggctgggaggtgagaacatgggggatactcggggtcctgaacctctctctcttctagccatgacctttctttcagaatcttaggccccttctctttctctctgggtccccgtccattctcctgggtcactgcatctctatctctgggtctctgttttcccctgtctctaggactcttatttatttatttatttatttatttatttatttatttattctgagacggagtctcactccgtcgcccaggctgcagtgcagtggcacgatctcggctcactgcagcctccacctcccaggttcaagcaattctcctggctcatcctcttgagtagctgggattataggtgcgtgccaccacacccagctgatttttgtatttttagtagaggcaggatttcaccatgttggccaggctggtctcaaactcctgacctcaggttatccacccaccttggcctcccaaagtgctgggattagaggtgtgatttttttttttttttttttttttgaaacagggtcttgctctgtcgcgtaggctggagcccagtggtgggatctcggctcactgcaacctccgcctcttggattcaagcgatcctcccatctcagcctcatgagtagctgggattacaggcgtgagccaccatgcctggctaatttttgtattttttgtagagatggggttttgccatatcggccaggctgctctagaactgctggactcaagcgatccacctgacctggcctccctaagtggtgggattacaggcatgcaccaccgcaccacacctagctaatttttgtattttttggtagagacagggttttgccatgttggccaggctgctctgaaactcctggactcaagctatccacccttctcagcctcccaaagtgctgggattacccaggctggagtgcaggggtgttatcatggcccactgcagcctcaaactcctgtcctcaagtgatcctcctgcctgagcctccctattagctgggactacaggcacatgccagcatgcctagctaatctagctcattcttttatttatttattaatattttttgagacagggtctcctgtcacccaggctggagtgcagtggtgtaatcatagttcactgcagccttgaattcctgggctcaggtgatcctccttccttagcctcctgagtaactgggactacaggcacataccaccatgcccagctaatctaggtctctgttttatttatttatttatttgtttgtttatttttcaatacagagttttgctcttgttgcccaggctgtagtgcaatggtgcattctcagctcactgcaacctccacctcccaggttcaagcaattctcctgcctcagcctcctgagtagctgggattatatgcatgtaccaccatgccctgctcattttgtatttttagtagagacggggtttctccatgttggtcaggctcatctcaaactactgacctcaggtgagccacccacctcggcctccaaaagtgctgggattacaggtgtgagccatggtgcctggcctatttctatatatttttcaagatgcccagccaattttctgtagagacagggtcttgctccgttgcccaggctgaccttgaactcctggcgtcaagtgatccttcccactttcgcctcccaaagtcctgggattacagatgggagccatggtgcccggccttgtctcttggtctttatcccactcccacctcccacttgggcttctttgcccacccacatggccctggcctcccagcctcctctacacctcccccattggcacaaccctctccaatatgggtgggccgaggttggacctgtgaccctgatggcccctgtgcctgccctgcagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggtgacagcgggggaagctgcttccatccactgaatctctggctgcccgtgtccgtgtccccatgggtgtccagaagctgggaaggcctgtggccaccatgttaatcactgggggagcctcaagtattcaccgccatcttgagtaagggcagacgttttcccgtctctgacggctctgtggctgccatgtgagataagggcattaaggctgtaagtgaggagggaaaggcccaggagggggagaaaggcagactcagccagggatgggtgagggtttccctgtcccaaagcaagacccaagctgtgactggagggagaactggatccttgactattattaagcctgactgtcaatgaaagagagaaactgaggcccacggagaaggggttggccgtgaccacttagcaggctgctgtgaagtctccgtttggggactgaggcctgagcacttgcaatgccagcatcacaccctcttgtctgtgtgaccccccacctcccacaggctgtgctgcacatggagcagcggaagcagcagcagcagcagcagcaaggccacaaggccccggctgcccaccctgaggggcagctcaagttccacccagacacaggtgctggccctagtccagggaggaggggctgcagggctggacccctgggtctgaggttggaggggctgggcctggactcccagatctgagggaagagggactgggggcccagactcccagatctgagggaagagggactgggggtccggacccctgggtctgagggaggaggggctgggggctgggacccctgggtgtgagggaggaggggctgggacccctgggtgtgagtgaggaggggctgggggctggacccctgggtgtgagggaggaggggctgggggctggacccctgggtgtgagggaggaggggctgggcctctggggtcctgggggaggaggggttcggatgtcctgtgccaccattccctccctccatttccagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaatgcatggctccatgcctgtgtatctggactggtccctccaaaacgctattgccacgtcacctgccggagtcctcatctttgaagactggattcaagcatcacttctgagaggctcaatcctggtatttttccatctgcccctgatgagtctgcagccttcactcagggtcccttcagccacaaggacagaaaacccaaacctgggattaagcaattttttttttttttttttttgagatggagtcttactctgtcacccaggctggagggcagtggtgtaatctcagctcactgcaacctctgccttttgggatcaagcgattctcctgcctccgcctcccgagtagctgggattacagctgcctgccaccacgcccggccttctaatttttgcattgttttagtagtgatgggggtttcaccatattggccaggctggtcttgaactcctgacatcatgatctgcccaccttagcctcccaaagtgctgggattacaggagtgagccactgcacctggccgggattaagcaacttttaaaagatgaatttggccaggtgctgtggctcacgcctgtaatcccaacacttcgaaaggccaagataggggggatcacttgaggccaggagttcaagaccagcctggtcaacatggcaaaaaccccatctctacctaagaaattgcgcaagatgagccgggtgtggtggtgggcacttgtaatcccagctactcgggaggctgaggcaagagaattgcttgatcctgggaggcggaggttgcagcgagccaagattgcaccactgcactccaaccggagtaccagagcaagattccatctcaaaaaaaaaaaaaagaatgtaccaggtatggtggctccacctgtagtcccagcactttagaaggcagaggcggatagatcacgaggtcaggagatggagaccatcccggctaacacggtgaaaccctttctctactaaaaatactaaaaaaattagctgggcgtggtggcaggcacctgtagtcccagctactcaggaggctgaggcaggagaattgcttgaacccaggaggcagaggttgcagtgagccgagatcatgccactgcactccagcctgggtgacagagcgagactctgtctgaaaaaaagaaggctgaggcaagaggatcacttgagcttaggagtttgagaccagcctgggcaacatagcgagaccccgtctcagaaaaagaaaaaaaattagctgggcatggtagtgtgtgcctgtagtctcagctgcttaggaggctggtgtgggaggatcccttgagccctggagtttgaggctgcagtgagccatgatctatcactccactgcactccaggctgggtgacagaatgaggccct

SEQ ID NO: 16390 - DNA, 36791 bp, Human
gtttgttaaagaagtgattaataagactgccacagacctactgtttcagaatctctggggaatgaggtacaggaatctgtatgttaaaaaaaaaaaacccaaaaccagatggttcttttggaaactaacacttgagaatcagtgctttattccaactcaagatttttaaatgctttcatctgttgaatattttaggttttgtctgttcatctatcaagtatagcaaacagtatgcttagtatgaactcattacagaatatttgtgtgtatgtacataggaaaaatatctggaagtatagatgtgggtgtgtgtatatatgtgtgtaaatatatataataatgttaatagtaggaatacagatgatctctatttttccgctttatccttctgttttatttctctcatttttttcttcctgtgtttaaaaaagatgcttcttgtttctgagctcaattcccccacctgagaacagggtgctgtaactaggtgaatttcaagatcatgtcttgttccgatggtccgtgactccatactaccccctaggttccctcgtccatctcacagcatgaactgcataggtaacaacagtgtttggagaataagcatgtattatttttgtatgtattacgtttgagatgcctagcaaccgtttttgtgcccgcaaaatttttctcttctttgtcaaggagccaaaacggaaatagtctactatctacggccctcaaaagttcctcctctctccttagccttagaaaataccgtccgccataggcatgggcaaagacctcatggctaaaacaccaaaagcaatcgcaacaaaagtcaaaattgacaaatgggatctaattaaaagaacttctgcacagcaaaagaaattagcattagcgtgaacaggcaacctgcagaatgggagaaaatttttgcaatctacccatctgacaaaggtctaatatccagaatctacaaggaccttaaacaaatttacaagaaaaaaacaaccccatcaaaaagtgggcaaaggatatgaccagacacttctcaaaaaaagacatttatgcagcaacaaacatgaaaaaaagctcattatcactgatcattagagaaaggcaaatcaaaaccacaatgagataccatctcacgccagtcagaatggtgattattaaaaaatcaggaaacaatagatgctggcgaggctgaggaaaaataggaatgcttttacactgttggtgggagtgtaaattagttcaactattgtggcagacagtgtggcgattcctcaaaaatctagaaccagaaataccatttgacgcatgcacacgtatgtttattgcagcactatttacaatagcaaagacttggaaccaacccaaatgcccatcaatgatagactagataaagaaaacgtggcacatatatgccatggaatactatgcagccataaaaaaatgagatcatgtcctttgcagggacatggatgaagctggaagccatcatccttagcaaactaacacaggaacagaaaacaaaacactgcatgttctcactcataagtgggagttgaacaatgagaacacatggacacagggaggggaacaacacacacgggggcctgtcaaggggtgggggccaaggggagggagagcattaggagaaatacctaatgcatgtggggcttaaaacctagatgacgggttgataggtgcagtaaaccaccatggcacatgtatacctatgtaacaaagctgcacattctgcacatgtatcccagaacttaaagtaaaattaaaaaaaaaaaaaaaaaagaaagaaaaagaaaaagaaaatgccgtccgcgcatatctctcaggagcataggaagggctgtgaaccaaaaagccagggcgtggtcgccccgcccaccggccgctacatcaccacccctctcgccgctttcaagcgcggagattggctgtaagcaagaaagagccccgcccctagtcttatgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggtgagttgtcgggccctcccgattagtctgtccgcctgggcccggggcaccagttcaaagctacaacctgaaagactggtccgagggggagggggttgagaggctcagcagctaacactgggcggcggcggttggcccggggaggcaagcggtgacctagagaaggcctgaccgacggatggcggggaagaagggcccaggagagtaagaaggggccggtaacggggggtggacgccgagggagtaggctgggaggagtgaagcgtggagagggtcagcgtggaaagagtaacttggggaaaacactgaggagtgagcgtaggagggtggtacatgcagattttgggcgccagagacaattaggagagtcttggtttgctgagatcagggaagagttttgaagatggtggaaaaactatggggtgagataggaaattaagagagaagaccatgcctgcctggagtagcttgggagaagtgtgtgggtgggggacagatgggacagataggacagtagagcctgaggggcaggggcagtgacagggttgggcattttgaaggttggaatttgagactgtgaagaaaggatgattcaagagattaggagtgatgctgggtttgagtttggtagtcatagttttaagggcgaaggaacctaaggtagctggggcaatttccaggaaagaaaacttggacccaacctctggagactaaggggttcagggggaactttgatggggagtgcacatctgacttggaggtattgaggatgtcgattttctcccagttttgctacttcctcccagccagacgctgacaaaaaaatccccagacgtttcagttaggagggcctcccagatgtgaggttttgggggtggagtatttgagtttggtagactacctctttgccttcagagtttcttcttttctttcttccccatcacacagctagcctattacctcatattttgggggtgcagggagcaggtagacaaacttgctaaggattgggttgttaccagggcctaagaatggctggatggggccgggcgtggtggctcatgcctgtaatcccagcactttgggaggccgaggtgggtgtatcacctgaggtcaggaattcaagaccagcctggccaacatggtgaaaccccgtctctactaaaaatacaaaaattagccgggcgtcgtggcacatgcctgtaatcccagctgcttgggcggctgaggcaggagaatcgcttgaacccagaaggcggaggttgcagtgagccaagattgcgccattgcactccagcctgggcgacaagagtgaaactctgtctcaaaaaataaaaataaataaatcaataaataaatggctgggtgaatgttcgctgattgtgttgtgccctaataggcagtgggtcgctaacaactttaatgcctaaaagtgaactttgactaaagtgtctcttcctgactttgattcatgctgtgcttgttgctacccacctgctcttgctatttgtgacttaataaaataacataaagaacagacccagatgggagtggggaagaaatagacatattaggggtctgagaaagcagtgagaggtatacattttgtaattcacatttcagtagaatgaaatcaacaccctggaatagtgattctcaaccaggggacatttggcaacatctggagacatttttggttgtaacaactgggggattgcttttagcatctagtgggtagaggccaaggatgctgctaaacatcctaactaagcacagggcagcccctgacaacaaagaatcatctccctgaaaatgtcaatggtgccaacattgataaatcctgctcgaaaaccatagtattggaagggttcttgattatctaattcagtgactctcgaggaccttttcatgcgtctgtgaaatcaaaacttcggaataaggttaagaaggtatttgtccttttctgctgggcacagtggctcacgcctgtaatcccagcactttgggaggctgaggcgggcggatcacctgagatcaggagttcaagaccagcctgaccaacatggtgaaacccagtctctactaaaaatagaaaaattagccggtgtcgtggcacatgcctgtaatcccagctacttgggaggccgaggcaggagaatcgcttgaacccaggaggcggaggttgcggtgagccaagattgcgccactgcattccagcctgggcaacatgagcgaaactctgtctcaaaaaaaaaaaaaaaaaaagaagttatttgtcctttgtccttttcactctcatcctctcaccagtgtacagcagagttttccagtggctacgtaacatgtgatgacctcaccactctgatgttcttatattttattcatttctcagttttaatttctaatactgtaaataccaatacatatgactcacataaacctctgtgaagtcctcagtggataagaaagtaaaggggtcctgacaccaaaactttgggaatccctgatgtagtccaactgttcacagcgcgcaggaaactcttctgtagcacttctgaaaggcggccttgaggcaggctttgcttgaatacttaattggaagccttaactgtaccttggagcacttactgagggccaactgaccctaagaaaggattgtttacaatggaaagtaccttatcagtgactagaacacatctgaccaaggcatctgttaatcagtagttccctgccaattgaatctgtgcacaaatacaacactgttattgttttgggaaagtgaaaaaaataatagttgtcctacttgttggctttcatgtcattaaatttttttttgttttttaatgaaagcttttttgttttgtttttacaaaagcaatgcttactcactgcagaaaataaacatgcaaaaagaagcacataaaagaacccatcagctcatctgctagtttgccatttattgatcaggactaactagattcttcctcttggaaaatttccaagattgattccctccgcctccaagttcagagcaggatttggaaaagtaaatattaataatgtacctagatctgatttttaagaggttccaggatgaaatagaaaccatttttctatacagctgcattttctgatggctcttggttcagtgtggagcccaaagtcctcccatatagctttttctgtcaagaatttagcagttgcttggtgggttttgcacaagttacttttctatatcaaaatggataccaataataggtttttgaaaacttaataaatatttgtaaagtacctaatatgtagctaaatcaataaatatttgtaaagtacctactatgtagctagaactgtgcctgggtactgtacggagtgccaatgaaggaggacctgtcctaaatttatagtcttattagcattagtgctctagctgtgccagtttgactttgtaactttataactctatcccagcttcacccataaccttttaaaaacagcagctttagaataagtacagaaaaggattcttagaggctatatattggtctttttcatagagattaaattatgctggtgtttatttggatgaattgtaactgaccagacaactttccgaagagaagctatatgatttagaggtgttataaagtggatagtgggtgaaaatcctttctttatataattgcctaattatggtccttttgtgatatcatagatttcaggattcttctgtggttattgattcttataactagcttgacttctgttttttggtttgtttgtttttttagggttcagaattttttttttttaggtttgaggcttttctgggtgggaaaaacctcacagaaatattcttagtgtatgttactggtaggagcctctcccttccacacgtttactgaatgcctattgtgtcccagccactatattaggtgaaagggacagaggaatggataagacagatgaggttcctgctctcatggagcttacattttaatgggagaagaaagctcaacagataaataatataatgtcagatagtgataaacactatgaagaggccgggcatggtggctcacgcctgtaatcccagcactttgggaggtcaaggtgggcaaatcacctgaggtcaggagttcgagaccagcctagccaacatggtgaaaccccatctctactaaaaatacaagggcatggtggccagcacctgtagtcccagctactcgggaggctgaggcaggagaattgcttgaatccaggaggtggaagttgcagtgagccgagatcatgccactgtcctccagcctgggggacaagagcaaaactctgtctcaaaacaaaacaaaacaaaaacactatgaagaaaattacacaggtaatgagaaaggagaatgagtagatgataggaatgggtgatggtggatgatccttctttatattatgtggtcagagggccttccgttatcgggtgacatttgggcagagacctgggtgttggcaggaggccagccatgtgaccatctggggaaataggaataaatcttatcatttgcaaaatcttaggttactagcctattttccacgcttttttgtttccccctagttttagtcaagtctctcctatggtagcagtctctaagagcagagacgatcttatgtactgttacttcccattgcctacctagcatagggtctggtacatggttaacccgtagtgaatttttgttgaagatattcattggtgggcactagggatatggtggtaaactagactcatttagtctcctttttcttccatgaattttaaatgatgttttgcaagaagttcttttggattgaaaacttcaagatcagtgctaagcagtacggataattatacagtaatttactaatgtataatcccatataataatgctagtttcttacctgtactccttcagatatacctccgtagtctcgaagggggtaatatggagaattaggagttccttggtgaggagagttaggttttcacaaagttaggttttctctgagagaaaacaagcactaagatttttctataggcttaacacatttcatttaactgataactttgatttcgaggttctgccaaattattctagttataatagagatactgtaaaggactgaaaaattctgaaccctaaaaaaaaacaaaaaaaaaacgaaaaacagaagtcaagctagaagataagaaaggacaggcttgttagtttgttagtcattgattatcacatctgatagggttatagatattcaaatatgtcccaaataccagattagtttgttagtcattgattatcatatctgatagggttatagatattcaaatatgtcccaaatatcagattgtcacatctgatagggttatagatactcaaatatgtcccaaaagaacagctttcttcccctatatctttgggtagattttgtctataaccaagcattatttcgtagcactggagctgatttaaatgacccttgatgcaggaaggctgctcttctttctgtagtgcaaaagtattctgatcataatttcttattaaagtgatcagagatcccctcagacccaaaagtatactttataagtacttgttggtatcctgctgtgcattgtgaaagaattctggaggtgtgccaaacactgctcaacaataagcactttccattagttgagtagtgttgaatcttgtttccttacccactctttggccttaacaaattaagtcattttatagcttaaaaacatatttttattaacttttaatactctttttcatgtgttcaacattcttactttaaaatcatattgcttttctcctttaagaaacttaccaaaagcaagggtataaagtaactgaatgcaatgagtgtacctattattaggaattataaaggagaaacagttaatctgacttaaacttgtaggaaaaccatcactctgaatagaaaacaaagataaataggtaccgtatgcctctgtgtcctgtattttaaaaagaccttttgctcaacatcattctaaattcatgagtttgaggacaagagtccagaatttaatatgatgaaagtaaacataaagctaaaacttgggaaggttccctttaggtgctgtgtttactaaaaaggagacttgtaaattggtatctaacttgtttggcaaatttcttttagctctgaagggtttatatgctttcaaagaacctattggagaaatatgcactataattctaaacaagggtaacttgcccaaagtctcacagctaggaagttggactgccagatttgagttctagctcttccactccaggaatggggactcttaatcacttcattatataatcaatccattgtatcttggatcattgtttggtttctttttattggttttgttttattgctagcattatgttcttcccccacccctaattttgtgtgtttatgttttcagctatactttgggtcaaatagacttgcaaaaacctagccactttttgcagtgtcatacacttggggaagtaaggtctgtgttctctgtgagaggtttttttttttttttttgacagggtcttgttccattcccccagctggagtgcagtggagtgatcttggctcactgcaacctctgcctcatgggctcaagcgatcctcccatgtcagcctcccgagtagttgagaccacaggcatgcaccatcacacccagctattcttttgtatttttagtatagatggggtcttgccatgttgcccaggctggtcttgaactcttgagctcaagtgatctgccccccttggcctcccaaagtgctaggattactggtgtgagccactgcccggtcaaggtctgcattctaaaagaatttacaaatgacctttttggaaaacaggattgagaggatatttgactttgagaacggttgattttgaggcatacctttttcttttatttagagaataaactctcagctctaaaattacacactctagaatatattcatctatggttttttaatgtcataaagccttttaaaaattgggtattgtaaaatcaaacacagcaataaggatggaaattgcttgctagatactttttaataaagtgtaaatatttcaactgtaaacttaccttttgggaaaagctctgttcctagcttgacatccatgtcaaaatttattgaagtgaaacccaacatggggtttgagggaatatccagaagactgatatgttcaagatttggaagagctaaaggactggcctctctgtaattagattaagctatgttttgggtccctattgcagtgtgttttcaccttgatataattaatcagtatttattgaaaatctaatatgcattcagcactacttggaatgataggagatagaggaaaagtaatacacatggtgtcccctaccatgacactcatgatagatgacattcatataaaagacacactgctaggggttgtgggatacatcagatcatctgatcaagggagcatactggagttcaaacgagtgacagaaatgttatctaaagggaatcttgaatctatccatatatatcattcattcacagacttggtactttttttattagtaacaaattacttactgtatactataatttaccatggcacaccagtttgttatgaagtgacagttgaaaactgctgtgttggagcttatgacagtaggagggacaggatttactgctataaaataactgaataattcaggataatgtaaaatatactgaaatgggatgtgcattattactgctccttgagggcttttatagtcagggaaagctttgtggagaaaatggctactgaaaaaacagatagcatatcagcccaggttcttaattgcaaggaagagaaatacaatctgattgattttaagcagaaaagaatttattaaaaagaactgggatataatgcataccctttggccccacagtttcattcctagatatacagccaacatacacgcatacatgtgtttactaatatgtgcaagaatgtttgcagcagtgtttgtaatagaatcacactggaaactaaatgcccattaaaggtagcatagataagtagtttttttgtttgtttgtttttgtttttttttgagacagagtttcattcttgttgcccaggctggtggagtgcattggcatgatcttggctcactgcaacctctgcctcccgggttcaaacgattctcctgtatcagcctcctgagtagctgagattacaggcatgtgccaccatgcccagctaatttttatattttcagtagaggtgggatttggccatggtggccaggctggtctcgaactcctgacctcaagtgatccaccctccttggcctcccaaagtgctgggattacaggcgtgaaccaccccacctggcctgtattcacctgatcatagaaggttatacagcagtgagcacagactgcaattatgcataacatgggtgaatctcacaaaacctaaaattgaggaaagaaagcagacacaaaagagagcatagtgaatgattttatttatatcaagttgaaaaatggataaaattaatctatagtgtcagaaatcaggataatggttacccttgggaagggaatagtaacccttgggaagggaaagggaaataaggagggctttggaagtgtagttgacccttgaacaacacaagtttgaactgtgtgtggatctacttatacatgagtttatttcacctctaccaccctgaagacagcaagaccaacccctcctcttcctcctcctcgttatgattttttttttttgagacggagtctctatctgttgcccaggctggagtgcagtggcgcgatctcagctcactgcaacctctacctcacaggttcaagcgattctcctgcctcagcctcccaagtagctaggattataggtgaccaccaccaagcccagcaaatttttagtggagatggggtttcaccatgttggccaggctggtctcgaactcctgacctcaagtgatccgtctgcctcagcctcccaaagtgctgggattataggtgtgagccaccatgcccagccctccttatgattttcttaacattttcttttctctagctttattttcaaaacacagtatgtaacacatatataacatacaaaatatgtgtgaatcgactgtttatgttgttggtaatgcttccagtcaacagtaggatattagtagttaagttttgggggagtcaaaaataatatgcagattttcaactgtgcagtgggtcaacacctgttaatgttctgtttcttgacacaggtggttttggtttgtgaaattatttgagctgtagacttaatgttacgtgcacttttcccttacatctgttatactgtgcctgtttctgtacatatgttacatatcaaatgtttattaaaggggtatattgggtaactcagaatttctggtgctcctggctatatataccaaatcccagttcaggattcaacaacccagatcatgctgctgaactgcactaccactgccaagtgtgaaattgaagcttgctctgctggccttgttgcctgggagcttgatcctgcttctgttactccacacctgtctccctccctgttccattcctggctccatttgcagccctcctttcaaagtgtggggtggatacctttgttaggcagagcctagcacaagtggtcctccttactgcaagggagtctgggaaagcaagtatccagtgttttcagcttttatagtgggtggtgatttctgccagaaattgtaacaaggggacaaggggtgtttcagatttggggcagccaaaaagcgagcaaaatccatctttgaggtgagcatttaggccaatagaagaaagtagatttcaagtgttaggaacaatagaagcccagggtagaggttgaatagagtatggcatttgagcccagtggaaacaagtttaactggattaaagggtgtgctctgggaaaatagtttgagaaaagttgaaggaataggatgggacaagattaaagattactttgaaagtcaggcagaggaatttaaatttcatatgggaatgttggagccagtaaaagtttttgaacaagaaagtgtcctaaaaggaaatggtacttaaggattattaatctggcagcacttctaggggtatctaggcattttctgtcataatttaggtgtggggtgatagattgggagtagaaataaaaggcaaagattgtatttaagagaagatttgaaggaaaaaaatcaataggacttcttgaagagaaagaagtagaggctatttctgaaactgagcttgagtgactgatcccactcttcatttagagctagcaaagctgaggagggacccagtttggaggaagcagaagaatgaattttagtttgggaattgctgagtttgaggtgagagatattgagtaaaagtggtccctgtgcagttagagttggggaccaagaagtggaaagaattgcactcaggcagaaaggctgtgaagggaatggaacagagtgtgccagaaccctcagggtgtttctcagctcttgtttacgggccaccaggtatactatcttgaatttaattttaagtgatacgtttgaaccacaacctctaccttttgtttcataaaacgtcagttctcacaccctaagacacattgatgcaagctatcgatgctattactattttacatggtcttcttcctgttattctaatatatttggaaagaaaatgattaatacatgtgaggcttttcttggtaattttcaatacttttgaatgttttgaatacaaggagaataatatactaaagctagagaccttaaacaagaccgagaaaagactgcatataaaaagcaaacctccagttcattaaaattgtaagttggagctcttggctccatggcagggagccttggatcagtaagtataacagctcccttccgtattgtacttagaaaagaatgatcataaaacctacttaggcctcacaaggtctttttgagccttagccaatgcatttagtcactgtcagtaaccacaagctttagtataatattctggcttgcaaagcagccaggtctccagagcatgacgataggctcttctatacaacttgaaagctgttgctgaggcataccttcttgatattcctcttagcacttttctctagtctatagcaagtctgtacctgtagatgacagtggattgctcagatattattaaagagtatgcaagtatcttaacaggaaacagcttaccctttgggtaatgtgtgatacagtgaagaaaatcccttaaatggttgcccaatatttatgctgctggcatgtttgctgggatattttttctcctctgaattagtattttgagtccttgggctcttcagtttaatagataatgtttctatgtttaagtgtagaagatccaccatgttagctgaaaagttccaaggcttttctgtctctgtaacatttctctgcctaaagaggtagcaggttgaaaatttaggaaataactttgcgtcaaaaaattcatcagcctttctaatcaattcgattttaaagtgaaacagtgatgaactttgcatttatcagaattcatgtttttctcatggatttaacagccctttgcaactctgcttccttggttacatgatagaaagagtatctgatcacatcagaataaaatcgtttgggaagacatccgtgtgtcatagattatgtagcttgcaacaggatttaaagcaaaaagatggtagaatatcggatctatcattatttttgcagtgaatgtttcaccagctggtttgagagaagttttacacccctaccaggcttcctcttacctcatttaccgcaaaaaccacaagtcctaacaggcaaactgtaattgcctaaaacaaaactagtaaggtataaatgcatgtggaaatgattatttgaaggcaaaaggcaaataaatgtcaccagtctgagccatgacctaagcatcctaggtctagtaaccattcttttggtaagggataatgccaacttttttatcaataggattctgttaaaaatacaaagaaaaacagtcagcaggatactgtatctatacacatacatatatgtatatacacatatatgtatatatatgtatgtgtatatatagatataaaatacttttgtttcattttagagctggttgaacttcagtggtgggtagagcttgtttttaatttatataatttttgtagtacaattttaaaatattatttttttaaatgaatccaggagctgtgcggtcttatgcattggaacttaatttgacagattcagaaaatgccacttgcctttatgcaaaatggcagatgaatttcacagtacgctatgaaactacaaataaaacttatgtaagtatatattttaatttttctttgagttttatagtaggaatttaattgactttatcctttagatacacgtatacaaatgaaattccacgttgactgacttaatgctgaaactctgggattttttttaagcatacacactcagaagttattctgtttagtgttagaatgaatatttcttctgattcattggttcttgggagtttttgtaggacttgattaagggcaaatgatctgaagacgactatatggtgttcaggtctaagtatttctgtaaagtgtttaaaatgtactagcaccaaagcttgcccttttaaaaagcagcttcccatctgggcatggtggctcatgcctgtgatcccagcattttggaaggccaaagcaggaggattgcttgaacccagcccgggcaacatggtgagacctcatctctacaaaaaaactttaaaaattagccaggcatggtggcacacacatgtacctccagccactcgctgggccgaggctggaggattgcttgagctcaggaggttgagtctgcagtgagccatgattgtgctactgcactccagcctgggcaacagagcgagactctatctcaaaaaaaaaaaaaatcgcttacttaggttggtacaaaagtaattgccattaaaggaacaaaccacaattacttttgcaccaacctaagtaagcgattttttttttttggcacaaactgcaattacttttgcaccaacctaacactaaaatctccccctttttgacatctcctcttaattcctttgccttcttattttctttttgttaaggtcctcactacttacaacctaattttttaaaaaatcagtttaagaacagcagctcaagccagttttccttttctttttagacatacacgaatttatccagaggagtggtatgtagcagaagaatcagggactggtttacacagcaaaccaggcaaagggcaacctggccatggagaatgtatgatttaggctgaagtggcatgccctacataaatgcttggtgttccttgctgcctgtttgtttctcacccccaaatttctatttcttttagaaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggtaaccttaagaatggatttgtgttatgttctcttgctttttattaatgataaaaatgtaaacaattttaaaattgttatgaatgtctgtcttcctaactagcatggaaacttcatgtctttataaccctcccactgaccccatgcatggcacatatgacaccatccaacatactgatgatatttgctgtcattgcttgagtgacttactgtataccaggtattatcctagtatacagtaagtcaccttactatatatatcctagtatacatatatatgtgtatatatatacatatatatgtatatcctagtatatatgtatatatatatatacacatatatcctagtatatatatacacacatatcctagtatatatgtatatatatatcctagtgtgtgtgtatatatatatatatatatcctagtgtgtgtgtgtgtgtatatatatatatatatctcctagtatacagtaacacacctagtgtgttacctgcagcatctcacttaattcttaacagcaaccctgggaagtagatgttgtttcatttttacaggtaaaggaaatgaggcttgataagattaaatgacttttccaaacatcacacagtctggtaagtgggcgagctggtgtttgaagcagtctattgacctgcagaattcatatacttaactattattgatttcattcagtagtgtgcatgaaacaaaggtttgatgaatgagaaaatgctttactaatagctactttattttcaagatcgggggttggggggggtgtctcactatgttgcctaggctggttttgaactcctggattcaagcgatcctcatgcctcacagcctcctgaatagctgggactacaggcatgcaccactgtgcctggctactaatagctattttaaatgtgtaaaagttaagtaacctgagactaggagaaatgcctcttgttcaaatctttttatcatttaggttggattttgattgaaaagtaaatgatgattagttaaaggtgtagtagtccctcattacactcagggggtatcattctaagatctccagtagatgcctaaaactgcagttactactaaaccctatacaggaaatgctatgttttttttttttttttgatctgataactgacatggctactaagtgactaacggatggatagtgtagacaacgttgatatactggacaaagggatgattcatgttcctggttgtgcagagcgggacagcaagagatttaatcatgctactcagaatggcgtacattttaaaacctatgaattgattacttttggaattctccattgaatattttcagagctcaattgaccatgggtaactgaaaccagggaaagcaaaaaccgtggataaggggagactaaagtcaacatttgctgttattttaagacaatttcaggtcaaaatgaacttgggaagcattggcaattaggccattctagtaattcccagaactgaaatgcgtgttaaaatattttgaagatatagagtgtagagattttattttattttattattttgagctggagtctcgctctgtcgcccaggctggagtgcagtggcctgatctcggcttactgcaacctccgcctcccaggttcaagcaattctcctgcctcagcctcctgagtaactgagattacaggtgcgtgccaccacgcccggctaatctttgtatttttagtagagacagggtttctccatgttggccaggatggtctcgaaatcctgacctcacgatccacccacctcagcctcccaaagtgctgggattacaggcgtgagccaccgcacgtggtcgagattttaattttgttagggatataattctcttctttctccccctgcccgttgagattgagttaatgtggtatttgtagtagcttagctctttgcagatagtgtttcattctgaccccagaaacaggtagatgggctttagttgcctagacctggggattaataactcatttggacttaaggatgtcaaaagatcctattcgaaagaaccagaagtaaataagctcacgtaaaatttgggaggtattgcagaatgagacttggaaatcaaatcctagtgttctttttactaatctcttagtttgagagtataactaaagcaaatggttattggctatcttatcagtttatctttgtgccctgttttgcctttcagagctagtataagatatgcccctcactttcaagtagcctaagaatgagctggggagacaaagctaaatgctattcccgagttacatggaaaaattggaaaacattgagctcagtctgattttgttgttgttgtttgcgtttttgtttgagggagtagagggttcataaatctcttctgacagtgtgaggaaaactttagactccctctcaaaaaagaaaaagtacacagtaaactttgcatatggaacatagtccctgaacccatatgtagatccctgtggttaagagtgcctgatttaggtcgagaatggtagctcatgcctgtaatcccagcactttgggtggccgaggcaggctgatcacttgagccagggagttcaagactagcctgggcaacatattaagactttgtctctacaaaaaaaaaaaaaaaaaaaaagccaggtgtggtggcgtgtgcctgtggtcccagctacctgggtggctagggtggaggatcgcttgagcccaggaggttgaggctccagtgagctgtgatcccaccactacactcagcctgggtgacagagagagaccctgtctcaaaaaaaaaagaaaagaaaaagaaaagactggctgatttaaaagtgttcccgtgttcccacaagtggtcctgattaggaggagtgataaaggaaggctcagtgtgtgttagagtagtgagaaagcttggtagagaagtaggacctgagctgaaactcagctaatggtagaatttgagtaagcggaggattttgagcaggatgtttccagcagggggaagcatagcatatgcggcagtaattggagagctgcctgattaaatcaggctgtgtgtgtagcagaaggaaaataaagttggctaaatgaagtgggcctaaattatagggggccttggaagccaaggaaagacatttagcttgatggggcaggcactggggaatcattttaggtttttaaagcaggagaatgatataacaaaagcagagacagtagcttataaagaatattctgcaggattagttgagaagtgaggaggctacaagcagagatgctggcttaagaagctgttatagtaatcaagggctgatgtaataaatgcctggactacaggggcatcagttgttagcagttattaggaggaggtgtttaatctgacatatttggatagaaaaactatggaccctgaaatgttaacacttctctctttccccttttatttaaaacaaagggaggattactttttaaattactaccttctatataataatatttgaaactatttggaatgttaaatggcttcctgaaatggactattaataattgtttttgatatagttcagtgtttcaagaatactaatttatggctgggcgcagtggctcacacctgtaatcccagcactttgggaggctgaggctggtggatcattggaggtcaggagattgagaccagcctggccaacatggtgaaaccctgtctctactaaaaatacaaaaattagccgggtggtagtggtgcgtgcctgtaatcccagctactcaggaggctaaagcaggagaatcgctttaacctgggaggcggaggttgcggtgagccaagattacgccactgcactctagcctgggcaacagagggagacccttccttacccacccccaacaacaacaaaaaaaactaatttaggccaggtgcagtgactcaacgcctgtaatcccaacactttggaaggccaggcagatcgcttgagctcaggagtgtgagactagcctgggcaacatagcgacattctgtctcaaaaaataaaaataaaaaactactaatttatttttaggcatctgataactgaagtaacattgaagctgcttttttcttttttaaatttttttcgtgattaaaatatagaaatgtactggccaggtgtggtggctcgtgcctgtaatcccagcattttgggaggccaaggcaggcagatcacctgaggtcagaagttcgagaccaacatggtgaaaccccatctctactaaaaatacgaaaattagctgggcgtggtggcgtgcacctgtaattccagctacttgggaggttgaggcatgagaatcgtttgaacctaggaggtggaggttgcagtgagctcatatcatgccactgcactccaacctgggcaacagagcaagactccatctcaaaaaaaaattatatatatataagttacgtatataataagggttttttaaaaggctctacatatacatatatatatataaagattatatatctataaagattatatatgtatacagagaataatatagcagacccatatgtacccattatccagaattaataaatgctgtttttttaatgtttgtgttacttttttgattaaaaagataaaacgttgacaatacagttgatatttcctttgtcttcattccccagacccattttccttcttgcctgctaagaggcaaacactttcacaaatttggggtataaccttcctgtctttatgtttgtcttttactatataagtacgtgttcataaacaatacatagtttaaaaaaagctattcatagtataactccaatatgcctgcaagttgtttttttgctgatttgcttttgaagtccatctatatacagccagtcacgtatctattcatttttgttaacggtgagaagcaattctgggaaaaatgttctagttcattggttttttgttttgttttgttttttaattcctatggccattagggggtgccaaggcagcattatatggctgcttgctacatgatggagaggcacagaaggcagcctatattaaggaccttggatactttcctttcttgctacttctccaaaagaagccaaaccacttgggtgatcatcgtcttttgaagtttcactatacacaggctaataaaaactatatgaaatggctgtaacttactgctttcatactctgaagattccctgaaatggaatcatctttaaatgtaatccaggaagcggttctataagctcattggagttaatataacttacttgggactagtaaaacaaaaataaggatttactatacaaatgtatgattaatccatctctcttgcttctttagttatagtcactaagtcctgatgattctaccatagataagtgttttcagtttggcttctttgctctctttctactgccccacaccatcttagtttaggcaaccctcccttacccttcaccttaaccagaccatcaccctctggtttccctcttaagtggcttccctgaaaagtttttccccctgcttatcccctacaaatttgctatcttccttaaaataaattatatatgtgttattttctgctttaaaaactgaggctagccctcgactgctaaaaagaaaagcccaaacaggccttagatcatagaagatgcttcaaagtatgatcacctgcaacttgtctttccttcttaacccccatttcttttccttttttctttctttttctttttttcttgagacagagttttgctcttgtcatccaggctgtagtgcagtgggcgatcttggctcactgcaacctccgcctcccgggttcaagcaattctcctgccttagcctcccaagtaactgggattacaggcacctgccaccatgcccagctaattattatctttttagtagagacgaggtttcaccatgttggtcaggctggtctcaaactcctgacctcaggtgatccacccacctcggcctcccaaagtgctgggattacaggcatgggccactgtgcccagcccctaacccccatttcttcttcccccttactccttatgttttagccacagtgaactagtcatgcccttaagcatgctatatcctttgtcactttgtgcctggggtagggcaggcagagagaagaagaaagcctatacaaatatatttatattatcacttttctcctaccttcttggaaatagccattgttaatcttgttttataggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatggtgagtaaagtatatatttctctacttggatcctaatttaagagtagagtataccaggtagctttcattgaagtcattatctgaaagcatttatatattaaggtttattcatagcttctactaggctataaagtttttgtaaataatagcaattcttatttttgtgtatcttacaatttaaagtttttgatgtacatgttgtggaatggtattttaaaagacactacctatactgttctcagctgataaaacctaatcattgtttgaacagatcctcagatagcttgattatcagcttttttagcggttccaagaccaaagcttagaaatcagattcatattctaatcttgaatttttaaagttgattttataatttttatatagctttatggaaaggtaataatttctcattcaccagttctggaaaactatgaacacttcccaagaagaggttgaaatgcctatgatttgccatagggctaatgcaaataaatggttcatttgtatttaagtcctttgatgatttctaagcttttttctagtaaacagtatccttccttatggtgattgtatgtgggaataaagaaccaaaaaatttaagacttaactctctgaatttcgtatcagaggcaggcaaagttctttgggaataaaaagatttaagggtctgaaaaagacgagtatgtggccatgtgggagcagataaagcatagggatgtgtcctgagtttgctgtgtcataactcatgtagatattctgtatatgaagcagcagtttaagaacctctgcctaatttagtttcaaatatactaacaagatattctcttcccctaatataacccttttggacttctattatgagaattttttttggttttccctggccttatgaattaagaaaatgtccgctttggtttcttttgtcccttttcgcttgttttagagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggtataggtgtctatctttatcaatacatcctttttgcatttcatttcaaatattgcgtatcctaccttcagcccaaaggtagtgttactagaatgattccgttttctttttgtttgtttgtttgtttttttgagatggagtcacgctctgtcccccaggctggagtgcagtggtgcgatctcagctcactgcaaactccgcctcccgggttcacgccattctcctgcctcagcctcccgagttgctgggactacaggcgcctgccaccatgcccggctaattttttgtatttttttagtagagatagggttttaccgtgttagccaggacggtctcgatctcctgaccttgtgctccgcccgtctcggcctcccaaagtgctgggattacaggcgtgagccaccacacccaggtttttctttcttttttttctgagatggagtgtcacactgtcgcccaggctggagtgcagtggcatgatcttggctcactgcaacctccgcctccagggtttaagtgattcttctgcctcagcctcccgagtagctggggttacaggcgtgcactgccatgcacaactaatttttttgtatttttagtagaaatgggtttttaccatcttggccaggctggtcttgaactcctgacctcaagtgatccacccgcctcagcctctcaaagtgctggaattacaggcgtgagccaccgcgcccagcctgattcagttttaaatggagatttcatgttggcttgttgagctttgattagttaggagttactataaccatgatgtgttaatgtcactttcaggtgttgtgttggccggcagaaaacctagcagtttaaagtactcttgggggtttagattctatttgccatcagtggatcagagtacaaacaattggcctttatttcagtcagtttaaaatataactccttcacactttgatctgaaatgcactgtaggttggcgtacaggagtggcacagctatccgtttctccagctatttgattactcggatcgtgtagacatgcccgagtacatgatggcacttctagttgcaatgttccactcaggctgtagagggattgccaagaaacaaatccgatttccaggatcttgtgacttaaacaagcgaggcagatggctcttgtgctccataaaaatgtgtgttttcatttggctcattactgtagaagcttccctcttgtttttttttttaagttgtctgagtcatagcttgaggacccatgccaactttgtttgaaagtgaagacaccatgaattttaagtatccagacaaaagattttttgttctacgctgaagttgattttgtttggtagagtgtaaggctttgctggccacttttatagctaacctgtaccttttccctttcttcttctcctgaaggttgcttcagttattaacatcaaccccaatacaactcactccacaggcagctgccgttctcacactgctctacttagactcaatagcagcaccattaagtatctagactttgtctttgctgtggtgagtaacagattttttaaagttaggttcattctcttagaaacacatctgaaagtctaaatagttgcatggggggaggggggtatttagctttattttccagttctacagtactcaattataaagtgtagtccattcatccctgttcatccctcagagtctgtgcaatggtctgtggactggactcttgcattaatgttcaccaagagtggccattttaccattagagagactctagggtagaagcaagaattaactcacatcaaaaaaaagaaaaaaacgaaacccacaattgtctaatctatccatacataagtaatttccatgataattttttctctgttattggttaggtagtgctcatgtttttctgtgatactatttgaagccatttggaggctatattatttgtgatagtgtcagtaataaaaataggtaacatctattgagtacttactatgtacaaagctctgtgttaagtgtgtatatgaattcattaaatcaggacaatttataatggcagcattcaggtttttgttgttgatcaagagctgaaacctaaacagaaggttttgggttaagcatacctgttctacttcttgctagcataaattaatcatcggggatctttatttccaccttctcagaagcaactattattcccataatttctgtgaagggatgtatgtgtgaacatgttgtggcaaatgagactggtggaatagaagatagctgtaagtgagggaaaatgttgaaccaccaactattctcaaactaaaaatattgtataattagataaaaaccagttctgtttttaaatcagattactgtgtttggggatggggaaataatctcaacatctgatatataaaaagtaggtatgttgttatttcatatgtgatcttggtattttgagtctaaagcacatttttctctttagaatatatgccgagtaattgaggattacattaggcacttgtattttggaaaggtttacaaaaatgttcctttttccagcattcaaataattcctctgttaaagtaccatgtgaccagtgaattactattgaaaatgtctaattgaatttgtcctctccagtatggtaaaagcaagcctcaggcacattctcttttaaagttacctaataggggttatggtcaataagaacaaggaaagtagtattttgggtttattccctttcaagtgattgagtttgatctttctagctgtggtagactcctaaaaggaacatgatttctcttgactcttatacggcaatgtttagtatttaagaattacaatatttaatttacccagcaggctatcttaaaacgtaatccaaaatagtgacattttaatcatgctacaggcactctgaaaaatcaagagacacctgcaatgtccccagagttcagtggggcccatttttgccttcaaccctgtcatgatagatgctccttaggagaatttatagaattcgagtgcgttatgtgcaggctgctatggtgggttatggagaagaaagccagtattcttaaagtgcccacagtttagtggtaatgggagaaatctgcaaataattaccatttttgtgaaaggcctacatgccatgccaaggcttttgaactcgattctgtaggcagtagagtactgtggaaggtgtatatgaaatgggatgagtgccagaccagagaatagtacaaagtgctgcaggagaatggaggagggagaggttaattccggctggaggagagtcaggaaggtttaatggcagagatggcatttgagctgggccttcaaggatgggtctgatttgtattggtagggagataaggagagtaagtgggaaagtgcaggttatccctggataaagggcataatcaagaccagctgggagaatgaggagtgttatatgtttagtgaaaatgtggaaaagtcattgggacaaattgtggagtcttgaatgcaaagccaagatgtagcctaagtcgaggagggatgtgatgaaggtgtgaagtcctccattatgcttcttcctgaaatttctctgaagtctgtctcctagcttttactccccattgcctttgctctgggtccagtccacattacctcttgcctggaccattcaaacagctcctgcctgattgctcctcttcctcaccttctccattgttctacatcaacttaaccttcctaaagcacatctctccatcagtgtttctctctttcttttctttctttctttcttttcttttttcttttcttttctttccttccttccttccttccttctttcttcttttccttcttttcttttctttctttgacagagtctcgctttgtcgcccaggctggagtgcagtagcgagacctcagctcactacaacctccgcctcccagattcaagcgattctcctgcctcagctgcccaaatagctggaactacaggcatgtgccaccacgcctggctaattttttgtatttttaatagagacgggatttcaccgtgttagccaggatggtctcgatctcctgacctcatggtctgcctgcctcacaatgtttctcttttgccaacaaggtaacatctaaagtccatggctgggtagttcaagccttcttttctcccatgcaatgcagcctgcattttcagccttcactccctctttatgaaccttatgtttcctttagttccttcagggtgcttccctcatcctgtcctctgtgcacttcttgtgaggtaggagaacatagtaataataattacatagactccgcagccatactcccaaaatggggatgataacagcacctattgcataggagtgttgtacttactcagcgaagcatcatatgtaaagttttaagaacagtgctgggcacttagtaagtgctcaaatgctagcataaaaatttgagattatgcttattttctaactaccgttatttatactcttgctctctcaaataccccttttcccacttgtttcctaagagaatcctgcccggttcaaaatgccccatccctaagctggcattactttttctcctcccttatttggaagtgatttctctcctattttcatgacttctcactttcttttttgtaatatggttgtttatgtgtttatcttaccttccctggcagattgcaaacagggtgaaggcaggattgaagtgtggttcattttggtagctcctggagtacttgcactctgaaattattagaatgactggctgatcagatgagtacttcagaaagataatagcagtgaaaaggaaagattaggactggaggggctgaaaggcagggagcccacttaagaggctgctgtgatccaggctagaggtggtgagggctcagcaagtgacaggaggaataaaattgaggccataaatcttcaagtgtctgagatccacatgactacacctgtgctccaaaagttggaaacaaaatacagaggaaagggatttctgtcagattatgagttctcttttacttagttgcagtttattctaccgcatgatttcttcttctgtgtaatagtgttagattgcttttcttctgtgggtattaaccgtatctgttatctgtagacagttgtgaaatgttaattaactggaagctctttttcaaacagaaaaatgaaaaccgattttatctgaaggaagtgaacatcagcatgtatttggttaatggctccggtaagcaaagcactggcctggggaaaaagactgtggattaccctgaaggattagaaattacaatggtcttattaccaaatagtgccttatttaatgaaacagaagatgctatgtaaaaagtgtaccttgatcataccttaaaatcagtaacttagaactatgatgttctgtctttttctgtatcccattttttcaaagtagagtagataataattaaggatatgactgatttttagactatagaaacatctatagaaagataagggaacctagttatggtaagaattgctttttgtgggttgatcttgtcccccaggccttcactgaaaaaccctgaggactgttcctttttttttttttttttttttttgagacagggtctcgctctatgcccaggccagattgcaggggtgtgaccacagctcaatcccaggttcaagccaactacccacctcagcctcctaggtagctgggactacaggtgtgcaccatcatgcccagctaatttttttttgtattttttgtagagacagggtttcaccatgttgcccaggctggtcttgatctcctgggctcacgtgatctgcccaccttggcttcccaaagtgctggaattacaggcgtgagccactgtgcctggccaactttcccatttttgatgttgataggataagaagttactaacctgtttcttttctttgaagttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacaggtaagaatcaagcaaacttcattaataatttatgttcttatgttgacaggtggcttttcctttgaatcatagacatttaaacgttgaaatagaggaatatgaattcatagccttgaccaaattgtgcaactctatatttggctcatcattttgctcaaccgagatgtttttgtgatcttaaaatcatttgcaaaaaaagttcttaaagctaaaactgatagaagctttaagtgagctttatttgaggtatgggttttagtttgtagggaagatggcacttgggagcagcagctttgagcatcttgcatctgcttcctgaggccgtcttctcactggaaacattttcatacctgaatgaaagcagtttggtctgattttgttaagacaaaagataaagagcggtagcaaagcctcaaatatcatgaactatgtttttaccagccaaaacgatctggagagttttcaaagcatgtgccagtgtgaatgacgctttttgaagatcactcagggataatggtggtatttattagatttttaatgaaacccttttgaagggctcattataatgtgttcatacgaatatgaaagacatatttggcattacaagattaaaatttgcatgaagaaaaaaagcacataaaattccttaattgacttgtccttttaagcctattacctaaaattgggggtttgtggatcacaactctgttgagcagagctagctattccaggcatccacatccttttcaaccattaattctatggtttggaaggaaatgtggaagctgtgtttaaaagcgaatatactgtgagccattcgactacttttgcagtggtgttgaatacctagtctgacttggttaggccacaataaattgggctctccaccctaccattcttgcgattaaagacgttagttacactttaaaaatattttcaagaattcattttcccttttgtctgttttgcttatgtacttcaattattttgatcctttagtagctttatttttggactttttatctggctccccttcattattcccctaattttaagtccagatttgtgtttacagtttaaaatcgtttgcagtattagtatcatcacttcaagactgtttatctagtcacctgtaatagagatgagctgtgctctttctcttactttgaaactttggtttttatgtacatagaattaaaaatatcacccaaagagatatacagcatttaatactgatattgaatgtataatctatttgtggaactaggttcttggctgtgggtacctataaatacaacacataggtaatatttgactgtatggggaaagaaatagaattgcaataaggcagaagagtgttgattggattttactggatcagaccactttctagaagtagaaaaaaatagcccccttaggctgccaaccctgaccagataagaaatgcagtaagcacgctcaaattagtaagaggtcccagttttcttgactttgcagccactaaaattgtatgtactaagtcacgatctgcaaactttaaagttccaaacagtgagtgttttaggctttggtgccatatggtctctgtcacaactatttgaccctgctattgtagcacgaaaacagcaacacataaacagatgactgtggctgggttccaataaaaccttatttatggacactggaatttgaattttatatgctctcatgtgtcacaaaatatttttttcaaccatttaaaaatgtaaaggccatttttagctcttggaccagatctggcccatgggctacagcttgctgacccctgaccctaaagacagagccagcctggctattctcatcacatgataccttcctgatcctgtttccactttcccaaaagacattcactctaccactgagaggctaatctggctatgtaaaagtgggctagattagctccctttatttctgataaagtaatatgcctattttggaaaggacttggaatataaacaaacatatatgtgtgtatgtatatgtatatgcacacatatatatcacatataaaatatatatcatatatataatgtgtgcattatatatcatatataatgtgcatatattatatatatgcacacatatacaatgtgcatataatatatgcacattacaatatgagctgtgtttatagatgtaaatgaatatacatgtattcatatatatgaatatctgcatatatacacataaacaaatgaaaggacaaagaaagtcttagaattttaattctagaacagttctccattttctatagctttatcataaaaatatacctgtcttagttacttgaagttgatcttgtaagaacatttctgacttttaaatcaacatctttgacttcgagacattcttttgtgattatactcattatttattacacactttttctcacctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatctttttttaaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcattatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaatttgcttaccttttttcccgttggttaaagtcaagattttgtatactacataatggcaatttctttcaaatggaaaaactttagaaatgtttagaagtagaactgaattatttgcaaaatgttctgatgttctgtctgtatattaccatctggaagaatagtcccatacataggcctcgattgatgctaggcaggctacagaataagattaacctgggaagcgttttataaaaatagattccaggctgcatccttagaggatttaacgtagtaggtctaatgaggagacagagagagagagagacagagagagagagagagagagagagagagtgtgtgtgtgtgtgtgtgtgtgtgtgtgtgtgtgtgtgtaagctcccctgctgaacctgatgcatagtcagttagggaaccagtgatctagaatatttatttcataataaaagctgcggagtatctctttgtacacttttctcaattcctaagttgaggttgatattcaatatctctacatagtagctttacattgcagccatacatattgagctattgatctgaaccaacgtaggattgtgtgcagtctctctcttacttagatcaccctaaaatacttgagccttccagtttccatatacggatagttacctagtcaccttactatatcacataagaaaacttagcaatgtagctggtaacttttctctgaattacccagttaagccatgtgaatgccagttagtcatcacggctgcaaactctgcagttaactaccattgtctttggccaagttgtttaacttctagtgtctcaatttcttcatccagtgggtggggtctttaaaatcctgctactcatttctttgagtgataatttgcatttcagaggaatgcatcatagtatttcatacatcttagtattttagaaggaatctgataagctacttgttacgtatcaagaacatactataagttcagtgtaaaatgtaccacttaagtttcctgcagtttttcaggaggaattcttataagacttggacatttttaagatgatagtatttcatctgtttatttaggtagataatgttaaattgtcttgggctcatcttccacccatctccttttcttttaccctggtagctaactttctgcgttaataatcaccatttcttgtatttgaaactggtatagatattcatgaatgatattgagtagcttcacgaatcttttcagatgcatgtgatttacttaacacagtttgattatagatataaaatgtatataacaaaatatcacctaagaatgtgcttcttaatgtggatccttccaaaaagaagttttgactcgtttgtttgtttgttttgttttgtttgagatggagtctcgctctgttgcccaggcttgggtgtgtatagtggtgcgatctcagctcactgcaacctccgcctcccaggttcaagcaattcttatgcctcagcctcccaagtagctgggattacagacgagtgccaccacacctggctacctttttatttttttagtagagatggggttttgccatgttggccaggctggtctcgaattcctgacctcaagtgatctgcctacctcgacctcctgaactgctgttattataggcatgaaacgctgtgcctggcctcaactggtttttaagagaagttttattagtttttgttgtaaatgtatacctcagctttccagttcttgtgttgaaaattgtgtttgaaaaatgtctgaactggcagaaaattgaagattaacagcatttttaatctacatgaaacttcttactgaaattttagtggccatggaactttttaatctttaaaaatctttattgcttctgtggctattaaattcttctgcaaatacacttctcttttccccagaagcattttcaatacagcgttaagtatacattaggcaagtagatcagatcaaaatgacttataggatgagattttctt

SEQ ID NO: 16391 - DNA, 36791 bp, Human; identical to SEQ ID NO: 16390

SEQ ID NO: 16392 - DNA, 98708 bp, Human
  misc_feature (1)...(98708): n = A,T,C or G
agaggcttctggaaacatgggcagaaacagaaagaccagttaggaggctttgcaatgatccaggcgagagaggacagggtcctgagtgaaggtgataccagcagaggagcaaaggggtgttggaggatattgctggattctggttatcttttgaaggtagagtcaacgggatttgttgatagactagataacattggaaaggtaggttgttgctgaattgggaattgagacaatttctgaacataccacttccctcttaaaaatttcgtgttaaagtccagactcattagcagtcatttattcatttgcttattcattcaacacatactgattgaatgcctagtatggaccaggcattgtgctaggtgttgcaggtagacacaaaatttaaaagtagggcatactggccgggcgcggtggctcacgcctgtaatcccagcactttgggagtccgaggcgggcggatcacgaggtcaggagatcgagaccatcctgcctaacactgtgaaaccccgtctctactaaaaatacaaaaaaattagctgggcgtggtggcgggcgcctgtagtcccagctactcgggaggctgaggcagaagaatggagtgaacccgggaggcggagctttcagtgagctgagctcgcgccactgcactccagcctggatgacagagactctgactccaaaaaaaaaaaaagaaaaaaaatagtggcattaaccaggaatgagttggctcaaacaacaagcacagaggtagggcagccccagagatgaatgactcagtgacccagtgttatcaacgggtcctttttgtttttctgctctactgtccacagatgcagtctcattttaaggatggttcttgtggtcacgaaacggctgccaaaatacccaggaccatatgctcccttggagaagctggcttcttttcagaatcccccaggaaacctcttttctgttccattagcccaaattggcttagatgtgccatttctgaaccatcactggcaaagaatttgggattctcttattggtttagaccagtcagcacaggtacatgcactccaccagtaggtgctaataaatgttcaagaactggttctctgcnnnnnnnnnnnnnnnnnnnnaaaatttaaaagtagggcatactggccgggcgcggtggctcacgcctgtaatcccagcactttgggagtccgaggcgggcggatcacgaggtcaggagatcgagaccatcctgcctaacactgtgaaaccccgtctctactaaaaatacaaaaaaattagctgggcgtggtggcgggcgcctgtagtcccagctactcgggaggctgaggcagaagaatggagtgaacccgggaggcggagctttcagtgagctgagctcgcgccactgcactccagccagggtgacagagggagactctctctctctcaaaaaaaaaaaaaaaaaaaagggcatactttctgcccttacagatcttcagtcagatgggtgacacagacaagtacttaggttattacaacccatgtgacaattgctaccatggggaaatacagggggaaataggggcatataggaaaggtatctaattggaattggcaaggctccactcgtaccttaccccgaggtcagctcagttttgaagttcactctagcagtgctgaccattgcggggctgtgagacagtacagtctgagctcggtcatcagcgggtggccagctttgtctctgccgctccgcggcccgggcttactcgaaggtccccggggaatagcctcacctttgccccacttcccagtctagcccctaacttcccgccgtctattggctgcgcagccgcccaatgggcaggcggaaaccgcgggctcgtgctcccggcctagggcgtcttatctcgttcgcgcgtctcgcgagcattaggtgactggctgaggcggcgccagttggccgggcacggggctgctgtaaggccgaggttgcggcggaagcggagaccatgttccgagcggcggctccggggcagctccggcgggcggtgagtccggactgggaaggcgaacccagggacggccccccgtcaacccgccgtccctatggggtcttgcaaagatcactggccccctcagattcgaccagccctcgcgcccgcaggccggtccccgcctgggacttgggtccaaagttctggggcctaccctggactccctgcggaacgccagttcggggcagaagtcagaggtttggggtcagggtgaccccgaatgatgtgaatttgcgcgtctgctgccccttcttctggcccactctctgccctgccgtttcccacctttgtcggtcactctgggcactttcgggccgccaggtcctccacacttgctccacacccgagggagcaaaatgtcaccggggaatgccctgttggggaaagtttcaaacctagattcctcccggaggccggcatttctggaagaattaaacactttgggcgcatcgtggctactccgacccactcactgtcaagggcgggggtggggtggggtgggaggctgcgtggccagttatggaagctggttctgctttctggtttatggagcagggctgaatttaggtgattgtatttgtaaaacctgcgatccgatttgacagctttagccagttttgaaaggcagacgtctttttatatgcttcaggctgacctgcttttaaccagcagattgtagattaggttaactggtgacagtggtacattttcagtgtttcattagtgacaaaccacatttctctcttctgttgtgagaaggactgataggaaacatattttccttctcatgctgtgggaaaggagtatttggagactgaccagtcacaagtcaagtaacaataatttatattgtggattgtgtagttttcctagtttacatttaggtgaaatgagaaacaagattggtaaacttgggtcagaaacttacctgatggtttgtaccttttctcctttttttttttttttttttttttctgtgcatggatattttcccatccactcctgggatttttctctctgaggcatagctggagctctttctagatgtctgtagacattagacttttgtttgtttgtttgtttgtttgtttaagagacaaggtctggctctgtttcccatgctggagtggagtgcagtggcacgatatgggctcactgcaaccgtcgcctcccaggttcaagcgattctcccacctcagcttcccgagaagctgggatcacaggtgcgcatcatcacgcctggctaattttttttttttttttttttttttttttgtagagacggggtttccccatgttacccaggctggtctcgaactcttgtcctcaagtgatccacctgcctcggcctcccaaagtcctggaattacaggcctgagctaccgcacctggccttagacatcttttttcttgtgcgtattccttgtttaataaaaagttctgaccctcccctcccctaaagagttcaaacccatgtctttcaggttagtgtcctgtcttcccctcaggacatgttttctcccggttggggatctagacataaacaagtgaaaatcatgaatttggggaaattccaggaacctgagccagaagaatgctgctctatgcagcagttggaaaacagttttgtggacagattacaagtctggcctaagtgaaattataattgtggtgggggatggaatttaggactcagtaattttgtagagctaacagaaaaaaatggaatgattaagtaatttttactatccacatcgttggctaatgtgtatagacattacttccagatattcattgtggtttgccaaagactttgaccttgacttatttttaaaatttgaagtcaagctaagtagaatagctgttttttttgtttgtttgtttgtttgttttgagacggagtctcgctctgtcgcccaggctggagtgcagtggcgcgatctcagctcactgcaagctccgcctcccgggttcacgccattctcctgcctcagcctcctgagtagctgggactacaggtacccgccaccacgccccgctaatttttttgtatttttagtagagacgggggtttcactgtgttagccggtatggtctcgatctcctgacctcatgatccgcccgccttggcctcccaaagtgctgggattacaggcgtgagccaccgcgcccagcctagaatagctgttttaaagtcattaagaatgttggagagatttggatttctagcataaaagaaatggtggcaacacttctaaagtggacccatatattaatagggacatatacctgtatttaactttttaaattttgaaatagttgcacttatagaaaagttgcaagaatagtacaaagaaatctcaaaacccttcccctggttttcccagcatgttagcagtttgacacatttgctttatctttccacatatatacataatactatctttctgaaccatttgaaagtatgttgcaaatgtgccctttactcctaaataattgagtgatattttaaaagaacaaagaggttcactttctaactacactgtaattggcaatatctggaagtttcaccataaaatactgttttctaatctatggatgttcaattttgccagttgtcccattagtacagtttatagcaattttccttattctggtctaagatactctagatgtcctgcaagtggttttcatgtctctttactctgttagaaaggttcctcagccttcctttgggtttgatgacattggtgtatttgaagagtacaggccttctattttccagactgtcactcaatttgggtttgtctggtgtttcctcatgattagattcaggtcatgtattcttggtgggaatatcacaaaagtggtattgtgttccccgtgcatcatattagcaggtacttaatgttggtttatcccattagtggtaatgctgactttagttacttagccaaagtgttgtttgccaggtttctccactgtcaagttaatactcctccttttgtaatttttaactaatttgtgaggcgattcattgagactatgtgactgtcctatttctcatcagacttttacccagtcttagcatctgttgatgatttttgcctgagaaatgattactatgatgcaaaatggtgattttctatttccatgataccttcgtacattttttagttattctactataaggaagaacattatcttcttgcatatttatggatttatggatacatggatccttatttaggataatacatttctaccttatgctgaagttgtctcatgtttgtaaagtggggcccattcaatctgactcctgtttgtttacatatatatgtttgtgatatcacaaagtcaaaatagcttatctcaagtccccactcttgaaattaaaaaaaaaatgttctgtagctaaccattaatgcatttaggaagaggatacatttccaaaaccatatttaaaaaaataaagttaggaattacagttaaaagattaccataaactgttaacgatgtgcatatagttaacacttaacacttaaaaatggttaagatggggccaaccatggtggctgacacctgtaatcccagcactttgggaggctgaggcagatggatcacctgagctcaggagttcgagaccagcctgcgcaacatggcgaaaccccatctctaccaaaaaaaaaattagccaggcgccatggttcacacctgtagtcccagctacttgggaggctgaggcacgagacttgcttgaacctgggcatttgaggctgcattgagcccaggtagcaccactgccctccggcctgggcaacagagtgagacgctgtttcaaaaaaaaaaaaaaaggttaagatggtaaattttatgtattcttttaaaccactttgttaaactattaggatataagttcaatgacttgcatttggtatctaagttccatttttagttctgactgatttgtgccattgagtaaagtctttcatccttatgtgtgtggcaatggtctttaaagtcatctgttaacaaagatagtttttatatctataataaagagctagagaacacaccaagaggcaaataggtaggcatttgcagttagttaatattcttgcagggatattaatcctaattattgttatttattaatttgctcttgaaattgatttattgaagaataagaagatgcagaaaaatatttatgtggtgagtgaaacaacaatttcaaggtcatttgagtactctttttactgtgtttattgtcaggtgggaaggaatatctatcaggactgagaagctatgaaactggtgtgaaggaacatgacacttttctgtctagtattgatgaataagattgaactctgtaatttgcatgcaaattttaatttctattgaaagaagaaagagagccaattttggtgtgattctaaaagaaaatttattgcataaggtgaattcagtaaaattatgatgcctgccaatgtgtctactaagagtcttgtcctttcttaaagtgaagtaaattgactgtgtttttagtattacagtcaatgtcatataacatttctggtcatgattaaaagctgctatattttattactaaaaggattaaaggaagtatttaaagtacagaaatatacattttaaaaattacaaaatgtatgttaaaatagggataggtgactttatatattatccttttgggtatgactcagaaagattttatagcttattcttgctgtttttctttttttaattaagaagcaaaaaaaccggctgggtgcagtggctcatgtctgtaatcccagcactttgggaggctgaggtgggtggatcacgaggtcaggagtttgagattagcctgaccaacatggtgaaacccgtctctactaaaaatacaaaaattagctgggtgtggtggtgcgtgcctgtaatcccagctacttaggaggctgaggcaggagaattgcttgaacccaggaggcggaggttggagtgagctgagatcgcgccactgcactgcagtctgggcgactgagcgagactctgtctcaaaaaaaaaaaaaaaaagaagcaaaaaaaccctcccctgccctctataccctcattacacctagtttccaaagatggttggggtggaggtataggttacaatcattcttactactttaggttatgagtgggtttgtaagggtagagagttagattccagctttttttcttcttctaccatctgtggtactttactatgtgaatatacagttcaagtcacagcaagaactctaaaaaactgacaagcaaaaacaatgtcaaaaatgaggctgatgctgggcacagtgtcatgtgcctgtagtcacagctactcatgtggctgaggcaggaggatcacttgagtccaggagaccagcctgagcaacatagcaagcaagacccagtctcaaacaaatacccacccccacaagaaaaaaaaaaaaacaactattgaggttgaaaaagagaaggaccaaaatgtgttcattggacttagccataatgaagtttttggtgactttggaaagattggattcagtgttgtgaaggtgaaagccagtttgcatgagtaactgaaaaaatggaaggtgaggtaataagagttggtgtctgtggaaattattttcaagaaatttagctttgaaagggtgcagagagggtgataacctctttaaatcctgcccacaagaagtatactatcttataaaggccagtcaactttatatgggtatgtggctggcatgagaaagaaaacttcatattttgctatttgcaaccaagtctaaacagagtatagagaacttctctaaaagcatgatggtgtgtctgttttagtgatgtaacagtttatgtactgtttagttacccttatacatgtttagttgattacattatcaatgaggaaacagttgctttttagtttttgataattttaagaaaagttttcatttagttactattcattgagtgccaactgtgtgccagagaggtagataccaagttcacagtggagaacaagacagacctagtccctgcccttgtgatgcaaacagattaaggaagaaacacattattttaagtgtggtcattgttacagaacatagagggtgtttgggagaggtttaatcttgttagaggactggaaaacactgaaaggatatctgtgaaattatgtttgcacactgaggtgccttaaactattgttactgagtgataaagtaatagagcggaggattttctttctttctttctttcttttttttttttgagacagagtctcactgttgcccaggctggagtgcagtggcgccatctcgactcactgcagcctctgctgcctgggttcacgccattcatctgcctcagcctcccaagtagctgggactacaggtgcccgccaccacgcccggctaatttttgtatttttagtagagacggggtttcaccatgttagccaggatggtctcgctctcctgaccttgtgatctgcccgcctcggcctcccaaagtgctgggattacaggtgtgagccaccgctcctggccgaggattttctttagataaaaacatcacttcattttttagttttgtgtaaaatcatttatcattgctgtattttttcccccaattttttttttttttttttgaaatagagtcttactctcacccaggctggagtgcagtggtgtgatcttgactcgctgcagcctcaaccttctaggcttaaatgatccttccatctcagccttccaagtagctggggctacgggaatgcgccaccacatctgactaattttttaatttttatctttcatagaaacagggtcttactgtattgtccaggctggtcttaaactcctgggccaattttaggtttgcagggtatctgtgcagatttattatgagtaaaccgtgtgtcctgggggtttgatgtacagattattttgccgcccaggtaatgaacatagcatccaataggtaattttttgattctcaccctgctcccaccctccaccctcaaataggcccaggtatctattgttcccttctttgtatccataggtatttgatgtttggctgccacttacaagagagaacattccatgtttggtttttctgttcctgcattaattcacttaggataatggcctccagcactgtccatgttgctctaaaggacatgatctcattctttttaatggctgtgtagtattccatggtgtatatataccacattttctttacccagtccatcccttgcatgggcatctaggttgattccatgtctttgctactgtgaatagtgctgccatgaacatgcacatgcatgtatctttatggtagaatggttcatattcctttgggtatattcccaattatggtattgctgggtcgaatgttctaagttctttgagaaatcgccacattgctttccgcagtggctgaactaatttacatcctcaccagcagtatataagcgttccttttctctgcaaccttgccagcatctgttgttttttgagttttaaataatagccattctgactggtgtgagatgtctcattgtggtttttatttgcatttctctaatgattagttaatgttgagcatttttttatatgcttgttggccacatatgagaagtgtctgttgatgtccattgcccattttttaatagggttgttttttgcttgttgatttaagttccttatagattctggttattagacgtttgtcagatgcatagtttgcagatttttttttaccattctgtaggttgtctgtttactttgttgatagtttattttgctgtgcagaagctctttagtttaattaggtctcacttgtaagtttttatttttgttgcaatttcttttggagtgttcgtcatgaaatctttgccagggtctatgttcaaaatgccatttcctatgttttcttcttgggtttttatagttcgaggtcttacatttaaatcattttttgtttgtttgttttttgagatggagacttgctttgtcacccaggctggagtgcaagggtgcaatcttggctcactgcaacctccgcctcctgggttcaagcaattctcctgccgcagccttcggaagagctgggattacagactcctgccaccacgcccagctaatttttgtatttttagtagagacaacagggtttcaccatgttggccaggctggtctcgaactcctgaccttaggtgatccactcgcctcggcctctcaaagtgctgggattgcaggtgtgagccactgcacctggcagaagtttttttgttttgtgttgttttgtttttaagtagagtttggcctgtgtggtagtacacatctgtagtcctagctactcaggaggctgaggcaggaggatcccttgggcccaggaattggacgccagcctgggcaacatagaaagacactgtctctaaaaataaaattttttgaaaatagactttatgttttagagcagttttaggttcacagcaaaatccaatggaaagtacagagagtcttcctggtccacacacccacaacctcctccactgtcaacatacagcaccagagttgtccatttgttacaattaatgaatttacattgacatcagcatttcccagagtccatagtttacattaggattcactctttgtgttgtaccttctatgggtttggacaaatggataatgacaggtatctaccattattatatcatacagaatagtttcactgcccccgcccccactccccctggaaaaaacaaaacaacaacaacaaaaaacctctatgctttgttctcctaatccctggcagtcactgatctttttactgtttctatagttttgcgtttaacagagtgtcatatagttgggattagacagcatgtagccttttcagactgtttttttttttcactaagtaatatgcattcaaggttcctccatgtcattctcatttcttgttactgctgaataagattccattgtatgaatatttattcacttactgaaggacattttggttgcttccaagttttggcagttatgaataaacctgctgtagacgtctggtttttgtgtggacctaagttttcaactcatttgggtacgtacaaaggagtgcagttgctagattgtatggtaagattatgtttagttttataagcaactgccaaactgtcttccaaagtggctgcaccagtttgcatttttaccagcaatgaatgagagtttctgttgttccacatccttactagcatttggtattgtcagtgttttggttttttaccattctaataagtgtgtagtggtatctcgttttaatttgcaatttcctagtgagcatcttgatgttgagcatcttttcatatgcttcttggccatcttctttggtgaggtacctgttcagatcctttccccctatttaaatcagattgttcattttttatgttgacttttaagggttctttattttttttagataagtcttttatcagatatgtcttttgcacatattttgtcccagtctatggcttgtgttctcattcctttgatgaagaggtgtttgttttgttttgttttgttttgttttgagatggagtctctctcgcctaggctggagtgcagtggtgtgatctcggctcactgaaacatccacctccagggttcaagtgattcttgtgccttagcctcctgagtagctgggactatggcgtgtgccaccatgcccagctaattttcgtatttttaggagaaatggggtttcactctactgaccaggctggtctcgaactcctgacttcaggtgatccatcggcctcggcctcccaaattgctgggattacaggcgtgagccactgcgactggccaacgaagagttctttaaaaaaaatgttcacttcccttattggtgtcagctctgtgctggatactggagtctagggttatagtggtaagaaatatcagacattgctcctgtactcagtatcaaagggggacgagaagacaatcaggtgaatatgatcaggtgtgataagtgctgtaatgaaggcaattacaaggtaccatgttggtgctagcaaagctaactagtccgagacggtccaaagaaggcttttatgtgtagctaacatttattgaggattaatatgttccaggcatcattctaagagctttacatttattaatttaaccctcacaacaactctatgagatattaatattattatcatcatctccattttacagtcagagaactgaggtactgagacgttatggtggaggtgggattcaaacccaggcaacgtggctggctccaaagcctgtactctaccactgcaactgtactaatgctttttggaggaattgacctttcagcagaaaacctaaggatgattaattggaatttagtagggtaacagggaaagaggtccactaggcagagggagcaatgtgtgggaaggctggaagtctgagagagcagggcaagttcaagtatctgaaaataaggcataaatggagtgagggatatatggttagggaggtagatcacgccataaaataaacacatgataaaccaacctaaggagtctagtttaccatatccagaggaggcagaaagcaatagcagtgttttaagcaggggagaataacatgttagatttgtgtcatggaacgatcactgagagaaatagattggtaggaagcagaattgtaggttagaaacaagctgggttgggagactctgtggggtaatagaggagaaggataatggcctgcactaggatattggcattgacgatggagagaagtgaatggatttaggagtagctctctttagaaggaagaattgttatgacttgagtggttggttagatgtaaggttgagagaaaacccagacatgattctctggtcatggttggggcagatcgaagtctggagaagtagcagtatggggaaggggctggaggaacagagggaaaacatgagttaaagtttaaatttgctgagatggaaagtgtttgatgagacaggcaagttaagcacttagatatacagatgtaaccatattataagtctagcacttaggaaagagctttgaaccctatttgagatttatatatataaaatatttgagccactcttctataggggttaaattaagccatggaaggcagaagggagtagtcagtaactttaaacattgctgagataacaagtaacataaagcctgaaaagggtttgttggtaatttgggtgagggcaaaaaccagatgcaagtaattgaggagggagtgagaatgaggaattagagaagctagagttgaatgtgggtttgtggctttttagcaggattgttgcaaatggggagagcctcaatcatgtttaaatgttgatgagaaggaaccagggtaaagggagaagctggagacatgactgggaagtgtagattacagtctctgagtagattcgagagaatggaatctagatcccagatgaagggattagacccaggagaaaggatccacagcagcttccattgtgatagggcaaggacaggaattgtaatagggcagggacaggaatttctatgttgagtatcagaaaaggaaatcaggtcccttgatggctttagttgtcattgtgaagtaggaggtgaggctaccttctaagagtagggggcagaatgtgttggcagtttaagaaacatcaggaggcaggcacagtggctcatgcctgtaatccaagcactctgggaggccaaggtgcgaggatcgtttgagcccaggagttcaagaccagcccaggcaacacagcaagaccctgcctctacaaaaaataaataattggctggacatggtggcgtgtacctgtggtcccagcgacttgggaggctgagatgggaggaacgcttgagcctgggaggttgaagctgcagagagctgtgattgtgccactgtattcaagactgggtaatagagggagactttgtttccaaaaaagaaaaagaagaaacatcaggagaggatatttgaaatcattgctgtggagggtgagagtgcgaacaaggaagttgtggtagcattgctagacagttttgagagcccaggtaaggctgatgactaagaatttatggatggcataggcctgcatagttaatttttatttaaatagcagtgtttgaagagatcgagattccttttgaggcaattacctcgttaagtatttcaatagttatctttaaatgtttaagaatttggctccttttcctctcataactattgttaaaagaggattgatcctaaagtgtagagaggcaatgggttataaaataataaaatgaaaatttgtttcctttaaaaccttttcaataatggacatgtatttttttactctttagtcatattctgtactactcttctgcttaaaataggattttagagttatagaatttttagagcaggaaaagaggtcttttgagattatatttttctttctgacaatgctatttttttttttaagcacaagaatgtttgccaagtgcaatcttagaggaatgacccatgtataaaacagctaaaaatggtggtgctttgatgtgtgctggtaattaggaactcaaactgtggagtcagactacctggacttagaataacctgactctgcttcctacctgtgtagctgctaagctccagtttcctcatctgtgaagtcagagtaatactagtacctccatcatagactttgtaggaattttaaataggatactatgtataaaactgcttagtacagtgctccatcaatgttagtttggttaatctggttaaagcaaagttgggtaggggggcattctagcagctgtacatgcctagtccctaccttatcccatgtggtggctcctgagatagcttcctagaacccttctatagatgcagtttgaaaatctctaatcttggctaggtgcgatggctcaatctgtaatctcagcactttgggaggctgaggcaggcagatcatttgaggtcaggagttcaaggccagcctggccaacatggtgaaaccccactctctactaaaaatacaaaaattagctgggcgtggtaatgcatgcctgtaatcccagctacctggcaggctgaggcaggagaattgcttgaaccctggaggcggtggttgcagtgagtcaagagcacgccactgcactctggcctgggcaacagagcaagactctctctcaaaaaaaaaaaaaaatctctaatctgattcatcctcctaaatttgcagatgggctttagattgtagaataacattttaaaagttcaggccaatttcttctgctctaggttctacacaaccgctattgctgaattaagccgcataaccatgcctagaggctgtagcttctctctaggtggtatctgagaaatggaatgtaaaacattgaattagaaggaagtttaatattttaaaaattatagaggagtcaataaaatagagtacctttatgatgtatataatgcttagtaaaaatcgatcagctagatggactgagtgggttcttaaatatgttcttttgttgtttatgcttataaatctaattttgataaatcttttaaaaagtatatataatctccagttggaagttctaaaagcttgatggttccttaggataactacttaatttatcttatgatagaactataatttacagcaagtatgggccttctgccaccaaatcttggattttttcttcaaatggtgatggaaatctcataatttttatggcaaatgatgtgtgaaacataataaaaaatatgatgccggatatatattggtaataaatagcttgttactggcaattcttgtgaaaagtgatttaaataatttaaattattttttatttttaattattttattaattttatttaattatttatttattacaaagtcctttccaaaatatgatgctcttccaacgaaaaaagaaagggtaccatataattaattctgcagatgtacattggaaaacaaacattgtatttgattctggggatacaaaatataaacaggtatggtatttgctttctaagaactttcatttcattccaggaactgtcctgacttcccttcaattcataccctccttttaagtttccagctctgggtaaattccatgctatgctttcttcactccagctccagagcttaaggttattgctgaattaagccacgtaaccatgccatttgatccacagttcctctttttctcacttttctttgccattttccataagaatagttccaagattttattttttccttatgcctatggtgccattcctcatcttttcacatgatagaacacctgaacttccttccttccccacttgactgtacttcatgatctgtagccttcaacattttggatctcttcattatttgaaaaactgttctattttataattgtatatgaacaagtctaatttcctgtgaaatatacagggaccattcttgttcatctttgtgttccttgtgtttaaaattattccacatgaccatgaatgattggtggtttcttgatagtctgcattagatagggctggatattggttggttccaagatactgtctgcaagcttccttttttgaatccagaagcatatttgaacagtcaaaacctggcaaaactgctgtttagtgtcatattttaaaaacatatttccattatcaattattttggtattgaatgcattttgactgaaacaatagggatcaactttcgtgactgatttcaaacccattatttgtgattatactgtactcctatactgtaggagtacagtatgtaaccaaatgtaattggtagtagaatttgaccagttcctagttaggtagttaatatgttctgtttaaggaatttacatttagttatatagtagtttcttatcagatgtagattagtgggaaagttgttttgaagtaattaaacatttttcctaacaatagaaggctaatttgcgttctaatttttattagataagaatattagtaggccaggtgcggtggcgcatgcctgtaatcccagcactttggaggccgaggcaggcagatcacgaggtcaggagatggagaccatcctggctaacactgtgaaaccccgtctctactgaaagtacaaaaacaaaattagccgacatggtggtgggcgcctgtagttccagctactcaggaggcggaggcgggagaatggcatgaacctgggaggtggagcttgcagtgagccatggtcgcacgcgccactgcactccagcctgggcgacagagcgagactccatctcaaaaaaaaaaaaaaaaaaaaaaagaatattagtggtacagtgatagacacaaatagctagattttcgctatagaacaagtattttataaataaatttatagaataatattgtgtacagaatagttttctttaaagcatacatgcttaacaattagtaaaaaaaaaaaaaaaaaccctgtgacaacattctttacctttttttttcctttttgctctttttaggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtgagaaatttttaaggtcagccatagcaaatattatctccatcaagagacaggaaaagatggcaacagagaattatgcttaggattgtaacccaaactgggctctaatcctcattaaatggtcagtgtcacaaccattaccatgtgtgaaaaaggaactaaaaggtttcttccctaagcattttatcttttgaaatgcagtagaatacttgatttagttccactggcaccatcatgtgccatcaggtaccaagtggaatgataatatttgagtccccttagaggttaatagctgatctcttttttgtgttgatgaatatacttggtaattgcttctaattcctgaaagtggtaaatctggacaaagtattatggatgttaatttttaattggtagaagaatttgaatgttaagtactattctttccaaactctagctggtactaaaagatgttcttgggtttgtttgttgttgttgttgttgttattgttgaaatcagatgataacagcttggaacactaaccctctagaaaggtgctatgatatgatttgcagggtctataccaccagcctgcaatatagatgagtgcttcagttaagcttacacaccttcagccaccagttccctctcacatggtataggagttgctgagtgtgtagttgggggcttaaacttcacagaggaataaatctgaagggagtatgttttgaggattttatgttttattaaataattgatgctggctgggcatggtggctcatgcctataatcccaggactttgggaagctgaggtgggtagatcacttgaggtcaggtgtttgagaccagcctgggcaacatggtgaaatcctgtctctactaaaaatataaaaattagccagtgtggtgatgcatgcctgtagtcccagctacttggaaggctgaggcacgagaaccacttgaaccttggtggcagagtttgcaataagcagatattgtaccactgcactccagcctgggtgacaaagtgagactgtgtctcaaaaaatatattaaaaataacaataattcagagcatgtgataatggaggttcatactgctggtgttgcttctgtctaattttttacatgaaattgataaaagaacatattctggtgggtttatgattagttatgtggatttctttacccaattcctgctaacaactgtaggatcttacatagttgatacagccacaatgtgtgatgtgtgatggctaagctatctatttgtatgtctgtattagccacagtatatgatggctaagctatctttttggtttccctgtttttggatatataggaatttgtgatttgttgtttgttttgctgtgatttaaaataattattgtaatattactttaaaaagactttgatactttatactactttgagaaaaatcaaaatagaaatcgtcttctgtactcagttacaatcctaacctgtcatgttctaattttaaagaaaacaaccagtacctgtatgaagagatcgtttaatagagttcggttttataccattttattcagctacttgtcataaacagcaagttattcttctgtataatgccagccgttttgccagtaaaaacaagatagtttcaatgggaaaattctgccccattttctatcccatgctgctatgcagctacattgcaattaactgagtttcttaattggaaattctcttaaagtttgagaagctaaatgcagctgcatccataataaagggcctctgtagtacaaatggtatgccggtgaacacttggtttagcagagaatgtattcttgcactgcatcctttcttcagtgaatattgttgcaagctaacagttcatatgagggtggcacaaggcacagccttttaatcctactcatcagtgaatcaatgaatcagtttggaggtaaacaaggagacagaagacgatagtatgactgatatgacttagctaaagtggaaaccagccatgaggtaataaagatacttaaaaaggggaaatctaattgccttctgaatatagaaaatctgaatcatcaaaaagctttctcagaaccccattctaattccaaacaggaaaaatgaagaattaaaataggaaatattttgctttgtcatagataaatatgtgtatgtgggcaggaactcagtggttgacaatgggatgttactagagaacttcattttcaccatttccaggacattgaacttacacttggattgaaccaaaagtaaaaagcacaatttataacaaaatttgaataaagagccatgttgattttggtttgtcaattagcacttttctttttcaaggcaggaatttttgttgaaatgcttggtagttggacagtgtaaggtcagtcagtagtaagatctattggcattagattttctttgttaaggaatgtattttaatattttaattctttgtttgtttgagatggagtttcactctttcgcccagtctggagtgaagtggtgtgatcttggctcactgtaacctccgcctcctgggttcaagccattctcttgcctcagtctcccaagtagctgggattacaggtgcccgccaccatgcctagctaatttttgtatttttagtagagatggggtttcaccatgttggccaggctggtcttgaactcttgactccggtgatctgcctgcctcagcctctcagagtgctgggattacaggcttgagccactgcgcccggccggaatatattttaattcttaactggcccttttgctaataagaataatttttacagttggccattaagattttatgatctgttgatatttatagtggtggctttatttgtatatttctgatagatggataattaggaacttatcttttaatcataggtggcacaagatctctgtaaagtagcaggcatagcaaaagttctggtggctcagcatgatgtgtacaaaggcctacttccaggtgaggttttccagtagaaaaaaatgtagtgtctaaattacgcttgaatatatgaatatgaaagtatttcaaaatatttttttatcaaatgtgtttaattctcagaggaactgacaccattgattttggcaactcagaagcagttcaattacacacacatctgtgctggagcatctgccttcggaaaggtgagaaggttgagaatgtggaatctgatatcactgcttgaaagggttagatttcattgtgctgaaagtatgcaacagactgtttatgtagccaatctggatttatctgaattgatgtggtagttttgctaaaatttattctttcaagattttgtcataattttccgttaaaactaccatttccaggttttcaaattatgttgtggagaaaactctaattaggctattattttaaaattttctgcatgtaaaagtaatgctgaattctgcttgcatgtgagagagagagtgaacgagcaagagtcatttctattagtagcccattttaagagatggtttatttggatggctgatggatatctagaaaagccaaattttatctacgtagggaatttggaaagggcttgtggtggttgaagacatccttaaggtaaagaaagctgtaatctgatcatgtgcattgtgatgtgtctgaagaatgagtgtgttataagatggatagcagtctacataaagttaaaaatggagggaggagtgtaatgggagcttaagacaaggaattcgtcagtggatttttcttgctctctctctgtggccgtgggtgttatcttagctctcttttcttttgttccattcttaataaggtgtcatttttagtctttatttttactttcttttttttgagatggagtctcactgtcgcccaggttggagtgcagtggcgccatctcggctcactgcaggctccgccccccggggttcacgccattctcctgcctcagcctcccgagtagctgggactacaggcgcccgccagctcgcccagctaattttttgtatttttagtagagacggggtttcactgtgttagccaggatggtcttgatctcctgacctcgtgatccgcccgcctcggccccccaaagtactgggattacaggcgtgagccaccgcgcctggcctactttttttttttttttttttcgagatggagtcttactttcctcgcccaggctggagtgcagcagcacaatctcagctcactgcaacctctacctcctgggttcaagccattctcctgcctcagcctcccgtgtgtagctgggattataggtgcgtgccaccacacctggctaatttttgtatgtttagtagagacagggtttcgccgtgttgaccaggctggtctcgaactcctgacctcaggtgatctgcctgcttcagcctagctctgttgcccagactggagtgcagtggcacgattgtagctcaacataccctccaacttgtgggctcaaacgatcctcctatcctagccttctgagtagctaggactacaggtacatgccaccatgcccagctaattttcaaattttttgtatcgatgtagtctccctatgttgtgcgggcttgtcttaaactcctggcctcaagtcatcctctcatttcagcctcccaaagtgctaggattacagacataagtcactgtgcttagcctattttcacttttaaaaattgtaaaataagttgtacacaaatacatccttattaggaagactgcgtgtagtacagcagtgtgcagagcaaggtgtcaaagtcctgctttcttattcccaactcaccctcccctctttagaagtatagctgttaacaattgtacattcttttaggcctccttctatggatttttaaattacagtacatgtacagctatatattttttacttctaaaatgggataatatggcatgaattgttttgtgaatagtagcttttacttaagagtatgacttgggcagggtgcggtggctgacgcctgtaatcccagcactttgggaggattgtctgagcccaggagttgtagcccagcctgggcaatacagtgagatctcatctctacaaaaaaatgaaaaaaaaaaattagctgagtgtggtggtgcatgcctgtggtcccagctacttgggaggctgaagtgggagaattgcttgagcctggaaggttgaggctgcaatgagctgagattacactgctgcactccagcctgtgctccagggtgacagagcaacaccctgtctcaaaaaaaaaaaaaaaaaaaaagagtagcgactttggctcataatgtttctctttttttatggctgcataagattccatgtttagctaaggacagttaacttggttccagttttttgcatttatatactttactgcaagaaaacatggtcatgcatgtatctgtgtaaacatgggctggaatttatttacaatagagttctagaggtgaaatcactgagtcaaatgctatgtagtttaaaaattttgatacctattacttaattgtcaacacttggtagtatacattttaacattttttcctccagtctgatgggtgaaataatctttgtggaccgttctgtctctgagagttttgattatatattggatgatttaaataatttcatgagccttgagtttccttctatgatgacagttcacctaacagagtgttagaccatgaaagggtgtttgtcattagctagattttagtactctggccatgattgctatgttgtaacagatgggagttttgagaataagggtcacataatagtagctggtcgtgcggcctgtaaatgggtttggaatgagaaacgtctatcagaagaagccaaacaatttgctgtatgatagtccttcaccagctgtggttttgagataacacacttttatacttgtctgctagaattttaaaatatgtcattttttatgcacaaaaagaactcaattattgcttcttcttcccagaaaccatgcaggcagcttgttggatgggatatatttttaataggatagatatctgtgtaccatccaccctcatgatgtttagatagaagaccagatccaggaaaacatacttttaagtaccatggtaaaatttcttgaagatatgttaaacaagggataatgaaaatacaaaagacattaaattttgagcaatttagaaagttctaaaacttttaaaagaggcaaagtctgtataacataaaatttgtaagataatctgttcagccaagtaactattccagtaataattcctgaacagttaaagaaggtggttcaggaggaggattacttactgaagctagctttaaatactgacaaatctggtttttaaaccagattaagtaggtgcttcagaatgggcatggtggctcatgtctgtaatcccagcactttggggtgccaaggcaggaggatcagctgaggccaggaattcgagaccagcctggacaacaacgcaagaccccgcttctacagaaaaaaacaaaacataaaccaaaaaatgagctggacgcagtagcgtgcgcctgtagtcccagctactcaggaggccaaggcagaataatctcttgagcccaggagttcaaggttacagtgagctatgatcacaccactgcaagttcagcctgggtaacagaatgagaccctgtttccaaaaaaaaaaaaaaaaaagaagaagaagaagaagaattaactgagacttggggaactgtgactttcccaaggattcctgctactgaggacaaagttagcacatgcatctatttcagtacaagcacaagaacacacctttattttatttttgttgctttttaaatatgtactacacaggctgttcttcaggttagtgttattcttttccttttttttttttttcttttgaggcagagtctcgctctgtcaccaaggctggagtgtggtggtactatctcagctcactgcaacctccgcctcccaggttcaagcaattctcattctcatgcctcagcctcctgagtagctgggactacaggcatacaccaccatccccggctaattttttgtatttttagtagagatggtgtttcaccatgttggccacattggtctcaaactcctggcctcaggtgatcctcagcctcccaaagtgctgggattacaggtgtcagccactgtacctggccttactcttttttttatacaatatcaatttaaacaaaaggtgaaatgtctgctgtgaatttttttcttttatatacattaagtaaatgtatacaagcataatctttttcagtatttgagaattttaccacccttctaaatttgttctatcttttcttatctaaattcaataatccacaactgtcacacttggtaattgatgtttattaaatttcatatctcatagttcaatatattgcattaaggtggcttaatactgtaaaactcatgaaactcttaatgtagttagagtaatggtaagtactcaatctcaaaggctatttaaaaagctgtgcttgaagttgtgtatccaaaggtgcacacgaaatataaaatatttgaattaaaatttctacagaatatgcatttagaatatgtcattactgatcatttatagtcttccatcactatgtatgtgtgttaactcactgcttattttgcttttagaaccttttgcccagagtagcagccaaacttgaggttgccccgatttctgacatcattgcaatcaagtcacctgacacatttgtgagaactatttatgcaggtgagtactcaaggaagataattaatcaacatgttaaattttagtgaaaagcataaattaatcttgaagatagaattttaaatcaaaccatacaattgctttaagtggaccatcttaaaggtttctgaggaaaattttagtctagaattgctggtggcccttgacatggcattctctctgatggatcgcaaacacagagatttcctgcctgtttattcagtttgcagggtgatattttcctagtgatcaataaaaattagattcacaatttaatatattttgtaagtggtacctggaaaagcaaaacttaaaaaaaaatagtattctcaatctttgctgcttctacttcatttccataggcattaagaaattcattttagccagctgcagtggctcgtgcctataatcccagcactttggcaggctgaggtgggaggattacttgaactcaggagtttgaggctatcctgggcaacataataagaccctatctcaaaaataaataaataaaataaattagctaggcatgttggcatatgcctgtagtcacagatacttgggaggctgaggtgggaggattgcttgagccagaaggtcgaggctatggtgagttgtgatcatgccacagcactccagcctgggcaacagagcaagaccctgtctcaagaaaaagaaaagaaattcatttcagtgtctcttcagttgattttttgcttagcacactggtctctagtggggtcggagaaggcagtgaactcttcgttttttgcctgattaaagttgtgtattccagtatgaatggctaattctgaaattagacttttcatcttccataatgtttgagggaaaatattttgtcatggtttaggttactgttaatgtgatagctaatccagagtgtctcaaatcctcttaaaatcttagcacattcatacctgttctttatgacctattgtgttttcaagatattcctcctttagcatgcacagtagctacattcttcctaagttgttgcagctcatagttttgagttactgattgtattgtttttggagaaggaagctttgttcatattccttttagaggtgtagtgtaccttcttagtgtggatgcctgttcgagtttcttccttctaggtgtggtagtacctgtcctgcttttaaagacatccagggttatacagatatctgctgatatgtttcttcaccgttatggttcattttttcctatacttaatagagttagaagacaactggtcaatagttatttcttgccttgtctgtgaagtaaattccaagcatcaaaggagtgctagttttgttgccttttgctgttgcttttaagaaatagattgtatgtttcaggaaatgctctatgtacagtgaagtgtgatgagaaagtgaaagtgttttctgtccgtggaacatcctttgatgctgcagcaacaagtggcggtagtgccagttcagaaaagggtgagtgttcatttggagtttttttgttttgtttcttacttttttaattcatagactgtattataataagagatgacctctgcctacatttctaatgaatagtatttgaaagttcaatttaaatgatattcccaagcttatacaaaaataataaatatgtataacttacatctttttcacattatctttggtactaggatagttgctttggtagatcaagggagtgggagacagaggatctattaagattaagcttttttactcttgtcactgtttcctattatatttgggtgattcagtataacagaagaatgtaataggaaacgtgtggagggtgtcacactttaacatatatagtgtcttatttgaacctcatagaaagaaagttattctatattcagactcagagaattgaatgatttctggagtcatacagctaatgtggcaaaggctggaatctagtctccttaagtctttccattatcagagagaattaattaggagcactgaaaattcacagtaattaacttaaatttcgtggaattatatacttgtgtgtttctcttgaaaataattcttgttatagaacttgaaatcatagtcattgttttattatgtattaatgtatgcagcatcaagtacttcaccagtggaaatatcagagtggcttgaccagaaattaacaaaaagtgatcgaccagagctaacaggtgccaaagtggtggtatctggtggtaagtgaaatattaatcttaaaagatgtaaattgaaaatactttgatttttttttttatttttagtatttattttagaagtacacagatctttttcaaatgtaagaagttgggaagtttgggatattattcccatttaaccaattaggaaaatgaaattatgagcataatacacagtttggggtttctgttgcacacctagtcactggcaccagggggagcatggtataaatcttatctgcataactttgccacttggtgccatcttattgatggacttccatgaattctgcagagtatggttggcttctcaattatagatagaactggcttgaatttcagggccatcttgtgtataattcctacccttctttccacttggaaagatttccagagttgtccatgtctttgtgtataactctttaaaaagtttcttaacatttaatatcaaaactgttaatattgcataagacatgcttatttttatacatcatgctccttgtctttaaaaacaatgatttttttatggcccactgactaactttttgaaaaaataaggactgttatgctttttaaatccttgcaattaaacatccaacaaaataagctttcagacagccttctattgcaagtatcattgagaaaaaaaaattaatattttgaagtgatatatctgacttgtttttcgttttctttttttctttttgagatggagtttcgctcttgttgcctaggctggagtgcaatggcacaatctctgctcaccgccacctccacctcccaggttcaagcgattctcctgcctcagcctcccgagtagctgggattacaggcatgtgccactacgcccagcgcggtgactcacacctgtaattccagcactttgggaagccgaggcgggtggatcacccgaggtcaagtgttcgagaccagcctggccaacatagtgaaaccccgtctctattaaaaatacaaaaaattagctgggcatggtggtggatgccagtagtcccagctactcaggagggtgaggcaggagaattgcttgaacctgggaggcagaggttgcagtgagccgagatcgcaccattgcatttcagcctgggcaacaagagtgaaactcctcctaaaaaataaataaataaataaataaaaataataattttgtatttttagtagagacggaggttctgcatgttggtcaggctggtctcgaaatcctgacctcaggtgatccgcccacttcagcctcccaaagtgttgggattacaggtgtgagccaccgagctgggccctgacttgtttattcacttatttattcaagaaatgtatattggttatctgttctatgacaggcttattgccaagtgctggagaaacagatgaaaaggcagaatgttcttcctctcgaggagtttaaagtccttgagatgactcccattcaaataataactttattcagtcattcagagaaatttattgagcatctattatatgtagagttttgctaaatattgcagatatggcagtgaccaagatagatatagatcctgaaattaaagagtttttattctagtgggaaaaaaactcatattaattacacaattagttaactaggtaatcatagtagtgttgaatgctttatagaagtataggagtgtcagaggccagaaaaggtttatagaggaggtgacatgcttaatatggcagttacataatatgaaaatttactccagtatataaaatagcaaaattgttccagaatgtatttgatgtttgcctaatttttttttttcatctttttaaatgaggtcgaggcttgaagagtggagagaactttaagttgttatatgacttggcagatcaactacatgctgcaggtaaagttattttccttagtagaaagatattccctttttgttggaaatattttttcttcattatttcatttttgtgtaagtctttcagccctacaaattattttacttttccggatttttcagtttttctctctgaaccagtttttcttaagcctccaagtaaatggtatatagcattcagtgaggagaaggcctcctagtatctcttacctttgcctaatcttagtaggttttcttttttcttcactttaaaaataatgaaatgggccaggcgcagtgacacacacctgtaatcctagcactttaggttgctgaggcaggaggactgcttgagcccaggaatttgagaccagccctagcaatgtagtgagaccccatctctacaaaacgtttaaaaattagccaggcatattggtgtgtgcttgtagtcccaggtactcaggaggctgaggtgggaggattgcttgagcttgagaggtggaggcgacagtgcactgtggtcgtgccactgcattccagtctgggcaacagagtgagaccctgtctcaaaaataataaaagacaaaataatgaaatgttagtttcagtgcctacttcagattcaggaataccctggtttttcatcttttttttggtggtcttaatataactcttatacaaatagaaatacatttaaagtttttaagtttgtagttaaaaatatagaattgtagttaaccatttataggtaaggtagaacctattgctaaaagtacattgatgagaagggagtgatgttttttgaaaaaccaaaaaaatttaagccaggcacagtagcatgtgtctgtaatcccagttacttgggaggctgagttaggaggattgcttgaacctaggaatttgagaccagcctaggcaacctaattgagaccctgttttgaaaaaaaatctttttaaagacatttgattatttttgaattacacaatcactacaatgaatatatattaaaatgtcccaattctgtcatctcaccctccttttaagactttaacatataactttcgagggttttcctgtaactttctgtggttttcctgtgcgaaatttctattacataacacgtgtacccatagaaacagtaatagttttgtcagaataaaggcattatattgacactgtataatcagatggtagtatttcagggtttattttcattccttctttctttgaacaagtatttatcaagtgtctgccatattccaggtactattttaggtgctattagtttattttggctacagtaataagttactacaaacttggtggcttaaagcaacaaagtttttctctcacagctttggaggccagagatgtgttgaagtgttagcaggggccatactccctctgggggctctaggagataatctgttattttcctcttccagcttctggtggctactctgatatccctgggcttgtggccacatcactacaacctctgcctctgtcttcatatcatcttctctgtgggactgcattcagtctccttctgtgtccctcttataaggatacatggcaggcgtggtggctcatacctgtaatgccagcactttgggaggccagggtgggcggatcacctgaggtccggagtttgagactagcctggccaacgtggtgaaaccccatctgtaccaaaaatataaaaattagtttgatgtggtggtgcacacctgtaatcccagctacttgtgaggctgaggcaggagaattccttgaacctagaaggcggaggttgcagtaagctgagactgtgccactgtactccagcctgggtaacagagtgagatgccgtctggaaaaaaaaaaaaaaaaaaaaaaaggatacgtgtaatggcatttagggcccatgtagataatccaggataaactccctctcaagatccttagctttatatatatctgctgccacgtaggtaatattcacaggttctgggtattaggatgtgaatatatcattggaggggccattttcttgcctactacagacacttaacaccatagattagtaaataatataatatgggccaggcgtggtggcttacgcctgtaatcacctgaggtcaggagtttgagaccagcctggccaacatggggaaaccccgtctctactaaaaaatacaaaaattagctgggcgcagtgatacgtgcctatagtcccagctacttgggaggctaaggcaggagaaacgcttgaacctgggaggcagaggttgcagtgagcagaaatcatgtcactgcaccctagcctgggcaacagggcgagactctgtctcaaaaaaaaaaaaaaatgttagagagtcgtaagtgttagggagactaataggatgggttatggggggtggagaattgaagggaaagattgaagtttaaaataagatagccagatttggccttaatgagaaagagacatctggctgggtgtggtggctcatgcctggaatcccagcactttgggaggccaaggcgggcggatcacttgaggccaggagttcaagaccagtctggcccacgtggtgaaaccccgcctctactaaaaatataaaaattagctaggtgggcggatttcttgaggccaggaattcaagaccagcctggccgacatggtgaaaccccacctctactaaaaatacaaaaattagatgggtatggtggcacgtacctgtagtcctagctactcaggaggctgaggcggcaggatcacttgaaccatgaggtggaggttgcagtgagctaagattgtgccactgtactccggcctgggtgacagagacactgtctgaaaaaaaaaaaaaaaaaaaagacatctgaacaaaggtttgaaggaggtgaggaagcgacccatgaggagatctgagggagagtgttccagaccagagcaactagtaaagtgcacagagcctgtctaacgcaggaacacatctggcctatttgacgaataggaaggaggccagtgttggaatggaaagtgcaaaagagaaagtagcaagagataaaattgggaggcaacacaagaccagatcacatagggccttataggacattgtagagattgctctttctctgaatgaaatggggaaccatttcaaggtttgagcagaagaatgacatgatctaacacatttttaaaggatcactttggctgcagttttgtgaataagctgtagggggtaagtatagtaatggggagatcaattagcaggctatatcagtcgtctaggtgggagatactcatagtttggaccagggtagttgcagttgatgtggggagaaattgtcagttttgagatatatatttgaaggtagagccatcaggatttcccgacagattggatgtggattatgagagaaagtatttttcctggcgagtggtaggatggagttacagttagctgagataaggaatatctcgagtgaagcagtttccagggagagatcaggagttcagttttgggcatattaacctttgagatgtctaataacagacatctgagtagacatgtcagttaagcagttggtataggaatgtgaagttccatggagaagtttgggctagaggtacatatttgagaatcagttcatttggatgatattgaaagccatgagactggatgaaattaccaagggagggagtgtagataaaaaaagaggtcccaggccaggtgcagtggtgtgagcctgtagtccctgctactctggaggctgaggcaggaggatctcttgagcccaggagtttgaggctgtattgtgttatgattgtgcctgtgaatagctactgcattacagcctgggcaacagaatgagactttgtctcttaaggaaaaaaaaaaaaaactcaggactaagccataaaccctgtatgattgagagctaagagagaaaaggagaaagaagaccaaaaaggagtgataagttaggctagataaccagggcagaggctatgttttggaacccaagtggagtgtttcattgaggggggaaaaaattgatcaactatgacacacactgctaacaggtcaaggacggtgaggactgaagattgactattggatttaaccacttagacatcgttggccactgagcagtttcagtggagtgatggaagcaaaagtctgattagagtgggtttaaaagaacaattctggccaggtgcagtgactcgcacctgtaatcccaacactttgggaggccaaagtgggaggattgcttaagcctaggagtttgagaccagcctgggcaacacggcaaaaccccgtctctacaaacaatatcagaattagccaggcatggtggtgtgcacctgtggtcccagctgcttgggaggctgaggcaggagaaatcacttaagcccaggaggttaaggctgcagtgagctgtaattatgccactgcactccagcctgggtgacagaacaagaccctctctaaaaaaataaataataaaaggcataggtagtggttacatggttgtcttcactgtatgataatgctcttgagcagcacatttgtctttttctgtgtgtaggttatattttaatgaaaaggtttttagagatagaatgggagggctggagttggagacagtgaatacagataactttttgagggattttgctatatagggaagcagggaaatggatggtagctagaagaggagtctggccaacagggggacttcataaagctgggacaggtaataacatgcttctatgctgatgggaatgctccagtagagagggaaaagtagtcatattttttctcttcactttttccccttcccttcacatactttttcacttcactcaaggacgtcactcccttattctccctcagtaattctcccctgagggaagtcagaattactggaatgatgtccttgagtagacaagagacaatgtggacatagctgcaggtggtgggtagatgtgttacttggagcatgtggaaattctcttttgatcctttcagtttttttcagtgaataagaagcaaagtcatcagctgagaatgaggatgctaaagaggtataggaagtttgaaaagaagaaaatatatgaaattatagtttaggaaacagctaatgaaaggactgggggaacttagtataactgccaggaattaaggtttatttatttagaggaaaatatacttcacatggttggatatttggatgttttctccagtaatgctgaactacaggagaagagctatggaaaaactggagaggttgcttaatcagccggaagagggaggtttttctgagtgagtgtggtgtgatataagaggagaacaaggaagttgaaggcatagcaaaggaatggttagaatgattgatcatagaatttaaggtgggcaaaaacaagaggacaatgggggagagttaatagaattgtagattacagtggggtcagaggaatgttggaggtgaatgtctgctggaaagaggaggtcagaaagacgctgaaaattgggagtattaagcaatcttggtaaagaaaatgtctaggatatgatcatgggtgtggctgaggtagggtggtgggcaagctcactggaggagagttgttcaaatctccaagtgttgaaatctccaggaattaagataagactagtgtaggtcttttggtttccaatctggcatataagaagcttggaagtcactattctgtcctaacaacaagtaaaaaactgaacaaactgaagaatcaaaactcatcttagatccataggagaagtgaggttgcatggcaaactgctgtcccccaaactggagagaccaacaagcaaatacagataatcacaacttcccagagcagaaacccaaaagtagcaacctccacaggagctggtggtggggtagggggacttgaagtcttgttgatgaattgttggaggttccgtgttaaaaactccaggtgggcagggcacggtggctcatgcctgtaatcccagcactttgggaggccgaggtgggcagatcatttgaggccaggagtttgagaccagcctggccaacttggcgaaaccccatctgtactaaaaatacaaaaattagttgggcgtggcagcacgcacctgtagtctcagctacttgggaggctgaggcagaagaatcgcttgaatcctggagatggaggttgcagtgagccaagatcgtaccactgtactccagcctgggcgacagagtgagactctggttttttgttttttttttttgtttttgtttttgacaaaaaactccaggggtatccagtgtgaggtcccaacatttttgtgaattttaccttcaggagctcttccacatggtgaaaattagagaaaaatcacctcatgcttccgacaaggggacgggaaagggaaccattttaaaatatgccagagcattctgttcttcttaacaaggtctgatctccttcaggaggaactgtttaaccagagattaacttgtggggctttatcagagcctaactgacctgaggaaaggtaaatactcaacttcagccattctagccatcctgtcccacctaagggagagagaggaactgagaagcatgtgtaaagttcacagtctcaatatggtcttattgaggtacggtcttagtaaaagaccaagacgtcaccataggactgtagaatgcttcctttcccccaacaccttaccaccatgtaataaaggcttattgacagcacttccttttacccgtgtacatcatgttgggctatcaagaaaatattgcaagatatactaaaaggtaaaagacagtttgaagagacagagaaagcatcagaaccagactgagctggaataatcagactggaaatttaaaacaactgtgattagtatactaaggtctctaatgaataaaaagcaagcaagatgtgcaatataagcagagggctagaaatccacgaaagaaacagaaatgctagagataaaaaacattgtagcagaaatgaagtataccttttaaggacttcttagtagactggatatggccgaggaaagaatctctgagctttaggatatctcagtagaaacctccaaaactgaaaagcgaagagaaaaataaccagaaaaagaaaaaaacaacaacaacaaaaaaacctgaactgtaatataatatctaagaattgtggaacagcttctaagagtataacatgtaatgggaatactagaaggagaagagagaaaggaacagaagcaatatctgactgaggatttcccctcattaatgtcagataccaatccacagatctaggaagctgagagaacaccaaatatgagaaatgccagaagaacttcaactaggcctatcatttgcaaactacaggaaataaaaaataacaaatactgaagccagaggaaaaaatccaccatacctgtacaagagcaaagataataattagatctgatctcttttcagaaaccatgcaagcagaagagagtgtagtaaaatgtttaaagtgctgagagaaaacactcaccaatgtaggattttataccctgtgaaattatcctttaaaaatggaagagaaataaagactttctcagacaaaaattggcagaatatgtcatagacttaccttgcaagaaatgttaaaagttcttttagagagaaggaaatgatagaggtcaaaaactctggtgtatataaagcaagtgagagcattgaagagggaatgagtgaaggtaaaataagttttatttttcttaattgatctaataggtaacagtttaaaataataacattgtattcaattacatatgctcatgtattacaattacttatgtgctcatgtataagtgaaatgaatcacaatgtaagaaacaggagataggaattaggattatcttgctattaagtggtacttgcaccacctgtgaagtagtaaagtgttatttgaaagtggacttggattagctgtaaatgaatattgcaaactctaggaccagcactaaagtaaaacaaaaatacaactaatagctaagaaaagagacaaaatgaaattatttaaaatgctcagttggtggaagacaaaaataggaaaaaagaacaagggcaacaaatagaaaaccgttacaaatatggtagatattaatccaactgtgtcagttattactttcaacatcagtagtgtaaatgcaccaattaaagataaagattgtcatagtggatgaaaaagtaagacccaactatatggtgtctacaagaaacccactttaaatataaaaatacatatacatataaagtaaatgagtggagaaagatataccatggtgatgctaattgaaagaaagcaggagtagctatattaatttcagatggagccaatttaaagttaagttttattaggtaaataaaacctgagttttaatacacttaaagttttaagttctaaaacttacattttaataaaacttaatataacttaagtttcgctgatattgggctccatattccagaaatcacagtgtaagggttaggaatatgggagattggtgcaggttagggagcatgcagagcattatggggatcagtgtatgggttatgaaggataacctttgagtttggggcttatggggacagacataatgaagggcagggtgtgattagtcctggctgactcaagatagtggtggtgaggctgtgcgtttttggaggttgttagttgtattgtctatggctccctctgtccttttcagcttgagatgaagaggcctgaggctcattcttgactcctgctggggaaggggttgttttactccaagtatagggctcattgttgactcctgttgaatgagaatagaaagtctgttaaattttatttgtgaatttgatagcaaatactggttaaaccttcatcttgttatatgaaactctttgtccagtatcttctctttatagtattacaagaggtgatattgtaaaacctttcttcaaaacttgtgaagttattacttaaaggagcattatataatgacattctaaacattatagtgtaaattttatgactgccattttgataaagcatgcagaagagttaagcccaaattaaaatctgaaatacttgggtataaaaagaagttattccttgaagctttctgtataaaatatactagtacttagaattctaaatcaatgtctttgtttacagttatcagtgaatatcctaactagctgaataatagagcttgaaaaaaatgacaaatattttttccccttagttggtgcttcccgtgctgctgttgatgctggctttgttcccaatgacatgcaagttggacagacgggaaaaatagtagcaccagtaagtattgcaataaaatatgctgtgtaaaatgttatggggataagtactgtatgtatttgttgaacagtgatctcagtgatttaccttactcagtgttcctgagcagttagccagtaccatggtgaatatgtcattttcacaaggtctgtgtagttcttgatcctagtaaaatgcccagcagttcttaaatccagcttattattcaagtattttaaagcagtggaacattttatcaaattaagtcatattacatcaaataaaacattgataaaagcagcattttatcaactcagatttataagttcacattgataagatttatttccataaagcctttagagagtataaaatcaatgagaacaatgaacctattttaatgaacagaattttgaaattgggagctgtgaatgacagttttagtcttatatcttcctgaacacctagtttctgtattttgtcttatagtatcaatttcagaaaattctgttctacatagataagtgatactagaatattcttcagttaagcctgtctaaaacttggaagagcaggaaattttggtctcaaagttgaatcacagttgataatgactgtttatatttcttaggtgatacagattttcagtgaataggagtctcagccagtttaaacttgtatagtatgcaggaaaacatgttttttatatatttcaaaacaatatgcagtcttgtccattaaaaaaaaatcttacatcccagtgctctattctatgagatattcattcacagttttaagatgctgtagtcaacattttcaaggcttattttttatttttgaagttttttttgttttgttttgttttgttttgttttgtttgagatgagtcttgctctgtcacccaggctggagtacagtggtgtaatctcggctcactgcaacctccacctcctgggttcaagcagttctctgcctcagcctcccaagtggctgggattacaggcgcccaccaccatgcctaggtaatttttttgtatttttagtagagatggggtttcatcatcttggccaggctggtcttgaactcatgaccttgtgatccacctgcctcggcctcccaaagtgctggaattacagcgtgagccaccgcacccggcctgaagtttgtttcgaagtatttgttcaagtcttttgcctgttgaaaacttgagttctttttctttttcttttctctttgtaggagttttttatataacctacatacaaattctttgtcagatgtgtgttgtatttttcccatgctaggacttcctattcattttcttttgatgagtagagatttctaattttgataacctaatgcaccagtctttcttcttatgcttaatacgttttgtgttactcaacttacttgaagtcagaaaagaagtcagaaaagaagatttaaagcttaaaatacatattagaactattcataaattaagtcacatcatcatgtggcctgtttgcttgtcataccgaattaggctgtgagagtggatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattccaaaaatgtcctttatagcaaaaggatatagtgcagagtcacatattacattttaactgtcatgtgtccttcaatcttaaatattaatagttccacagtcttaccttcacttcatgagggaattgtgaagattaccagacagctgttttatagaatgtccctcaatttggatttgtctaatgtcttcaatttagattatatatcttgaacaggaatatcacagaagtgatacctcatcctatcagatggtatacaatttcatttggtctttcatttaatgattttcactttaatcctttgattaaggcaatatgtgccaacttctccactgtaaagttacttttcccattgtaatacatattttatatggaggtactttgaaatgatgtaaatatcccagttttcctcaaactttttttttttttttttttttgagacatagtctcgctctgtcgctgaggctggagtgcagtggtgtgatctcggctcactggaacttctgccttcagggtgcaaatgattctcatgtctcagcctcctgagtagcttggattacaggcatgcaccaacccgcccaactaatttttgtatttttagtggagactgggttttgccatattggctaggctggtctggaacccctggcctcaagtgatccgcccaccttggtctcccaaagtgctgggattacaagcatgagccactatgcccggccaataaacttttgatttattcatttgtttatatcagtatggacttatggtacctattttattcaatgggtaaaaatctatggttgtcattattattgatgtacgaattgtcccatgtttggctagtgagaggcccctctgtgtctttttgatgtgttcccatcattctttgaatccttttttacttcctgacaagacaagatgttccaggctcattttgtatttttcctgtcccatctctggaaccagtcctttctccaaggaatcctggttccttttgctgaagaaaagtatttagaagccaatatctcaatgctagttatgttcattgctattgaaatgtcactgctcccatgacatctcagtgaaaaaagctagagaatgtgtgtgggcatgtgtatgtctaggcaaatatatgcatatatatatttacctgcatatacaaacacatttacatttatatttctgtatcagttgtatatgttgaaaaccataagtgtacactggtatctccaattctagtctcataccacagggttaattttggttttctcccttttcctatttgtaatgcctttctcctatggtgagaaacctagaccctgccagtactctaccctgcacagatgccctccttgccccactcaagctccaacacctggaactgaatagtcttcctgtatagataccctccccaccctacttggactctggcatctttgtctgggtagctttttcccaaggtggttgcacaattttacactcctaccaactatgtatgtgggttctagttgctcctcattttcaccatttggtgttttagacattttggtggatgttactggttttaatttgcatttccctgcaattaatctgatgctcatctaatgatgatgagcacgttgtattattggccatttaaacatcttccttatgaagtgcctgttcaaatcttttgcccttttttagttgaattgcttgttttcattattgagttgtagacatattttatatattcctttacaagtttcttgttagatacgggttttacaaatattttctcacagtccatggcttacctatttattttcttaatggtatcaaattgaggaggttcccttctgtttctgatttgctgagagttttaggaatgtgttttgaattttgtcagatgttttctgcatctgttaagatgattggatagctttttgttggggtgatcagacccaacaccaggccatgggggctacaaaatccggaggagtcaaaggaatgagaaaagacaggttaagagagaaagtgggaacagagggccaactctagtatggaggctgcaaaggccccaagctctgggaggccatgctatttattgatgatcaaacaaagaaacaggtggtgaggatgtgggggttgaaaggaagcgatgtatcaagcaaatgagctacagctgtgatggtgtagcattttctttgaaacgtatggctacttgagataatgggtgtgctagaagcaaggagccagcaagtttagacatgttccaaaggccactaggtattttagaccctggaccccagacatattccaaaactcttttatattatgtcagacatgcaagccctgcctcagtttctctcccaacactcagctcttctcccaacatgccccccttttcttttttgtaaaaccgccacagctatcattgcttgttcttgacggcagctttctctccagcggtggcttccgcatctgcagactaaaaggagacagcacaagcacataattattagaacaaaatctgcaagtgtagagcttccaatggccttaatccacttaagaggattgaatgtagacaacccatcggctgtcttgttgaaaataccagttgtagggagcaggttcaagtgagcctgagaggcttcaaaaacctgctattttagttttacaatatcaagggtgagattttcatctctgccctccagatggcatttaagagtaacataacacaactttgaatccaaaaggtcctctttttgtttttgaattaattgagcaaggcaattgcaggctgtgcagctcttaattgcctgttggtgatccagcttcatttttcttagcccttattcaaaatggagtcactctggtttgaatgcctcttacatatttcctctttcccttttacaagaggacccttaattctaagggttgcagaaggatggaggtctgtcttctgtaacttcttcatgctgaataggggtgatgatattcctgcctacctgttagggtctcttgtatttagggtagaagggtagagaggaattcagtcagaaaacattggtccattaagcatctgttgtagctctgaatcccagcaaaaggtaaaatcctggcactccagcagtttctcagcttcctgtgtggttttcttgatctgtcccatgttatgggggttgatgtcagcatgactctggttggtcctcgttccgtcttcgtattcagattgacctggctcatggcttgtactgggggaacccggtccatggttgggatccatgggtccctccagtctcccgctccatggtcatacacaccttgagggcacccacacagttttttcatctcctgcaaaagtacaaacataccctcacccctacattagtaaatctactgaaacagaagcaaaggctttttttttttttttttgctgtagctgggaggcatgccattgctgaagcatttgtaactcagcttctgcctctttggttaattactgcggggtaaaagttaccattggtaatgagaagcaggctttttctgattaacagaaggcatagagaaaccaaatcgaggcttatccttcttgtgcaatagtattgcaaaaaagcaatccttaaaccttcaatttgcactgtacaggtgggtccactagatgctgtggctcatgatagatcttcagatgtttggtgggcacccacacagacacctggttgtcacctggagagacacaagcaaatcgtcttccccatataattatctttcctttttcccagctttttgtatgtgcatccctccatcatatatcttgtccagcctttttattttccttttgtcctgtcagttgttcagctgcagtcgtgggttgatctttttataaatttaaaaactttaatgttaataaagctaaatgcaattgcatttgcagtgtcttatattgctggtcccctcccttttgtatgtgagtttttaaagtaggattagctctttaagcaatgtcagtttgaaaaacttgctgttgaggtcctgcaaattaggcttttccattagtagatccatcagtaaaaacagtaatggctgctccagtgggggctttttgagtaacagaaggcagtatctaggatgttaattatagaaatggaaatatcttagatttaggataataattatcaagaatgccaacaaaaccggccaaattaacttgccattcttgcgaattaatataggcttgttgaatttgttgttttgttaatgaaactataatctgatttggatcatatcccattagctttgttgtgcgcagcctcgcttgtcctactagcacagcaatttgatttaagtacagagtgagcgttttggttgtattgtgaggtagaaaaagccactcaaccagatcatcctgttgaactataaactcctgtaggcaaatgcttagtaggaaaaactaaaaactgtaatggctgtatcagattaattcgttctacttgtgcttgctgaattttttcctcaattgatggaagttcctccaatgcttctttgaacagggagcatttactgttaaggttagaatcaccttgtaaagtagaaaagagatgagacatagtataggtaggcatgcctaaagttggatgaatccaattaatgtctcctaataatttttagaaatcatttaaggtttttaaattatctcttcaaatttgaattttttttttttttaaacggagtctcgctttgtcgcccaggctggagtgcagtggcgtgatctcagctcactgcaagctccgcctcccaggttcacgccattctgttgcctcagcctcctgagtagctgggactacaggcgcccgccaccacacccaacgaatttttttgtatttttagtagaagcggggtttcactgtgttagccaggatggtctccatctcctgacctcatgagccacccgccttggcctcccaaagtgctgggattacaggcatgagtcaccgcacccggccaaatttgaactttttgaggcttaatagcactttgttctaacttcattccttgatattgaaagggagtagaagtttggattttatcgggggctataattaaccctgccgcatttacagccttttctgtttgtagcacatcaattcttccctagtttcagctgcacacaaaatatcatccatgtaatggataatataacatttttttaaactgttctccaactggcttaatagctttcccgacataagtttgacaaatagtcgggctatttaatatgccttgtggcagtactttccaatgatacctgtgcactggtttgttattatttatggcgggaacagtaaaagcaaatttttcataatcttgggcagctaaaggaatggtaaaaaaagcaatcctttagatctatcactataagaggctagtattttggagtcattgttggggagggcagccctggttgtagcttgcccatcggttgaattacagcattaacagccctcaaatctgttagcattctccatttacccgattttttcttaatgacaaatacaggagaattccaaggggagaaagtaggctctgtatgtcccttttgcaattgttcctgcaccagttattttaaagcttccagtttttcctgtttcagtggccattgctccacccaaactggtttggcagttagccaaacaagaggaatgggagccagaggctcaacaatggccactgctaaaaatgatactccaatccagtctgatctgtttgtccttctgaaggttctgattggccatttttattttttcctagtccttctcctgagcaatatcccatatttttcatcatttgtccactaatatcactatattgatccataggaatagatatttcagcaccccattgttgcaataagtctctaccccataaattgacaggaataggtgtaataataggttggattgtccctgccatcccgcccttgacatggtaaaatcaagggacttgaaaaacttctgaggcagtccctacgccaacgatacccgtggaagtcttttgtctgggcaagtgtcgaggccattgatttaaagcaataaatagagacatcagctccagtatctactagtccttcaaaatcctttctctgaatagttactatacaaataggtcttttatcagacacttgattaacccaatataaagcttttcctgctggattagtactaccaaagcctcctgttctcttcactgtgctgcttcctagttttatgtagggtagcagcaacaactgagcaattcattctcttggggaggcagaccacggagtcgaggaactaataactagttgaatctctctggtatgatcagagtcaattattcccatatgcacagtgacaccttttaaatttagactagaacttccaagtaatagactgactgttcctgagggtaagggtcccctaactcccatggggaccttctttggtggctccctaggaaggagacaggaattgtgctgcagaggtctatggcagcactgtctgctgtggcgggggacagctgtatgtttgttaagggcactggctgtgccggatatgcctcagtttgttgaggggccgaaggcaggcccctcttcctatttcctgaaagaggttgtccatctttgctaaatttagaatggcactgatttgcccagtgattgcctttcttacaccagggacatacaccaggacttttctgttgatggatggtagtggtttttccttttgatttccatttctacattccttttttgtgtgtccaaattgcccacaattaaaccaagagcctgagaaacgggacatattctttcctactttcaatccagccatagccttagctaaaagagtagccttatgtaagttacctccaatgccatcacaagccttaatatattcagctaaatgagccttccctctcaggtgtctaatagcagtttgacactctgcattagcattatcatatgcaagaagctgtattataacatcctgagctgttttatcagttatggctttatatacagccacagcctcttggagccaagcaataaaatcaatatatggttctttaggtccttgtcagacaactgaaagaaggatatttttccccctgtaacatttaccctttcccatgcccataagcacacagagcacagctgaacaatggcaacaccctccattacttcttgattctctaatcgaccccaattagggccaactcccagtaactgttaaaaggaaacaagcacaggtgactgcacttgtgtgttttcccttgcctgagtttgagcttcctcagcccaccatgttttaaactgcaagtactgggacggagtgagaacagattttgttaaagtatcccaatcatatggtattaacctattatcaagagccacatttttcaacaaagttttcacaaaaggagagttcggttcatattgaataatggcttgcttaaattcctttaaaacttaaaaggaagagtggcccaattagctatattctgtccttcttgctgggtttgccatgcttcaaggtctccctcagctctagctttttgaatagaattttgtatagcaccaccaattgctccaggttttaatgttgcaactacaggaggagtaagtttttcagctgattcattttctcacccagtaagggggagagaggaggtggccattcacttaattcagcaggtggagctgatgggctagtaaaacatactttttttagttttcctttcttttctttaatctcctccggtagctgtttctcacactcagaatctgaagttagttttttacactcgtcctcctcttcctcatctgaatctgcctcatcatcgtttgaaatggctcaggagctacctttattagtgcccacactgaccaaatggaaactggaatttttgctctgtctttatacacctttttaaaatctcttcccgttgtctcccattcatccaactccatagtcccttgttccggaaaccatgggcaaaactgctttactgtactaaagagtgataacaaattctgagtactaactttcactcccctttgtaataaatgccttaagaaattcaaataagcaaaatgtttgctttaacttcatcccattgttaccctggttcttccaagcgctcagcttcctcaccgagcttctttcagtcgtccctgggtgtcctctgacgatgcatcctccgctttcacatgctctagcgttccttcactgtggtctttgtcgccccatgttgggtgccatgaatattggggtgatcagacccaacaccaggccatgggggctacaaagtccggcggagtcaaaggaatgagaaaagatgaaagaaagtgggaccagggggccaacgctagtatggaggttgcaaaggccccaagctctggaagcccacactatttattggtgatcaaacaaagaaacaggtggtgaggatgtgggggttgaaaggaagtggtatatcaagcaaatgagctacagctatgatggtgtagcattttctttgaaacatatggctacttgagataaggggagtgctagaagcaaggagccagcaagtttagacatgttccaaaggccactggtgcctaccggggccgtcctgacacatctattcttaggtatagaatttcaggtatagttccccccagcacttttaagttccattgtcttctggtcttcattgtttctaatgagagctcagccattatttgtattgttcctttgtatgttttttgttgttgctttcaagattttatctttatcgtagatctttagaagtttgattatgataggccgggtgtggtgcctcatgcctgtaacccagcactttgggaggccgaggtgggcagatcaccaggtcaggagatcgagaccatcctggattacacggtgaaaccccgtctctactgaaaatacaaaaaattagccgggcatggtggcaggcgcctgtagtcccagctactcaggaggctgaggcaggagaatggcatgaacccaggaggtggagcttgcagtgagccgagattgcaccactgcattccagcctgggtgacagagcgagacaccttctcaaaaaaaaaaaaaaaaaaaaaaaaaagggggtttgattatggtatacctaggggtgtgtctttttgtatttaacctgcttcagatagcaagcttcttaaatctataaatgtatgccttttaccacatttgggacgttttatgttactattttttctgcttcatttttttttcctcacttttgttctgggactctagttacacatgttttagatatcttgatgttctttcccagattgctggagttctgttgattctttttcctcttttttttccctactctatagcttggatcatttcttttggtccattttcagggtcactgactcttgtataattttaatatgcttttaaacctatccagggactttcttattctaggctttatattttttagtttgagatttgcatttagttgtttttaaaatttttatttctctaatttcttatctgtttgaccattacagatattttactttacatccttgcgcataggtatagtacctactttaaaatccttgtgtgctaattccaaaatctggatcatttcaggactggtctcctaggctcaagcgatccacctatcttggcctctcaaagtgctggggttacaggtgtgaaccactgcacctggcctgagtgaatattttaccactttataatattatgcattgttcatttagaaaataatggtttactgagttatgaagatcttccaaatgttgacacatttgtcgatataaaaagtcacattcagccctcctccctcctcactcgtgggccgggcctggcatggtatggcatcaccacagatggtgctgaggcacagcatggggcggctggggctcctgctgctgccgccacagcagctggggctgctgctggcggctctgacttctctgctgctcccagagtccgcagctgcaggcaggtctgaagctcgtgggagtcccggcaaagctgacagtgtcccaggggcagctggtaaagctcagctgcagcatggaggggatggaggagcctgacatccagtgggtgaaggatgggtctgtggtccagaactggttcatcccagtcagcgagcagcactggatcggcttcctcagcctgaagtcagtggagcgctctgacacgggccagtactggtgcaaggtggatgggggcgaaacccagatctcccagccagtgtggctcacggtagtaggtgtgccacttttcacagtggagccaaaagatctggcagtgccacccaatgcccctttccaactgtcttgcaaggctgtgggtccccctgaacctgttaccattgtctggtggagaggaactacgaagatcgggggacctgctccctctccatttgttttaaatgtaacaggggtgacccagagcacccatgttttcctgtgaagttcacagcctaaaatgcctggcctcttctcgcatagccactgttctccttcaagcactgcctgcagtccccttcaacatcaccgtgacaaagctttccagcggcaacactagtgtggcctggatgccaggtgctgatggccgagccctgctgcagtcctgtacagttcaggtgacacaggccccaggaggctgggaagtcctggctgttgtggtccttgtgcccccctttacctgcctgctccgggacctggtgcctgccaccagctacagcctcagggtgtgctgtgccaatgctttggggccctctccttatgctgactgggtgccctttcagaccaagggtctagccccagccagcgctccccaaaacctccatgccatccacacagattcaggcctcatcttggagtgggaagaagtgatccccgagggccctttggaaggccccctgggaccctataaactgtcctgggtttaagacaatggaacccaggatgagctgacaatggaggggaccagggccaatttgacaggctgggatccccaaaagggcctgatcgtacgtgtgtgtgtctccagtgcagttggctgtggaccctggagtcagccactggtggtctcttctcatgaccatgcaggccagaagggccctcctcacagccgcacatcctgggtacctgtggtccttggtgtgctaacggccctggtgacggctgctgccctggccctcatcttgcttcaaaagagaccgaaagagacgtggtttgggcaaggctttgacagtgtcatttcccggggagagccagccattcacttctgggcagcccggtccttcaatcaagaaaggcccaagtgcatcgaggccacattggaaagcttgggcatcaacagcgaactaaaggaaaaactggaggatgtgctcatcccagagcagcagttcaccctggctggatatagggcaaaggagagtttggttcagtgcggtaggcccagctgaagcaggaggatggctcctttgtgaaagtggctatgaagatgctgaaagctgatctcattgcctcaagtgacattgaagagttcctcaggaaagcagcttgcatgaaggagtttgaccatccacatgtggccaaacttgttggggtaagcctctgagcctctggagcagggctaaaggctgtcaccccatccccgtggtcatcttgcccttcatgaagcatggggacctgcacgccttcctgctcacctcctggcttggggagaacccctttaccctgatccggttcatggtggacattgcctgcagcatggagtacctgagctctcggaacttcatccaccgagacctggccgctcggaactgcatgctggcaggggacatgaccgtgtgtgtggctgactttggactctcctggaagatctacagcggggctactattgttagggctgtgcctccaaattgcccgtcaagtggctggccctggagagcctggctgacaacctgtatactgtgcacagtgatgtgtgggccttcggggtgaccatgtgggagatcatgacacgtgggcagacaccatacgctggcatcgaaaacactgagatttacaactacctcattggcgggaatcacctgaaacagcttccagagtgtatggaggacgttcttacactcccactccatccaagccaaggtctccttaggccttcagacgaccttttgtatgatctcatgtaccagtgctggagtgctgaccccaagcagcgcccaagctttacttgtctgcgaatggaactggagaacattctgggccagctgtctgtgctatccgccagccaggaccccttatacatcaacatcgagagagccaaggagcccactgtgggaggcagcctggagctgcctagcggggatcagccctacagtggatctggggatggcagtggcatggggacagtgggtggcactcccagtgaatgttgatacatcctcacccctggagggctggctgagcagccagggcaggcagagcaccagccagagagtcccctcaatgagacacagaggcttttgctgctgcagcaagggctactgccacacaatagctgttagctcacaggcagagggcatcagggcaatttggctggctctgatggccactgtgctggctgacaaagccctgtctgacctcagcccagacagcaaggtgtggaggctcctgtggtagtcctcccaagctgtgctgggaagcctggactgaccaaatcacccaatcccagttcctcctgcaaccactctgtggccagcctggcatcagtttaggccttggcttaatggaagtgggccagtcctggttgtctgaacccagacagctggcaggagcagagtgattatgtttccatggttaccatgggtgtggatggcagtggggggtccaggtccagccctgtaggctctaccgtcccgctgagctgctcctgctgcttaagtgcatgcattgagctgcctccagcctgagggcccagctgttaccaccctcggggtttaaatatccaggtttgcccctccaagtcacaaagagatgttcttgtaatattcccttttaggtaagggttggtaaggggtgggtatctcaggtctgaatcttcatcacttttctgattccgtaccctgtctaggccaggagaagttgaggggaggatgcttccctgcagctgaccgggtcacacaaaggaatgctggagcacccaggctataaggtgtccctcttccaaaggcagcgtgctgagccagcaagaggaaggggtgctatgaggcttgcccaagagcgagtgaggctggagaggagttcaggagcccctctccatgcccacaatctgagcatgctaccaaatttcaaaatatctttatttatttatttatttattattatactttaagttttagggtacatgtgcacaatgtgcaatttagttacatatgtatacatgtgccatgctggtgtgctgcacccgttaactcgtcatttagcattaggtatatctcctaatgctaaccctccccccctccccccaccccacaacggtccccacagtgtgatgttccccttcctgtgtccatgtgttctcattgtttgattcccacctatgagtgagaacatgcgttgtttggtttttttgtccttgcgataatttactgagaatgatgatttccaatttcatccatgtccctacaaaggacatgaactcatcattttttatggctgcatagtattccatggtgtatatgtgccacattttcttaatccagtctatcattgttggacatttgggttggttccaagtcttttctattgtgaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacattgtaaaagtgttcctctttctccacatcctctccagcacctgttgtttcctgactttttaatgattgccattctaactggtgtgaggtggtatctcattgtggttttgatttgcatttctctgatggccagtgatgatgagcattttttcatgtgtcttttggctgcataaatgtcttcttttgagaagttctgttccgaacagacacttctcaaaatatcttaagactaacaaaggcagctgtgtctgagcccaacccttctaaatggtgaactttagtgccaacttcccctctaactggacagccttttctgtcccaagtctccagagagaaatcaggcctgatgagggggagtccctggaacctggaccccagccttggtgggggaacctctggaatgcatggggcgggtcctaactgttagggacatttccaagctgttagttgctgtttaaaacaaataaaattgaagacttaaaaaagaaagtcacgttcgttaatataggcatgcatcacttaacaatagggatatattctgagaaatgtgtcattaggcgattttgttattgtgtaagcatcatagagtgtacttacacaaacctagatggcatagtctactaaacacctaggctatatggggtagcctattgctgctaggctacaaacctgtatagtatgttactgtactcaatactgtagacaattgtaaaatagtatttgtgtatctaaacataaaaagttaatatgttgtgctatgatgttacaatgtctatgacatcactgaggtgataggaatttttcagattcattataattttatgggaccacccttatatatgcagtgtaatgttgaccaaaaactgttgttatgtggtgcatcactcatcttgttcatcttgttagaagaatcttcaaagctcatagtcatcggtacaagtgttttagaattttgattttcacttaaaagttcaaattttgtccttgataagaaatactatcagttgttatctcagaattgatgaggtcactttattcacagtaagatatctgcgaaaaatgcaaatgcctgtcagattttctttgaagtaaaaattgtgtttcatgaaaaaagtacctggttcagcttgcaactcaaactattaaacaagtgctttccctcgagacaacccattgtactttggtatgaagtggaagtgctttctacattcttcacagtttgtcacacagaatattaaatatacatgtaatccaaggtcaagatttaataaggttaatatttttttttttttttttttttccttgagacggagtctcactcttattgcccaggctggagtgcagtggcaccatcttggctcactgcaacctccacctcccgggttcaagtgattctggtgcctcagcctcctgagtagctgggattacaggtgtgaaccactatgcctggctaatttttgtatttttagtggagataaggtttcaccatgttggccaggctgatctcaaactcctgaccttaagtgatccacctgccttggcctcccaaagtgctgggattacaggtgtgagccaccgtgctctgccaaggttaataattcttactgctttatcaaggaccttaggtgaaagtggctttaaaaaaaaaaaacaacaaaaaactgtgagtatgtggccatgaagaatgcagtgagtttggtgccactgacttgaaactaccactaaggcagtgttacccaccatcattttcacatcatcagtgcaaatgtcaatttggtttttccagaataaaccatgggattccaaaaagctatttaaccttttgagtatttcatcaccacttgtgttcattgccaaggattcatgtaaaaatattcttcagtgattccttgatatcaatactggacaatagaagtaaagcaggaaacacagtcatgtctacagacttgtcaggcaaaagtataattttgcagatgaaatattatcttcatattcatgtttacagctaaatattttattcagcaagttacgtaccactggaatgtgacagtgccatgatttgttttcctgatttttcaaagcaggaattcagcaatgtcacctttattagtctctcagcaactatacttctctaaccaatgaaatatgataacttaagattcttcagtgactttttcttttctagcttgaaaagctaaaataacagcttttggctcttaaactcatgtcatttatgttaaaataaaatccagtttagttttctctcaactctgaatgtttgttttgaaaatagtcatcacttcctttgcataagatagagtaaggtaaattattagcatctgtaaacctaagagaaagataactttttcatatatttatttcacacagtattttttagagtatatttctcttttccataagttagagaactctgttatcggtttcatctttttcagcatctttagacatggttgttgctgcagtgggttgagaaagttagtcttctctatttcagtataaatattatcaaaatagaatagttttagagaaatttaaaaatgaataaaagtttaaaaaaatgtaaatgttattgccatgtaagacaacagtgtatttcttgtgtttccttgcaggcacaaggaaacctttagtatttcaaacattggtttattgaacaataatgaaattatagaaattatagcagttttaactgtaagaacacacactgctgtactgtcctgagaacaaactaagttaatccctatatacacacaaatttatacctaaaatcaactaccttaaaaacttttaggaaacataaaaatacagatgcatacattctattagccatcagagtgatggtttctttaaaagtcttggcacctctgggaaactccattgcgcactgtgagagaatgaaagaaaaaaacggtaaataacatcttagtattactatgaaaataggtttgactttgcagaatccctgaaagggtcttggggctctcggggttatcctgaccatattttgagaattgctggttgtctaatagttttgtaatatattgtacagacactgaatacgttgtagagattatggattctgttatattcctattaagaatattaactttgtgttttagcaggcagttaacttggctgaactcaaattccagactcaatctccttatgttcagttcttttagtcttagcctggcagcctagagctcacctcatacatgcctaatgcgggggtcagccagagttttgagtggagtgtatgtacagagtttgtggttctccctctgtggttctctccttctggaatttttccctcactttccagctggtttggcagtcacgaatactgtcttttgtgtgtttcctcaaccaaaaagactgcaggtttctatccagagtatctcctttcggattggcttttatccctgtggggaatctgcaaatgccccaagggaggaaatggagatatatgctgggctcatttcaatgtgcctccctcccttacaggattctgcctccttcagtgctgcctgcctaagttgatctccattgtacttaaacagttgctatctgtgttttaaccagattttgtagttgttctcagcaggaggattggtctgatacaagctattcccttagggccataagccaagagtcctgaggcccagaattgaatgcattacttcacttgtgctctgactagtgcagagttggattattatctccctaaataatattttaattaatgctacttaataatgcattaggtttttggcagccatatcctactgttggcaagaattacacttgtggccatccaaaatctctcccctcccccacttgaattgcctgctattaaaccacatctcctttgtctaggaataattcagtatttctttgtttttaaagctgaacgcagtattttcatttattcttatttaatttgggtctgttttctctaccattgaagcctcttgaatcttttaaagcttgatttcgttttctactttcctttcaactttatattgtttgaaaatcctctcattttttgccactttgaatagctatggaaagcatcatcagcactgctctttctgatgatcaatagtaataagttccctacttcataaagtaaggggacacaaagtctgatttggttatcctcacaaaataatattttattaatttgaaaaaaatatgtaatactcaaaggatgccgtgaattttgttatttttttaaatgcttttttgggtcattcacaataatttacatatgaatatgaaagattatggaacaattcctagtatgcttatggattcatgctctctgcaagaattcagacccagtgataggaaaacactagtcagttcatagcttactattgtaacaaagacttcttctcctctttattttttattttgaaatgatttcagacttacgaaaagttgaaaattaaaagcagtacagctgagcaccgtggtgtacgtctgtagtcccggctattcaggagactgaggtgggaggattgcttgaggccagcagttagagactgtagtacactatgatcatacctatcaacagccactgcactccagcttgcataatgcagcaagaccccatctctttaaaaaaaaaaaaaaaaaaaagtactctgtgtgtgtgtgtgtatacacatacattttttctgaactagttgatagtaacatttatagccctttacccctaaagacctcagtatgtatttcctaagaatagaaatattctcttatataaccaaaacacatttatataccatatcccaattttgtcagttcatattctgattccaattttttattttctaatggaatactccagttttatcagttagcctaatacagaatccactttagggccaagtattgcgtttagttgtcatctctttagtcttaagttatatggttgtggtaagggatggttcttggttcttatttagtctcagtcttaggcagatcctctgcacttgggcctcagagtgaggctttctcagtgttcttgcccctgccccctgcatctctacctatggcagccaaagtctgctttatctgtagtgatggtagcagtttgagtcatcctgagaaaattcaggtgaaagataaaggctagaaagataggctgaaacgaggtgagagtgtgtaaataaaaattctggctgtgtgaggtggctcatgcctataatcccagcactggaggctgagttgtagaatgtacaataagtttacctgtgaagtagaaggaaacccaggagttcaagggtgcagtgagccgtagttgtgacgctacactccagcctgggtgacagagtgagaccctgtctctaattatataaaaataaagtcaccttaataaaaaagattctatatggtcctgtccatttgctagatgtgggctgcaaatttggtttttagaagccaattcatattgggaaacaagatcagtgccctgaggtacagtgtcccaacgtaaaaacaaactaatggcacatgggaagtatcatttggcctggtatcaagatcagagagagagatatatcccttgagtccttataaagaaggctctattgattgacatcctcaacaatacctttactgtaaataagacagtggtttcataggactgcgtttttaataatgtccctcagtgtacactaattgcctaatattaagtgcattttcgtgagaggcagaaattatgtgatttcgtatctgctgttcaggcttattctagggtagtgactagtgatctagttgtagaacccttcttcaaaggaaattttatcaggaagccccatgtataatatgggaaaaagtggagttgaagtggggtggtatatctagagtgctactagctcagctctcgccctttctcattttcctgagacagtctgtactacacctgtgcggaatgactagcgccctgagcacattatcagaactactgtccagagaaaattgttgaattgcatagccccagatctctacaaatgtgtctatgggaactgaattctgatttttgtcgtctattagtatttcaactactttattttaaattgtcaccccttttaaaaccccttatttagtatcattatcttactctcagaaactgaccattccttctacttcacaagtaaacttactgtactttctacataagcaaagcaatacaaacaaaaatccagcttatctacatgtggataaaaaaagagggcctccctttttaattttgctaatatgtctgcttttcctctggaccccatcattttgtaccttctttgagacagtgttccattagttaccccatcctccgagtcagagtctctcctctattggccccttttctatagtcttaaaaagaaaaccctttatctgcccagcagcttcttttcctcattacctactgcccctttcacctctcttgctaggctaagcttgaaaatgtagcttatattcgctgtattccttttccttcccattcttttctttttatttaaaagtttatatataaatttatgaaaatataaatatatatacaatttacatagaaataataaacactaatgttttcatccctgaatttaagaaacaatattacagtactgttgaaaacccttgtgtactcttcctttaatacacattttttcctcccctcaaaagtaaccattactggctgggcatggtgggtggctcacacctgtaatcccagcactttgggaggctgcagcaggaggatcatgtgagctcaggaatttgggaccaggctgggcaacatagcgagacctcctttctactttaaaaaaaaaaaaaatttagttgggtgtggtggcatgtagctgtagtcccagctactcaggaggctgaggtgggaggatcacttgagccagggagatcaaggctgcagtgagctatgattgtgccactgcactccagcctgatcaacagagcaagaaaaaaaaggaaaaaagtagccattatcctaaatttgattactattgtttcaagacatttcatttttactttactacatatctacagatccctaagcagtatatagctgagatttttcaatatgaatatgatgaatgatttagaggcataccagatgttgatcctctcagcctttggaacagtggattttatgaccagccttgttcgtgtaccatacaaatgttatcttctgtgtgccatggtataaaaaagttggggagcactgatatataatattattgtgtatatttttgaaattatcattagtaatgtcctatatatgttctttatcttttttttcaatccatcttacatttgtgaggttcatctttgttaatgcaggtagcatttttttcatttgtatttcatttatgtatggtattctattatatgaatttatcacactttacctattttcttattaatggttgtttatttaagtagttataatttcttgcttacaaataatgttaccatgaagattattaataatgtttacttgtatgttagtgttttactagagaaatatgccttggggtgaaattgctaattgtagagaatctagctttaccagattttgacaaattgttttccaaagtggttattccagcttatatttaccaacagttttaacagctctctgaactttgcttatttacagttttaaaaaaacttttgcagttcttgagataggcggtagttctgaagatgggtggtgatggttgcataacaaggtaactgtacttagtttcccagaactatatattttaaaatgattactgggccgggcatggtggctcacacctgtaatcccagcactttgggaggccgaggcgggcggatcacaaggtcaggagattgagaccatcttggctaacacagtgaaaccccgtctctactaaaaataccaaaaattagctgggcgtggtggcgggcgcctgtagtcccagctactcgggaggctgaggcaggagaatggcatgaacccgggaggcggagcttgcagtgagccgagatcgcgccactgcactccagcctgggcgacagaacgagactccatctaaaaaaaaaaaaaaaaaaaaaaaaattaccatggactgggcgtggtggttcacgcctgtaatcccagcactttgggaggccgaggtgcaaggatcacctgaggttgggagttcaagagcagcctgaccaacacggagaaaccccatctctactaaaaatacaaaattagccaggcgtggcggcacatgcctgtaatcctagttacttgggaggctaaggcaggagaatcatttgaacctgggaggtggaggttgtggtgagccaagatcacgccattgcactccagcctgggcaacaagagagaaactctgtctcaaaaaaactaataataataacaataataataataattttgagaacggttttggattttaagaaaaaaactttgttttttttttgtttgtttgtttttgtttttttgagacagagtcttgctctgtcgctcaggccagagtgcagcagcatgatctgggctcactgcaacctctgcctcccaggttcaagtgattcccctgccttagcctacctagtagctgggattgcaggtgtgtaccaccacgcccggctaattgttgtatttttagcagaggcggggtttcgccacgttggccaggctggtctcaaactcctgacctcgttgtgatccacccgcctcggcctcccaaagtgctaggattactggcgtgagctactgcgcctggcctgaatttaannnnnnnnnnnnnnnnnnnnactatggtaaattttatgttatatatattttagcacaattttaaaaaagctttgctggcctgatgggaatgaaatctcactgtgctttttatctgcttttctgtgattactagtgagatatctttacatatgcggaatatccatttatggtttttttccctttgaatatttaatgttaataccatttgctcatttttctattaagttatctttttcttactgattcttggaattttttttttttattttttgagacagggtctcactgtgttgcccaggctggagtggagtggtgcaatctcggctcactgcagcctctacctcctgggttcaaacaattctcccacctcagcctcctgagtagctgggactacaggtgccctccaccatacctggctaatttttgtatattttttgtggagatggggtttcaccatgttggccaggctgattcttggaagttctttatgtattctggatacacatcttttgttggttatgtgtgttgcatacattttctttcatttatgtctgtcttttccattttaaaaaataataccttttgatagagcattaattttaatgtggttcaacttatttttttcctttttgatatgtattttttgtgtcttatttaagaaatcattcctaagttagggttgtaaagatattcacctgtatttttttctaaaagttttaaaaattttgtccttcacattttggtttataattataatctacttgatttgatttttatgtttaatgtgaagtgagtattccattttccccccatgtagttaatcaggtacctcagcaccatttattacacattccctctctcctccactaatgcacagcatcatcttttacatatcaagtttatatgtatgcaggggtctatttctgggccatctattctgtcccattggccagttgtttattactgtacccctactacacttaagctttataataaagttatctggttgggcagtatctcccttctcagttctccaaaatgtttttagctgttggttccctgcgttactttacagttttagaattcatttgttaagcttcacagttgaaatattgatcggaaatgtaggtataactcattatccagatgtagactattactaaaattgtatagatactaaagcttcagagaactcagacctatattttattatcttaatagggagaattaataactggttcacagtctattcaaaacttcaaataattttccctcaattacaaaatcttaaaacacttttataagaatcccagttcatgtaaaaatctgcattatgcatgtaaaacaccagttacttaacacttattacactcattatttggtatgtttttggacagaatagtgtggaaactgtacagtatcagttatttcttctacactgctccaaacacgtaccataatgtaaataagcaatgagaaaatatgttaaagatacatgatgaatgcaaataactcttagtgaataaccaagaccacgtaaaaaaaaatgtactgattaaagagttgcctgagttagatttggtggtgagaagtgggagaaggggctgttatcatggttgcggttcagtggtgagtcaaaatgtatggaaagattctagcaaaggagcttactattggatcctaagaagtgatggacagttttctccactcctgaggtccagaaatagatggctgtgaaccattgtctgcagtcttagatgaaaaaaaatctaaaaaaatgtatgtctccttgtgttccttttgctcgtggttatagaatgtgagcataagatatggtcctgtcaggaaaatagctgagatacagctgctgagtagactggatggtctctcttagattcataagcaccttaaatgtgcactcctacaaatccttgatagttgtttttttaaatttgaatagtgactcctgggtttaaaaagtacatattgtaacaaatattcagatagcgaaaattcttcaagtgaggaacattggatgtatagattaatttggaaagagtcaaaatctttgcaacatttgatcttctatctgtgaccatgattttatttctccacttgtttaggcagtttcataatttttgttataaaagtatgtagatatataggaatgcaattgatatttatatactgctcttactaatttatctgtagattttcttggatgttgtacatacacagacatatcttctgggaataatgaataatgaaattttgcttcatctttttatttaattttcttttcttttttttttttgagacggagtcttggctccgtagcccaggctggagtgcagtggcatgatctcggctcactgcaagctccacctcccgggttcatgccattctcctgcctcagcctcccgagtagctgggactacaggtgcctgccaccacgcccggctaattttttttgtatttttagtagagacaggatttcaccatgttagccagaatggtctcaatctcctgacctcgtgatctgcctgcctcagcctcccaaagtgctgggattacaggtgtgagccaccgtgcccaaccaattttcttttcttattgtgttagctgtggcattgttgaacggaagtggtgaggataaacatccttgtccttcatttcaaggaaattactccattgtttcaccataggtattatgttggctgtctgtttttagtggataccctttatcagattttaaaaagttccctacaataggcagtgtcatagaatagttaagaatccagactttctagccaggttgccaggattcagcccttggtgttgccacttgctggctgtgtgactttggacaaatcacttaacccctctgtagcacagttttctcaactatacaatggtgataataataattcatacttcatactgtagtattaaagattaaatgattttaaagattaatatgtaaaacaggcttaaatgagttaatatttatataacacttaaaaactgtgcctggtatatagtaagtgctgtgtattagccatttttacagtactgtcataaatccttgttttctaagagattttgttttattttgttttgaaattatgaacaggtattgaattcttatttctttacctgaggtttgacacacttactggattttgttagcacattaatatttgttgaacttaatagagtctcagatttacgctacaactagcatttaatttctatggccttttaaaggttggcgtatttggtggtagtttccatttaatacttatttctagattgccttctattagcttttttgatggtgctgaccttaccttcctaaccacctgaacatataagcatattgcaattattaaagaatctgttttctaatgccagggaaatgtgttcttacgcttagtgcaacttcttagtgggagtagattattttgtgtatattttggtattttactaacagaccaactgtccattcataatggtgagactaagtgaatagaagtcagtttaaagttaccaggtgaataagcagtttttgaaaaatgtatcaagataataaattttgtttctgggttctcttttgaaaattcactattgttgaaaagtctgtgtaggaacaaactttatagacttacttgtatacagctaggactgaatttatgggctgcctttctaacttgctaaaaagctgaagattgacagctgctttcatagtgctttatctagcttggcttttaactccaagagaactgtgttcacaaattgatgctctgttcctttggggttggtatagaagcattaaattgtactaaaatattcatatgtgagtgcatttagctgaaagcaattgatgttttgttcccaagaggacagagagaaatgctgtatggacctgtactccagaaaaaaccctaagcatgcttcttaaaggtaattacatggcctggattatcaaagcccatacagtgaagtttaaaacgacaaagaagaagttgtagaatttataaactgtggtttgtatatataaattatttggttgtacaatagttaaaaacttaattgccaaaaaactaggagttttaattatatctttggtttgtcttctcagctaatttttactagactgattgctctaaacatttattccagaggtccaatatcagtgaagttctttatccattatcattttattatataaagttaaaaattgtaagtttcagagagtgttgaattcctttttacatatatatggtaactgtttaaaagcatgccaccaataatgataaattgacatgtcttgtagatagtgaatctaatttaacagctgacatgaaaatcaataagagtagacagcagtctttgtcgtagctgtgttggtgtggtaacttgaaagaaataaaactattctaaatttctattcttattctatgtaattttgttttttttttttcctataaaaaccaatgtattttctcatatagtttcaggtatgataaatgggcacatgaatgtcaaagaacatgagacactttactagaaaatgttgattcaatggataattggtcatttagcatatgtaattcagtactgtgttcacctcaaggccaaagatacaagcactgaggtgtagagaagaagagtttaataacatcgtttaactatatattaatattaaccaaacttagtctgaaaggaaatttgggaaatagtatttgagacaggagggtatactccacttccttaaagtgagattattttagaggatcttaggttgtatagtaaatttatttttaactggcattactattttccatattacaagctctactccaattcttacaattttagaaggtgcttaaatgagtttttcataagtctttggtctgaacttcacaactcagatagctttctcttaaataaacattttgagggctggatgtggtggctcacgcctgtaatcccagaactttgggaggctgaggcgggcaaatcacccgaggttggcagttcgagaccagcctgaccaacatggagaaactccatttctcctaaaaatacaaaattagctgggagtggtggcacatgctgtaatcccagctacttgggaggctgaggcacaagaattgcttgaacctgggaggcagaggttgcggtgagctgagatcgcaccatcgcactccagcctgggcaacaagagtgaaactctgtctcaaaaaaactaataataataacaataataataataattttgagaacggttttggattttaagaaaaaaactttgtttttttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactgccagctctgcctcccgggttcatgccattctcctgcctcagcctcccgagtagctgggacttacaggggcccgccccccatgcctggctaatttttgtattttttagtagagacagagtttcaccgtgttggccaggatggtctggatctcctgacctcgtgatccgcctgcctcagcctcccaaagtgcttggattacaagtgtgagccactgcgcccagccaaataaactttttttgagacagggtctcactctattagctaagctggagtggagtggtgccatcacatctcactgcagcttcaacctcctgggctcaagtgatcctcctgcttcagcctcccaagtagctgggatcacagatgtgtcccaccacacccagctaatttgttttttattttttgtagagatggggtcttgctgtgttgcctaggctggtctcaaactcctggcctcaagcgatcctcccacctcgacctcccaaagtgctaggattacaggcatgagccactgcacccagccttcaaataaagtttttatttgacctgctaaaatgcaaagctttgtaatagacttgattacatgttcaagtattttgatatcatagacacaaatatttcaatgtaaattaactgtctgaatagttttaggtaagtatataataatatacttggcttttcataatttcaggtacacttaaagtgtattttcccacaatggaaaatctctgaactggtatagaagcaaattaggtaaatgcaaagcatttaattataaaattgttaaatataaaaattatatttaatttattattattaatatttttagaggtggggtcttattctgttgctcaggctggagtatggcaacatgagaccatagttcactgcagcctcaaatttctggactcaagaaatcctcctgcctcagcttcccaagtagttgggattatagacgtgagccactgagcacagctgaagttatatttgaatgtgaaactattctcttaagaaaaaaaaaacttgtttcaggtcctatacatcttgcataattgaaatctacaattagaaaacattgaaaggccaagggttgaaatttcactttttttctgatttacatttaaatttttgaattgtgtttcacaatatagttaatgtccttgttttaaaaaaattcttttaactttgtagttgagcaactgggttattaaatttacattttgaacaaaaaatgtgaggtacataatgaagtgtgtgctagtgatatacatcccacctgctctggacatattagactagatgtgaagaagacatttgcttagttccctatatgtcctgggagaaaaggtaggctgattaaaagaatatggaggagcttatatctaagaatgaatttgaatttaagatttcaaagaatctttgactacatattctatcactaaaaagaaccaagtccatctactgagccatggaatctccattcatgtgaaaaatcttcagaggctagataagggcccctgcttttcttccaaatgcattttctggctttgcctctagacatttccctttagcagttatttggaaccagatattgacttcactgaaagccagatcaaaatctttagctggaaagtattaattttcagtgcaggttacataaattaaaagaaagaaacatcatcaacaacaacaacaaaaataatttcggagccttgcctcttttgtgagtcagtctccttgaagggcttccagctggtgcatgtgtgtggtgggtgtgcattagaggctttctaattgacatgcaagtggttgatagagcaataaatctaaacagtgtagcttgtcattattcatgataaggagacacagagctaatgtacaaactgatacttttagcaacatggagtaaaagctaatgttagctaaaattgacaatactttttttttttttttttaatatgtacaaacttcagttggctcttcaccaggtctcatcttgttttagggatctttctctaagataaatatactttgtggacttttaacagactggtgacttcagctaaagcatattaccaatacagtaataatattgagtcatatgtggtatagaaaaagtgctgaatttagaatcaacctaggttaagaagcctgccttttgagagtagaatggtggcttccaggggctgggaggtgggggaaatggggagatgttggtcaaaggatacaaaatttgttatgctggatgaataaattctggggatctattgtacagaatggtgactatagttaataagagtggattgtatacttaagatttgctaagagagtaaattttaagtgttctcaccacaaaaagtaattgtgatgtgatagatatgttaattagcctgattgtggtaattatttcataatgtttacctatatcaaaacatcacattgtatactttaaatatatataatttttatgtgtcaaatatacctcagtaaagctggggagggagaacctgccttttactaggtgtgtataattttggacaactcagcaagcctgcctgagactctgctttctcttctataaaataggaatcatttctaccctatagagttgttgtcatagttaaatgaggtcgtgtgtataaagtacagcatagttactggcgtaacatagacagtacatatagctgtgatgactagtgtgttgtcttgaattctaataaaacaggagctaatcttagtaaaggggtgttgtctcatggatgggatataatttcagcttcaaaccaagagtatgggtaaaatcttcccttcatgtgaaactcagtttagccagaatcccacctgagaatttcataatacgggcagagagctgtttgagaaaagagccacagatagttgtgctttgagttttggggcctcttccaaaaagagaagagacttaaacaggatttggcaaacaaaggaaatagtttggccttttaaatgagcagcaggatgaaatatagcaatattaatgcacaggaggctccaataattagaaaatatagtttggttaatctacttcccaaagacacattcattatttgctatgataaattcatttaactcctaacctggcatttgttatgtatatgtatattatgttttatctataacagttgctgtttaaggttatggctgtgtagtctattgagaaaagaaggttgagaaagcatttgccattctgtataactcttgtcctggttgaggcagtcttaggggtattgtttttttgagcacataacattggatctctgaattctagatagaaccacttacatgatgtgtttaaatttttatttatttaaagaaatgtaagttttcatgttccttccctacctctatctagaaaggaacacttttggcagaaaagtttaaaacttgattttttaagagaggaaacaatattggcatggtatttctgctctgaatgctccagatttaaccaccctactcatattcgtatttcatataaacaaaaagtaaacatttaaatctctccattctactgtgtttaaagtaaagcagatctgaagttgctgcaggcagaatactgttccaattccagaaaaacatgaatttatgattttatatcataaactcacataatttcaacttcatatgtattatatttttaatatgatcaacttgatatgtcttagtacttgcatctgggatatgtatccttgcacaaagattgtgttagaaatctgtaaagaaatcatcccaacttcctaggcaagcactggctaggaagctgggcagaaattctaactttatggtcagtactaaatgcaaagaagaaactaacagctgtcaaagaaaatttttcccagtacactcccctggaagaattgtatcaagttagtaacaactttcttgactatagatatatagatagtaatagttaccattttaaagtgaaatttttgacagttggctgtctccttttctgtttagaactataacattaaaaatgccttctagtttagagatttgatgatcattttagaaataatagcattatagaaatattttgagtactttatgtgcatcttattttcatcatcacaacaatcctattagctgcaggtatttgtctccattttacacataacagcagttgagcctttgagagattgaataatttgctcaagaatgcagattggtaagtgggagagtcaggatctgaacccagctcttatttatttaactgtaatgattgaataatgtagtagtttcttttacctcctcattttcaactttcttgagttgagatctgagcttactaattttccatcatccttgttttctaatatgcgtttgaggttataaatccttctaagtatcggccaggcatggtggctcatgcctgtaatcccagcactttgggaggccgaggtgggtggatcacctgaggtcaggaattcgagaccagcctggccaacatggcaaaaccccatctctactaagagtacaaaaattagccgggcgaggtggcacgttcctgtaatcccagctactcaggaggctgaggcacgaaaatcgcttgaacccaggaggcagaggttgcagcgagccaagatcgtgccactgcactccagcctgggcagcagagtgagactctgtctcaaaatcaatcagtctttctaaataccactctagctgcatcccacatgttctgatatacccttccttttttggtgttttgttccatgtatttttaaatttccattttaatttttttgactcacatatttcagatacttttaaaatcttttttagaactgtgagtttttgaggaaatatttttcaggtccatctagagttttaagaactaaatataagttactggagaacaaaatttgatagagagttgctttttcagagtataaactgatcatgttaaaccagtagttttcatctgcttttggttttcctataatgggccacaccacctgaaatttgatagatttttgtcatctatttgtgactctctatattggctactcttgtttaatgttgctgcctctaatgctaatcttcagctctgccacactgctgactttcctttttggttcacgttcccattgagcataatagaacctgtaaatggtcttgttctgagccaacagaagcaacacagacacataagacaatgccattctgtctttagatctgttgtcagaccatagtccacggttccctagtgaagtttacaagaaggctctttagtttgttctatgattattttggatttgtgctgcccagtatgataacctctaagccacatgtgattattgggtacttgaaatatagttagtctgacctgagattacattattaaaaattaattttacctgtttatttttactttaatgtggccactagaaaatttaacattaaatatgtggcttacaagatatataagtatagatgtatcgaataactctgtttggggcttaacagtgatgagcgaaaatgcaatgtagcagaggacagttttccccttagcttctacatgaaattctggaaaagcagagctcagataatacatcttagaattccaggtttgggcacgtgttttgggtaaagcaggagtgatgttagtatatacttactttctgaagaaagcagccaaaaacctaatcatccaccagagaacactagccatgttgaatccacaggttggttagatttctgtaaaagtctgaagatttcattccaatcatccctctaattctcagacatgcagttttatcattaagccaggaccattaaaacctgctttaaaagcttgttttgtctaaaggacttaagggagcaggaacagatggggatagatggcaaaagtgggcccctgtttgtcagaaggtaaagatattgtcccctaatctgttttctgctcctaacggcttttccacttctcagtggcaggtaggaaagtgaggggctgatgagagactgtagctctatcacacctcttttccattttcctttattggattacagatttttgtgaccttgccgtaacctgtaattgttagactgtgagcttcttgaggacagggcacagagaattagtcatgtttatattacctgtaaggtacagtaagaatatcaacaacagtaaaatcagttacccagtgctgctcaactctttcctattatggtacacttagacagttagaatatttgtaccacaggggattctggccacccagtacttcaagtccacacaactcttttgtacaaattataaagtactggtgtctcaagttactttactgccatctgttggaaagttattgtaataaaaatgcagggctatagtgactgttaagagtggtgccctccttcagagttattcagtgtgcagcctgctcagctgtacatggtagtcctgaggctacctcaggagcccacctggccacctagtgggctgagaaaatcaatatttgaataaacctcaacccgtgagtgacacatcaatgtgtcttgggaaatctgatactatgctaaggacgagcctcaacagtaaccctataaagcaggagttcttataattccagtgttttggatgagcagtctgaggcatagagaggttacatgaatggcccatggtcatgcagctatcagatggcagaggtgggatttgaatggaggcaatgaggctacagagcctaggttcttaaccacagtgatacggtaaacctgttaaaccgcatcagatgcaacagtttctcagtcctgctgccctttctatctcagcccactgtaactagtttagacctcagcccctgagttctttgaatgagtctataggttttggcaaaggaagaggtatttgtgcttttttctgccagtacttgtttgtgttaaggttaagtgctatcccttctctatatttcagaataagctctggtcctcttcccatcctgtggctttacttctccgcacagcccctattcttggcatcacagagtgatcaactcagactgctatcagccacctggggttgatccattctcttctaaattctcactcttctagattctaaagccacgaggcctatctctaggactctccctccttctttctgtttctgttggttcctttaatccccaccgtgccccgccacgccttgtataacccttaattgctgtactccctggcaacatctctcactttctctccaaatggtcttactatctgatttagaaggaaagtgcctcagggaagggattgtcttgttatgttgtgaagcagcatctgaagtgccccataaattagcatctgtagagagttttgtgtatactaattattattattattgaaatacaaaaatgctttctgaaccatgaggaattagactaagatattagtctaattgcctgtacatgttttttaaaaaggagggaaaaagcctctcttcctgagagagctatcagagcctcagagcagccgccaaaatccctatacttgttctgggttattgtttcagtgcttttatgtttattcagaggaccatgtttgcaagacagtaaaataaagtcctgttggtcatgtggatccatttggaccatttattgtgatcagaaaggtagaaatggccctggagcaactgccttcagtttgttttggcccagaatctcttatttccttagtgacacttatggttaaagtcaatggaattcatttttggggacacagggggttttaagtaatttcatttatattatgtttatgtttactgccagagtgaatcaacatttttattagcattttataatgcacatggagcttttaagacttgaatttgctgtagacatgtatgacagaaagactcgtttacaggactactggtcttttccaatgcttgctttgagaatatacctaaaagagtggtgtctagctaaatagcttgctttaaaaatctttatgttagaatttgtttgccgggtttttctgaatatgaatgttagtatattttgattaacagtttaacaaatgtccctttatgaatgaaatgctagtcagaataaactgaggtgaccttaaaattacctattgaaggctgggcgccgtggctcatgccagtaatcccagcactttgggaggccgaggtgggtggatcacaaggtcaggagttcgagaccagcctggccaacatagtgaaaccccatctctactaaaaatacaaaaattagctgggtggggtggcatacacctgtagtcccagctgctcgggaggccgaggcgggagaatcgcttgaacctgggaggtggaggttgcagtgagccaagactgtgccattgcactccagcctgggtgacagagtgagactccatctcaaaaaaaaaaaaaaaaaaaaaagcctattgaattacttctaaatcttaaatagaaagtagtggaagaagtttactacttatgcaagtgtccatgtctgagagacagtatgatgtcagggcctccttgcattgtccgactatgtagggtcacaattgacacactggatacattgaaggtagaatcacagagcatgcaattgctttttatcctcatccatactttctgcagcattcctccccaccctaagacacagtcttattacgccaaattgttcttgtcttcaggcttttggtaactatagaacaagttgattcaaaaaacaagctcatctcatttttagatgattaactcactttggggactagattgtttccttttccaggttacatggtgctgctctaggagcagttggacactttatgcttgtaaagatcagggagtactgcagggggctagacagttgtcagattcaggctgccaaagagctgagggatcacttattgtagtggttctccagctctggctatacatcagagtatcctggggagctttctttacaagcaccagtgctggaggtgtacctcttctgtttacaattggaaaaagtgagcccctgagaggtgaattgacttgtatgtggccatatacaattaggtgctatgaaaaatcatgacattaggaggtaataacattattttcagatcctagttgaaatgctctcttattttggattgagcaattgttaaatgagatcataagcagtgcagaaaacaaggtgggaccaccttgacactgtcattggcttttgaagtatctgccctgtaataaaagtaagtataacagaaccaccttcagtgccttccacatattattcatattgaggagagactttactgtcagttgtgacaaaaccttagtgtcagtctggttacatggtagttatacctcctacccaggccaggacttgtttgttcagtttttctgtgggaaaaggttttcaagtgaagctttaatcatacctggtaaacagaatgaagcaggtaagctcttctaattaagcacttattaaagtgcttaaagtttttcataatggaagtgtgtttttattttcaaacaaaggcactgtaaaaattttagataaggagacagaacagtgtcagtcatcattccctttgtaattattgagggcagaggggcaggaagaggtacaaatatcatcaacatttaccaaaaaactatggtatggaggcctttttgttaggctctggaaacacaaaggttcagcccatacctttgagaagtttgttattttttattcagagagaatgtgtgtgtgtgtgtgtgtatgtgtacgtgtgtgtgtttaaaatctcttgatagtaatttgtatttctggtttttctaaatacaaagtttaataaacatatcctaattaccattttaacaaatatccttttgtgataaggcgaacaactaagccaaacaactaagtcaaaaattattttaatatatttgagtatatgtgtttatatgttaatatacaatgtgtgtatgttgttaatttttaatgggtatgtacagcatgtatgggttgtgcagtgattttcaagtgagtgccacagatgaaaaatgctacctcacaggtaattgtgagattgagacacttgatgtaaaatgcttaacactgtgtctggcacatagtaaatgttcagtaatcctcattatccacatatttattttactaccattgctataggaattcataggaaaaagagaactgtaggttaaggagatcagagaaaaagaaaagcataatttaagcaatacattttgcctctattttatttaacatatcttttgcctaagacttaaattgctaacagcaaacactttggaaagtattatataatataaatacatattaataatgtgacctcttttatttcaggaactttatattgctgttggaatatctggagccatccaacatttagctgggatgaaagacagcaaggtaattgtacatcagtgatgttaaaagaaaacgtttccacattttaggatttggcttaccttgtatgtttccatgtagttacaatgcatgtagtcaagccattcacactaacgtagatctgggaactgaaagaaataaaagctaccgttcactgccttaaaaattattggtcacagaggcagtgctgtgtcatggaaagaggcctgaacctgagttatagctccactgctaacttaatgcatgatgagtgctgtctgcaaactcagtttctttgtctactaaatagtgggtattgaatgatgatcactaagttgcccttcagctatcacaatctgtggatagaaaatatcagacttaaacaatttgatgaggttctgaacgtgtaacttatttttgaggttttgatccctgattctctctctgtctgcttcactttggtcctgtaaccctcacaatctcatatatcagcagggccccacttcttgggttgttatcaaagtataaccaacacattttgggttggagcatcaggccatcttaatatctcagtatctcagtaattatcaaaagtgcaataagtatggggccgggcgcggtggctcacgcctgtaatcccagcactttgggaggccgaggccagcggatcatgaggtcaggagatcgagaccattctggctaacacggtgaaaccccgtctctactaaaaatacaaaaaaaattagccaggcatggtggcgagcgcctgtagtcccagctactcgagaggctgaggcaggagaatggcgtgaaccgggaggcggagcttgcagtgagccgagattgcgtcactgcactccagcctgagtaacagagcgagactctgtctcaaaaaaaaaaaaaaaaaaaccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcatccagcctgggcgacagagcgagnnnnnnnnnnnnnnnnnnnntcgctctgtcacccaggctgaagtcgcccaggctgggagtgcagtggcctgatctcggctcactgctagctccgcctcccgcgttcacgccattctcctgcctcagcctcccaaagtgctgggattactggcataagccaccgcgcccggccaggaaacacttgattttaacttgctacttggactactctgaaagtcctgtgtaatgattctgaacatatatttcagaatatgacacattaattcatgcataataatatatagtttgaattatgaacttacctttcatgaagtcagagatgcctctgacattcctgcatttatccattcagatggaagcttgatataaaagattataaaacttttaacaggcttaacttcttctaatttgaaatgcatgcactacctctttgtagcttctaaatgaactggcccaaaaccagtcagattttacagttggatggtaggtttctttactgaactatgaaaacagcagtgccaatggggaaaatgtgattgctgcattaagaaaaaataaataaataaaagaaagaaactccaacaccagcagccttaaagtatatttttagccagaccagttcagacatagctagaattctgcttctctaaaaataaaagattctgcctgtcaagaagataccagtgaaaattctcaccccatgccaacagggctgaattgtgggagagacactaggtagtgtacgtcagagcaaatagggaacagttgaagtaaggagactggtgttgggggtcagccaagactttgtatctccatctagtcaacagatgtttattaagaccattccttgtactagaagctgggaatgcttaaaaagatatagcccttgttgtcactgtcttatcctgttgtctgtgtcgtcctgtgttgtcatagccccattatctgcataggagacagtctttagttctaaaatgggatattagaatggtttaaatctgacagttgcattccctgcaagctgcaattttaattagaatcctggtttagttgaaggaattcaagatttgattgttaaatcaaatgaatctaatgaaagcactttctgaactaatacacagtaatatggttgaggccacgtgcaatcccagcactttgggaggccgaggcgggcagatcacctgaggtcaggagatcgagaccatcctggctaacacgatgaaaccccatctctactaaaaatacaaaaaattagctgggcatggtggcgggcgcctgtggtcccagctacttgggaggctgaggcagaagaatggcgtgaatccaggaggcggaggctgcagtgagccgagatcgcgccactgcagtccagccagggtgacagaacgagactccatctaaaaaaaaaaaaaaaaaaaaaagtaataataataatatggttgaatacaatctatgcatttcaaagcttagtaaggaggaagaacttgagcttgtgaggagctattgagagagctttggatacaagcaagactttatcatagttctttacaattgattatttaggaatattattttaataatctgaagaacaataaccagccccacatcttttttgttaaatactgtagtggttccttgcccacagttatatgctctctctttaaaaataacttttaaggcaggcatagtggcactgtaatcccaaggcactgtaatcccagcgctttgggaggccaaggcaggaggatcacttgagtccaggagttggagagtggcctgggcaacacagtgagaaccccatctctccaaaaaatgaaagaattatctgagcatggtggtacacccctgtggtcccagctactcaggaggctgaggtgggaggatcacttgagcccaggagatcaaggcttctgtgagctgattgtaccactgcactccagcctgagcaacacaatgagaccctgtctcaaagtaataatgataataacaattgttatatagtataatgaaaaagctttcggatgattaaactcccagatgtctgactaagtggcctctagaagaataatttaccatcaataactaaacaaatctctgcttatcgccgtgaagcaggttacacattcccaaaagagaaacacgccaatgcaaatcaacacctgcaattcagaatgtttgttcttgtgcctttggatttgaggctcacgtttgaaacttgtttattgtctctgactatgcatcttaatgtgtgtagcatgtttctctggattagcagttacctggactataccatgttccaatcttagacattctggcatcttctgcacatctctctgaggaacccctctaagggaaatacacagatgttggatatcctgtagcctgtattttaagtcaggctacatcaaaatacttaatgtattttttaataccagctgttttcacaacatacaatgccaggtaggtagaaacttaattttacttctagagatttgaattatttttagtccacaatctattaaaataatactacattagagtctaactgcagtggtgttagaagcatctgtggggaataccaaactatttgtactgataaactatctgatattaataaaagaatgatttgaatgatagcttttcctttttttttttttttttttgagacagagtctcactctgtcacccatgctaacatacggtgcacaatcttggctcactgcaacctccacctcccagagttgagcgattctcctgtctgagcctcccaaacagctgggagtacaggtgcgcaccaccacacctggctaatttttgtgtgtttagtagaggtggggtttcaccatattggccaggctggtctcgaactcctgacctcaagtgatccgcctgcctcagcctctcaaagtgctgggattacaggcataagcttttattttttattgtagagatggggtctccctgtgttgcgcaggctggtcttgaacgcctgggctgaagtgatcctcccacttccacctcccaaagtgctgggattataggtatgagttaccatgcctggcctgcatttaagaatatttttatagcaaataagagaaatgtttgacagcttttataagagatataagtaatttgcttcttttattaatctatttgctatgtacataaggacttaaagctgtttaacgtcccttactaacaggctgacaagatactttagctttcatattgttagaatatcccagaataattgttttattttattctattgtattttattttatttatttatttatttttgagacggagtctcgctctgtcgcccaggctggaatgcagtggcgcgatctcggctcactgcaacctccgcctcctgggttcacgccattctcctgcctcagcctcccgagtagcttggactacagatgcccgccaccacgcccggctaattttttgtgttttttagtagagacggggtttcaccgtgttagccaggatggtcttgatctcctgaccttgtgatctgcccacctcggcctctcaaagtgctgggattacaggcgtgagccaccgtgcccggcctatttatttatttttatttttgttgagacagagtctcactgctggagtgcagtggcgtgatctctgctcactgcaacctctgcctcccaggttcaagtgagtctcctgcctcagtctcccaagtagttgggattacaggcacatgccaccatgcctggctaatgtttgtatttttagtagagacaggttttaccctgttggccaggctagtctcgaactcctgacctcaggtgattcacccgtcttggcctcccaaagtgctgggattacaggtatgagccactgtgcctgtcctccagaataataattttaaaataataaatgaaggacaaaataatttgcactacaaaggctgtggatttgggtatagatttgttactttttcacctaaaatcaaatattttttttgtaagtcaaaagaagaacttttaaaaaataatgattttaaactctttaatactgagatgggctagatgtgggtaagagagaattttattacattccaacctggaaatttctaataaatttacagtgttgacacagatgcctcaaatcttatttggtagacattttaagaatattaatatattgtaagggaagttaaaatagaactatcagtctgtgtgaaatgttttcttggtaaaagtcaaactctttgtttttatttcacagacaattgtggcaattaataaagacccagaagctccaattttccaagtggcagattatggaatagttgcagatttatttaaggtaagctggccttgagagaaattgctattatctagattgtcatccgagaaactctcagaaatggttagggatgaagctattaaaagaaaacattgtgtgtttgtgtgtctgtgtttgtatgtatactgttaatatatgtacacaattttgacctacttaaagttaagttgctctaagagtagatatgtgttgtttatatagagcattataactttccttttaagaaagagtccaaattgtctttaaaatatccacatggcggccgggcgtggtggctcacacctgtaatcccagcactttgggaggcggaggcgggcggatcatgaggtcaggagatcgagaccatcctggctaacacagtgaaaccccgtctctactaaaaaatacaaaaaattagctgggcgtggtggcaggcgcctgtagtcccagctactcgggaggctgaggcaggagaatagtgtgaacccaggaggcggagcttgcagtgagcagagatcgtgccactacactccagcctgggtgacagagtgagagactctgtctcaaaaacaaaacaaaacaaaaaaaacccacatggtttttggcatctcatgtgctaagttaatgcacaatgtgaagtgattcaagtaatttataacctggaatcatatttggcaggtaccctaaagaaattaacatcaaacccccttattcagggatttgccaagaatgctagagcttttcaggggagagtaggcacccatatccagcttatctgtctcaataggaatgctctgcttgctgtgtttgtgggttaatggccttccttagctgacgagtgtagggagagcacttatttctcactcctcacactcttcacttttgagtgttccttctctcttgccgtcacctccatatttgaccttcccatgagaaaaattactttcatgatattaattagtgaattacaggtgatgagcacctgatactcatttggctacatttaaaggtcatgactcatgcgtggcctggtctcttctttttcctgggtctgcctacacgtttctaggttatcttatgcagaaatcacttatgcaggaattgacactctgaaaatagcatccaaccctaggagaagtgggtttgctggggtgaggaacccctcatgtagaaccacagcgaggggctatgggccttagtggagaggcttcagcctgagaacagagctacaggtggttccctcagcaagaggactggcccatttctgtgacttcaccagcactgcatatgatctagaggaacctagtgagtgtgcttggagagtacatttgtactttgaagtatgttcatgctcagtgaaggatggaaataggacccttgagccgattactccgtgatggctcagactgcatgcaaagactaggatggggctcttgctctggctcagtgttgggcatacttcccctcagaaggcccccgccaaagagcttagattttggcttgggaaaaacattacccctcttcagtaaccctgaagctctgtatttggtatttgggattcaggtaggtcagctgctcatgttgcctggcccaagtgtgtaagaacaaacagtaatgccagtcattttcccactaagatgttccagtgggaaggggggctggtatgaaaaagagaatttttttttctctgtgtaatgataactttgttcacgtagtaagaattcagttcttactattggtgtgaatagggggtaaatattatttttatttaaaagcaaaattaaatactttctgaacctcatccatgtttgcaagtagatgtctactgtggttgccttttttcctcaagagaatattttaataaacttgtaagtaattttgttacatttttctgtctgcctgtgtactatgtattaaaactcacatgggggctttcatgataaaaagataaactgttaagcagttggaaattttcagtgttcttccagtggacacctgccttggggcaggagcttctttgtagtcattattgatagaatggggtcacacacattgtgctcctgcattaagggcagctccaaggtttggcatgagactatgcatgtgtgtggacacggaggtttctcagtgagaaagagtcctaagacagtgaagtggaacgaggccttaaaaatcatctagtcagctgacttccagtttcaggttctcaggctccttttggtattttaggaagcccacattggactagagagagacttcagaccaagatatcatgtttatgttcttttagctagaattgtgttaaggcaatgactatctcctacagcttagaagttctgaagtacatggccaggagcggtggctcacacctgcaatcccagcactttgggaggccgaggcgggtggatcacccgagctcaggagtttgagaccagcctgggcaagatggtgaaaccctgtctctactaaaactgtgaaaaacacattagccgagcatggtgatgcatgcctgtaatcccagctacttgagaggctggggcacaagaatcacttgagcctgggaggcagaggttacagtgagccaagatggtgccagtggactccagcctaggcaacagagcaagactctgtctcaaaaaaaaaaaaaaaaaaaaagttctgaagtacagttatatatgtatttgattaatacaaaagtagagaagttaatcactccttaaaaaatgcagtttgggaggccaggcacaatggcttatgcctgtaatcccagtactttggaaggccgaggaaaggcggatcacttgagtccaggagtaggagaccagcctgagcaacatggtgaaaccccatctctacaaaaaatacaaaaattagctgggtctggtgacgtgtgcctgtggtcccagctacttgggagactgaggtaggagggtcacgtgggcccaggagattgagacttcagtgagccatgattacaccactgcacttcagcctgggcagcagagtaagaccctgtctcaaaaaaaaaaaaattcagtttgggggaaaaaaactaaagattataaaaatattaaacatatggcagactcctctttgttaccatgtgagtaacacaagccaggtgcattctttttaagttgcctgtcccagagagatgtgatttgggacaatccacaggttatgggcacaactaagccagggtcctgcttctgttccccttctctctcatttctctgcctctctggctcagcaggtactacagctgggtggctcaccactactattgtaccttggataaggtgcagtaaaaatcgcacctttgacagactctaggaacctacagagtacgcatgaagttgttttctcagctgaaatcagaatgagcttattgtaggtgaatactgtagtaattctgacacaagagcacagacaaagtggtttggtgaatatattccttactggggcgatctcgtttttaaaaaatcaaatatttaaaatattttaaaaatcaaatatttaatacttttgattaaaaaataaaaaatacaatatttgtataattatatttcttaatgttatatattttatatttttaatattttatttttattttttgtattttatgtattgtaattatattttaaaattataattttaaaaaatatatttatataacattaagaaacatataaggtaatatctttatataacattaagaaatacaattaattatacaaattatgggtgagaattaattagcattacctattttggcttatgatctaaagaaaatagaagtcaaataatagcgtacagaaaggacttttttagcctaatttttgtgtgaaaattttaaattgcaaattgtatcatgtataacatgtatatacagctgttagactaataattccctaggtgatattttgctcaccaagtagaaccgtatctggagtaaaaatgaatatgcataacattttattctcttatattaattgttttgcttgacccttcaacaatcattagttataaaggacaagtttgtttttccctcagaaataatatgttatagtaattaagagctttaattccaattctgccttggccacatactagttaaattatcttggctaagttatttaatctctggacatcagcttgcttgtaagtaatgtaaatattacactacctctttaaaggttgtaatgaagattaaatgagattatactgtacctaatactaatagagtctgtgacaaatattagcctgcctgttctgtccaggtacatagtaggtgctggtaaatattataattgtagtcacagtgatagggcatagggcaccacctgttttttgtttgttttagtataacagctttactgagatataattcacgtaccataaaactcaccatttaaaaatgtacaattcagtgggttttagtattttcacagttacacaaccactatcacacatttcatcatgccaaaaagaattccatacctgtcagcattcactccctgttttacattctgcatcttccagcccccagccccagctcctggcaaccactaatctactttctgtttctatacattggccagtcctggatgtttcatataaattgaattatgtaatatgtgatctttgtgattggcttctttcagttagcataaggttttcaaagttcatccatgttatagcctgtgttagtactttgtttctttttcttgccaaataatatccattgtaggggtatgtaacattttgttcattcatttatcatttgatggacatgttgggtttttcccctttttggctattatgaatgatgctgctatgaacattcacatatgaggttttgtgcagacctatgttttcatttcttttggatggatgtctaggaatggaattgctgggtcacctggtaactctgagtttaacattttgaataaccgtcaggttgttttcaaagtggctgcccccttttacattcccaccaaaaatttgtgagggctccagtttttctatatactcattaatgtatgttattgtctgtctttttaaatatagcccttctaatgagtgtgaggtggtatctcattgtggttttgatttgtatttccctgatggcaaatgacatttagtatcttttcatctgcttattggccatttgtatattttgtttggagaaagtttatttagatcctttgtaatttttaaatcacattatctttttgttcttgagttgttagtgttctttatatattatggatataagtccctttttgaatatttgatttgcaaatagtttctcccattgtgtgggttgtcttttcactttcttaatggtgtcctttaaagcatgaaagttttaaattttgtcaatgcctatgaaaaagggggagaaaaagttttaaaataaagttttaaattttgatgaaatccagcttaccaattttttctttgttgcttatgcttgaagtctcatatctaaaaaaccattgccagccaggcatggtgactcacacctgtaatcccagcactgggaggccaaggtgggtggatcactcgatgtcacgagttcgagaccagcctggccaacaaggcgaaaccccatctctaccaaaaaatacaaaaattagctaggcatggtggcacgcacctatagccccagctactcgggaggctgagatggaagaatcatttgaacttgggaggaggcagaagttgcagtgagccaagatcatgccactgcactccagcctgggcaaaagagaacccatctcagaaaaaaaacaaaaaacagaaacccattgcctaatctatagtgtagtgaacattggcctacaagtatctgctcaagcccctgctttcagttcttttgggtatataactaggagtagaattgctggatcatatgataattctgtgtttagctttttgaagaaccttcaaactgctttccatagaagttgcatgattttacgtttccaccagcagtacacaagggttccagtttttccacatcctcagtaacacttgttattttctgttttttaattctagtcatcctagtaggtgtgaagtggtgtctcattgtgactttgatttgcgttttcctaataactagtgatgttaagcacataagcatatgaaaagatgttcattggccactcgtatatctcctttagggaagtgtttatccacctcttttgcccattttcagttgggctgtttctctttttgttgacttgtgtgaattctttacatattctggatactaaacacttatcagagatatgatttccaaacgttttctctcattctgtaggttagcttttcaccttcttgagaatatcctttgatgtgcaagagttttagattttgatgaagtccaatttatctttttttttattttgttgcttgtgcttttggcatcatatctaagaatccattgccaaatattgggtcatgaagattcacccctgttttcttataagagttttatggttttagctcatatatttaggttgttgatccattttgagttaatttttgtatatggtgtgaggtaggagtccaacttcattctttggcatgtgattatccagttgtcccagcaccatctatctgttcaaagagactattctgttcccattgaatgaacttggcaaactacttatctttctaaaccttcttttgtttcctcttctcccctgtagtcactacaatctctttactatctctggaacctgcagttgtttatctctgtctgtgcctcattttttgcctagaatccttttcttctttagtttgatgttctgaattttcctaatccacactgatcttcctcagaactcctgaatttggagcttttaatgctattctcttctccttctcctacattccagtataagctgaggacacttctgattgggtggttcataggcctctctgtctatgcttgccaactaggaggcagaactcctctgtcactcccacagtgacagagagcttctctgtttcccttagtactacctggaggaagtactaagtgaatgagtgaaacatacttgtactgtgatttatatcagtaggttgtctttttttaaaaaaacttaagtgacttttattgggtcttactgagtagggagctgcctctgcaatatctaaaagagaacagaaacaagaatccagatctttcagtgtgctcaggccatcagacactcaatgaacctgagttagcatttcctttttcctaaataaggcatcatgtggtatgctttaaaggtgtgcagttgggctgggtgcagtggctcacgcctgtaatcccagcactttgggagcctgaggtgggtggatcacctgaggtcaggaggttgagaccaacttgaccaacttggtgaaaccccatctctactaaaaatacaaaaaaaattagccgggtgtggtggtgagtgcctgtaatcacagctacttgggaggctgaggcaggagaattgcttgaacctgggaggcggagcttgcagtgagctgagactgcgccattgcactccagcctgggcaacaagagcaaaactctgtcttggaaaagaaaaaaaaagtgtgtggttgatctaataaaaaaagatagatgatagagaaaatcctctcaaccctttcatggggagtgtggtaaggatatattcggtaaaattttaaaaagttatatattctaaaccaaattagtgtttcacttcgtggtaaaagtagttgggctttatcttatttttcatgaaatatacaggtcccgtgtgaaactcagttagcatgtcatctgtgtgactggcatgagctcatggtctctccactgaggaaagctgggagaagtggtgccagcacttaatgccacccctgagcaaatgcctgctggctccatggtaaacatgggccttttaataggctggagacagtgacattcggaagaaacaacatgtcgacaatttccttaataaattttgtacgaacacattatttccacctaatggaaatgtagctctcttaaataattgagaggctgtattcatcagtggtgagttcagctggaatctttgtgagctaaggcagccgaaagccccttggaagactgggtaattgatattttgcacaagtggctggaccagttttcagagtatctgtgtgacattccctgcagcccccttggacagctctcctctgtccaagcagtcacaaagcagctctacactggaagctccagttgcagccactgcactgccacgactaagggttagtaattaatcctttttaaaatgggagccaactcaggccatttccccttgctgtggtttcttactgtgtctgctgaccggccactgcattagcacacaaggtcttgattttaataaagagtgatgatattgaatgttcagcatgtagcacatttctgtgtgccagatgatagtagcatgctgctgaaaaagcaaccaatatgtttgtgaaatgaacaatgaatgaatgaacgaacagtgagagaacaagtataaaggaggttggcaggagtcataattgcagtaagctagagactttggtgtggacttggaaggaaagtcaggaatgcagttaagggtgggaagaatgccaagcaaaacatgaaggtaaatacacagtactcttcacccagacaagaaaaattgggcttcctgtttctagggtgccttcttgaaatttgtggttgggtcacaaagccaaaaggtagcagtgtgtgcagtggttcacgcctgtaatctcaacactttgggaggctgaggcaggcagatcacttgagcccaggagttcgagactagcctgggcaacatgacgataccccatctctacaagaattagacaggttggtggctacttgggaggctgaggtgggaggagtgattgaccccaggaggtagatgctgcagtgagccataattgtaccactgcactgcagcctgggtgacagagtgagagcctgtctcaaaaaaaaaaaaaaaaaaaaaaaaggcaaaaggcacctaggcaatgagtgggctgtaagccctgtcagccctgggtcctgggtagtcgccctgggtgggaagagagactaccggagaacagggggttcctggtggagaggagggggccctcgtgcctcaacagtgatttgtgttgtttcttttggcctccctgtaatgcttacggagctgtgaccatatcacagtgaaggctctagttgcttaattactttttgtttttatttgcaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaactatcagaaatatgcctagcctctagagaaaattgaagaaaaggagtaaaaattttgtttatttatttatttttttgcctttcttgttcatggagagctctatgttttaggaagattgtaaacatgattgtctccaccagcctaatcaacctactaatctcattgttgaagggcaaacttcataggagaaggtaactgaattggcaagtgcagagttaaaaaagcacggctataaagcatgaatattatcttaaacatactccagtcttcagaagaccatagctaatgtgacaaaagcagacctgacttaaacctgacccagctccatgtatttagttggcttaaggtaaatttcattttccgtttaattttaaggttttgtcagtttataggacttttgtctgtaaaggagggagagtggaggaggggctgctttgagacagcatggcctctgatgcaagcagatagtttgatgttattataaacattcaaaatcctgtgcagagaatgctctagcctttcttttgccttctgttggcttcttttgggctctcttaggaagcacccaggcctgtgtagtcacctctggcactctcattctgctgcccagggcacagctgaggtccaagagtgtcaccagggctgcagctggtgtggatgcaggcccaagagcagaggctggtgaggctttgaacaggcctgcaggaaggcgtgggtaggtaggtgagtagaacaaagagggctgccctcctgaatcagatctgcagaagtaggagtagtgacctggatcaagcagacactagggaagagaagggaagtgataagtgatggaggtggctagagtgcctttgtgtgaccagcctggggcccttccccagctgactagtgaaccctttctgatttgtgtcacaatcagttgctataaaacacttttaaaagttgtatctttggcatttcagtcttcttttaatgagatgagaggagagcagtagaatgatgcctctttgcaagtaatgtctgttagaatagaagaatcctagaatgtctgagcccggtgattatctggtcagaccccttgttgtatagatgggcatactgaagcacagagaagtgaagaaggtaaagtgacttggccaaggccacatggcttgaatcacctttgggagagtaattcctatgtcttgtttttatctgtgaggttcttcctaagagggctaaccttgctcaagattttttccatttacccctcatccctgttggatgctataactgggggacaggagagatggcaaaggtgatggccacagaggcacccccagtagaaggtgtgctggctcagggagggacatcccaggtggtgcctcggctcagagttgaactggttggtctttctccctttgctccctcctgtcatggctgccctgcctcagccccaagcagctgttcactggactagtatttacagctcatcatcatcatagcattaagtataatgcttactatataccaggcactgttctagcactttatacatattaaaccccttcagttctcacagcaccctgtaagttagatgctattattatccctcttttacagatggggaagctgaggctcaaagaggtcatataacttgccttaattcggacagcttataaatgagagtcaggatttgaaaccaggcagactggcttcagagtggtaacttcactaaggacgtgattctccctcacctcagctcaagggacagtgcgactgcacagcagcctcaggtaaagagcactaagtacttcatgctgggtgggaggggcacatttaggaccctggttgagaaggagggatgggtgttctggaatagtccctccagtgggattttattcaactcaaaaagtccctctgagtgctcacttagagcttatcgtaaaaaggcagccatgtgaggtggaggcaagttgttaaaactattatatatgcaagaggcacacatatataatgtgccctt

SEQ ID NO: 16393 - DNA, 19296 bp, Human
gcagcttcaggatctgagggatgggtctcggttcttcctccctccctgggtggctggggcctctctgaacttctgctgccttctccatctgaggacgcattgtgagatccacaccacaggttttcttgttgtgaggatgtgatggaatgtggaaatgtctgaggcataataggtgttcagcaaacagccccttctaccctcctccttatgtgagagtttaacgagccaggtgcagggagaggaggatgcccaggagaacctgctgcatcaaagctggagggatgtggtttatcaggaatgatgggagcagaacatccgctccgtactggctgctttaagtgctattgacacatcctcctttcaccctcacaagagcccaagagccccatgatactgttgtccccactgtacagatgagcaatcagaggttgaagttggcagcttatccaaggtctctccgatggtgagtggcagacctgagagtcaaactcacatcttaaatgtcattaagcacagcctgtgtatggagaggctgagtcccagagaagaaaactgaccccacccctcagtgtgggcagattcaagcctggggagaggcaagggagggggcagaaacttggagggtagatggacctgactttaggttctagctggatgacttacttgctgtgtgtctctaggaacttggaggatagatggacctgactttaggttctagctggatgacttacttgctgtgtgtctctaggaaagtttctcagctctcaaacctctgttttctcatctgcaagatggggataatattaaccaactggctaggtcatgaggattaaatctgacaactctacctaaccgcctggtgcagccaggtgcccacaaaatgggcggccctgccagacttctgaaatagttgtgcctcccaccacaaactgtctgctattgactgagaagagaagcatgttctcttccaaactcaaagacccttatgttctggaagatctctgtagcaatgaagagtgccaccttcaagctgctgctggtccaggccaagggtatattgaggtgggtccatccctcacccagagtgtgtgctgaggcatattgcagcccatattttgaggggtttttcctgctattcattttgtgttgccgccagagaaaactaaactgcagctcctggctgtcggggaagagctgtgcttctgccagggctagtgtgcctggcaccagctcaggcatgtaccagagccgaatgccgtttgcaggcaaatgtacacacaaaaagattccagcacacgcgtgcaccagccaacacagagttgccacggcacgcaacagcgggccatgcacgtgcctgctgactcggctgtcatcttccgactctcttccgtgatcagaagactgtctcagcctctgtctgtctccacgtctgtctgtctgtggatcagtgtgttttgagtctgacagtctacctggctggtttccttttttcttgctctgtccctctctccttgtgtttctacccatctccctatctctgccactctctgtctctgtttttctttctctttctcccctcctttgtatcactccctaggtccgacattgcctctttctcgatttccgattctctctgagtctctctctctctctctctttctctaactcttctgtctctgtccttccctgtcttctttttcctgtgacactctcctggaaacgcatcaaaaactgaagtggccggatttcaagtgacaaacagcactacacccagaatccgccccctccccaacacggctgccttcctcctccacatccctgtcacgaagagaagcctattgtgtcaggcccagggagttcgagttgaagggcctgggggtctgtgctctgactgctctcagccacttccccattggctcccagcagcctgtgctcagcaagggctgagcgacaggggaggctctcgtccataaaaggggggaagaggcaccagaactgccatttgaaggggctttggtggtgttcacagctgcctctttggcacctcctcccaagccggagtcaaggaggcccctgagccttggaccagccactgccacctccgacctgctcggccagaagctgcccagggacaaagcagagtgcaggtaacatccagagggggcactggaattctatcgcttggttttatttgcttattcctggtcctctggacctagagatggtgggagctcgggctggggattttaggtttgggtctgattatctagcaaaggtggttacagttaggaggctagttcacaaaagccagaccagtgagagactgctctttggactctccctttctgcacagtcctggcttaaacaggtggtaagctctctcccaagaggaccaccctttggctttagctccagggtctccttcttgcagtctcccacacagcagttcccatgccattcccagggtctggggaaaatgggacaccctggatgggagaagtgagaggtttcactaatcagggtgattttaaaggtcaatgagtctcactggacttagagaacaatggcttgaggacattaatgagatccaaggctctggcatttatcacataacatgtacatcaatgtacggccaggttcggccttttcattcttttcggattgtgtttaattgctgacagggtgctggtttgagcggcttcttttgatggaatttgatacaggttgaagtttggggatgttttgttggaagggaatgggaaaagggagtgacaacaagccaggaggcccaggcttagcaggcattttcttgtccattttacttggaaaggacttgttgctctcctattaactacagccagaggagtctaaggccaggaggaggctcaaagggaaagccatttgctcactggtccagagacccatattcagaaaagtaccaagtctcaaagtttgattctagcaaaaagctgatgagtttcaggaaaaaaaaaaaaaaaaaaaaagcctgctgactactccaaggttgaagagtaaattctgcaactgcttactttttcctgggtatcaagaatccctccaagctctacaaacattacttaattaagtctccagtcttcccaggggaaacaagctctttcgattattggatctgatttcaattcccctcccacagactgaaagtcttcattatcatctttcttccaagggttgctgaaatatacaaggcttgcctttctaatttgacaggcatcccagtcgagatccattgcaaagcattgcagaatgtcgatcctcttctgttctttctcaccccaggcctcactcccacccctctgtggcaccttccttctcttttcccctcctcttctccccccagtcccaccacaccttgcctttgttctatttttgcaggtcatttatcttcaggctttgagatctgcgtggggggagctgttgcagcagcccaagccggtgagttatgctgcctgggggtggtttgcgttcactgacgggatctcaagcccactgctttgccccagctgagctagaggtgtgataggtggcaggcaaaccctatgcctctgttggcagctgggagggggatgtcacactggttcccaaggctatgtggcggaaggcagcacattttaagggagcaggcaaagggatcagctctggggctatttgagagatttgcgatcttaaaacacgtggaaggagttaaggtttcttgaagtaactcctgggaggcaggaattttccatctgtcatctacacgtgtgtctcacaacacctgaaacagtgctgggctgaaatcccagatcctaccactcacttactgtgtgactttggaacagtagaagtccctctctgagtcatactttctttacctgtatgatgagaataataataatattcacctcctaaggttattgcaagtctccaatgggatatagcaaaatgcctggcattcagtaggtgctcaataaatactggcatgactgctcagattttcactgttccgaagtggtgaggttggacctttctctccatcgattatcatatcgctgatcatcccactccatcatgctgtgtgctatgtccaggagatatgatctaatgtctaatattttcatttgaggggctggtgctcctttcccctccccatcccagcagaagactttttatttcatctgctgcatcaggatcatgaagtctctttttgatcgatactccctaaatccacctcccactacccacctccttgggtcattcctgcacaattgtcgtatttattagatctcttccatcattgtaagagagatcaatagttactggttcgatttcaatgcatgcctgacaaagtgtggttacacagctgatttctctcactgtattcactcatctcagcccatgaatgttggctaatcttgctgggtctgacaaagtgataaacctgtttcactgagacagagctggccactgtggtaggcagtgaacatcggctggagacacccaggtaagccccaggatcagaccctcgaaatggagtggggtctgttagtgctgtgaagcgcagcctcatcagtccctcccagcctggatccagactgatgctcctggcaggaggacgatggcctaggtccatgaggcacatggcttggctcagggggctcctccgagtccatccaggtcatcccactggccagagcggctggccacaagccgcagacatatgcaccgaggcaatttgttgatgcattggcttgaactgccatttggtccctgtcctattcctggacgatttgatttaacttgacagcggtttactgagcagttattatgtggcagggtctcttgcccactggtccctaggaacaaagggcagactcagagagcagcaggagggagagaattggtgtttgtgattcacacggtatgtcagcatcctgaatcaaaatctactctccctccccacttctctctctcttattgtgttcacttcccttcccttttttccctcttcttcccctcctcctcacccccttcccttctattcccatttgtcctctccccatctctatgtctcatcttattttttcttcccatatggtcctccacctctctctgctttttctcggtgtctcggtctctttttctgtgtgtgcagttctcacctctgccattcttttgggcccctgtctttttctctgtgtctatatctctaactctctctttttacatctctctctctatgtctcttcatctccatatctctctagcttatcctctttttgcctttctccccatcccttaattgcaccagataacaaaaagggtggcggttccatccaaaccttgctcttgaaaaacgttcttttaaatatgcagtgaatgatcccaccaggaccactgcctgcaaggccgtctttccctctggtctctgcacagcaaatgcagccgaccaccaaacgggaccctcatccgattctgtgctttgatctttgccaggctaaagtgtgggtttactttctgttcagaacccgagcctccttcccattgatcattcgtctttcgttacgatgctaacacctaacaaggggcaccgcttttccaggttcaggggctccctttgccaaccacctggagacccacaagggtgaactttacactttcgagtgtggggcaaaagcttctgaaatggtttcaacgtcaggaatgtgagagtttgggaggttatccgaaagacactcgatacatatttaggcctcaggatggtttgtggcgtggtcagcagactgactctgaaatcttattctgctgtttccttgcttcttggtcttggcccagtcttttagactctgagcctctgttttccccatctggaaatggaactaatagttcccaacccactggattctcttcaagagaagagagaaataattgagataaagtggacagcaaagagcttgtcccttctcatagctacaccctaaatgaggaatgcgatggacttagagaattccaactctgccatgctctgtgaccacggagaggcactttgtcacttgatcctcaccttcccatctggatcccaagctgtaatattagcccctgccccgtagggtccacgggaggcacctggagtgcacggggctggtgcagaacagcgtctcagtccttgctggctgttaggatggttgtcattgcagggtcattgaaacaatggcatctctttagtgggagtcacggttcaggtgtgggaggctggagttctgtctccatttccctcgtgactcatgatatgaccttaaacaagtgacttcatttctaccttttcccatttcctctttcatcaaataggggtaatcatatgcgctaaagtgctcagagagataattgcaatgttaaatcaagccattattattccatgctggctttttaaataaaaacgcttgcggctcctctgagccctcagctgactacaatatagaaatatcatcgagaagccaagacgtcaaaaagatcattccctttcaaggaactctgggccctgggtgaaaagagggtctaccttgtgctggccctttaagcagtgctgtctcagtgcaggaagatgatacaccccaatcacagatgagaagactgaggcttgtggaggaggtggcaccaaatgaccgcagagcccatgcctttccctctcaaggaaaaggtaaatcccaaggcaagcctccccaggtcctctcagtatttgccaggagagcagcccaggcaactagaaagggctcagggctgaagaatggggccagttgcttcctgcctcttccatcaggaaacccacctgacctcctggcaagagatccatccactagcaagacataaaaaatgttttattatttaagaatatgttcaagtgcctgaggactcaagaaaattagcttaaaaactattagaatcataaaatgtttataaaaccagtcaaagtacggtcagcaaaccttgtctgtaaaggaccagagagtaaatattttgggctttcttggccctacagtctctgtttcagcaattaactcagcttttgcagcatgaaaacaaccacagacatagatgcaaacaaaggggcatgggtgtcgtattagccaaggttctccagggaggcagagccaacaaggtgtgcctatccgcagaaagagattgacgtaaggaattggctcatgtgattaggcaggctggtgagtctgaaacaaccccacctgttaggggagaatcaccccactgccccatcagcccctctttcccctactgggctattacaaagcacccgaggtagcagctgagaaaaagcttcacaaactgccaagtgcaaaggacttttccttgtgtggcctccgggtccttggccaagtctgtgaaagaagaccatgcaggccctccatcagggtcagatactgacatcatgcctcccgcttaccaagggggcttgcttcccacttctcatcccgatgatcggcaaagttcctttcctccttggcccatccctaatcagacatgataggcaggcagggctctctcttatgtgtgacttcccagctccattccttggcaaatccccatcagaaaggtcgaaatgcttcccctggggcccatctgacattgttcagtaatgtatttatcctataaaaggaaggaaataggatcacctatgaaattgtgagggccaatgtgtctctactagggtccccttttaacccggagggatctggacaggagcccaactcccccattcataactccaggtgaacttggatgagcaagttcccctttctcagcctcagtctggccctctgtaaaatggatattaaaagaaaaacatgcacctctggggctgctgtgaggattggagctaatatgtacaaagcagtaatgcacagcctggcacccagtaggctcctgagaatcggtggctgttgctgggttgacaggatcatggatgaagggcattcagcccagaccaacacccagcaggccctccgtccacggcagtgagtcatgcagcagcattttttgtttctgcagtgtgccaagctctttatgatctctcctttttgccctcttcttttcctatcccctacagctcaagtaagactagactggagtcttcatactcccctctccaaagcacctactatgtgccaggtgcttcaagcacaagctaggtgcttcaaatgtgatcatttatttagttcctatgtccaccctctgaagcattattattagccccattttgtagctgagaaaactgaggcacagtaaagctaagtcattttcctaaagtggtggtaagtggtgggctgagacctgagcccactttactgaccacttggtgatcctgcttcggggtcaggaaagaatttgaggtcctacctctcctttctcaacagctgtgtcccttccaccccatgctgcttctccgagttagagtgggtaattcaggggctgcagactcacttgtctgtcaggcagtcggcagtgagggaagccccaggtggttccgcgggtggcgatgggcagtatggctcttcctctgtgactgttgccatattggaatacaggctcaatgtccccaggccttttgttttttcaagacaaattgaaaattgagatttttttaaatgtaaaaattgcctaattttaaaatattgcctgtttattttcataactaattggtgtgcagctcctgctctcattctagccctgtatgaggtactgggacaccattcattcattcattcattcattcattcatcaatcactcaaacttccttagtcttccagtcacatttagatcaaatgcaaactctcccttggcctatgagagccggcattatccatcctctgcccacctctttgctttttcaccccagtctctcccttacgtcccttcatgcaccctggcctctttgtcatcctcaagcacaacacactcgcacctcagcgacccccctacctgcccataagggactgacaggtaagtggtaattttgtgatggagccagcataggaggccgtgggagctcaaaggagggaactaatccagatagacttcctggaagaggcaactgaggctgagttttgaataatgagtaagaattagccaggtcaaagtgtgatgggagtggatgagtgggttgagaaagatgttcctgtcagaggaaaccctttgtgcaaaggcttggagggtggggtgtgtggagcatttgttttgaaattgcaggtggtttggtcaagcccaggatgggcagaactcacatccaatctgtctgggtgctgtgtacttgctgggatagcttggacagactatatgatctttctgtgtcccattttctcatccataaatggggagaatattagtcccagtcttatggagttgtcagaaggacccccttacaataagacacacagagttctgagcacaggggcaggcacacagggagcactagcaaatgtcagctgttggtattaggagagcccggggctgctaggtgatggggacaatcttcctctggaagccagtggacacagggcagaggtgcagtcagatctgcatttcagaagggtcctccagctgctgcgtggaaagtgtctaggaggaaaagattggaggctactccagaaccaggtggagggtccacctggagggagaagctggaggctggagatgagaggactgaaggggcctgggcagtacacagcagttacgaaggtagctctggagccagacagcctggtaggaatcccagctttgccacttactcactgtagaatcttggcaggctctagaatcttaactcagtttcctcatctgtaaagtgggcatggcaacagcaccggagctgtagagtttctgtgaatatgtatgagttaatccacgagaactgctcagaacatcgtgagtacttcattaccttcagatcaaccagaattatcattcaatataaagttaatggatgaaagacaaggatgccaatgctgtttttgcctgagataaagagatcttaacgtgagtcccctacctttgcagctaagctgtgtgggaagccttcggccaggagttagatggtgtggtaggcgccccctccccagtaggttaattcactgctgatcttctaacaggccagcccagccatcactgatatcagagaaaacatgagctgcccgctttgtatggctcactggtggggaactgtaatccactccgcagctgacagactcaaggggaagagaaagacacaggagggacacaagtccgcttccctgacttttccactgagcctccctggttcaggggagccgaccttgccagcctcaagcgaggcacatgggcctgagcttatgcctcgaattgctatgtgacctcaggagatttactaagcctctctgagcaccagttttcttgtctataaagtggggctagtgatacccacctctcacagtttgtgggtaggctaagtacaatacacaggtcaagggctttgtatataaagccccttggatctcacggagggtgcagctgccactgaattgaagttgctctagaaattgtagtcattaagtgtagggggtcaaacagagcaggccttgcaccccagcttcactattcgaggtagaacatgggcaattcaccagaccagaagtgcccgcttccctgaaggaataaatgaggtgatgaattgaagagcttagagcagtagggatctgataaatggcggctgggatcactattaggcatgctctggtgggggagcctactgcatgctttaacggggagaccctgctctggctacagcgtggggttctggggcccgtggagtggaagcttcaaaacactctgagcacctgagcaaacacggcagtttgcagggatggggaagttggaggaaaagaggacagccttttctgagagtaaattggtgttgtcaggttacaaagaccatgctgggcgaagcatgaagcccctggccagggtggggtggagtgtcttagaggatccagttgaaagaactgtactgcgcccccataaatcaaatatcgaggccctgagtcttgatgtctgatttataaagcgctgactatgaaacagacaactttttttttttgagatggagtctcactgtgttgcccaggctggagtgcagtggcacaatctctgctcactgcaacctcttcctcctgggttcaaatgattctcctgcctcagcttcctgagtagatggggctacaggtacatgccactcttcccagctaatttttgtatttttaatggagatggggtttcactatgttggtcaggctggtctcaaattcctgaactcaagtgatctgtccgcctcagcctctcaaagtgctgggattacaggtgtaagccaccatgccctgcaaaacagacaacttttaacagagtatttatgaagcattaattcatctgccaagaatttatggaggacctgcgatgtgctggccggggttttaggagctagtatacagcagagaataagacagggtctgtgtccccaaggagctaacattctattggggaggcaataaccacaacatacacaccaccaacaacaaccaagcatcagatagataggagactatgaggtgggagtgttctgatgcaaacaaagggtgatgtaagagagagaccaaggaagcctcattagacatagtgatcagtaaatgcctctctgccaatgtgacaactaatttaatgacaaagaaggaactagtgatgtagaagtctgaggtcaaaatactgcaggcagaagaacagaaagtgcaaaggccctgaggtaggagcaagcttatttgaggaacagagtgactatttcagagaaaaagacaagacgtggaaccaaatcctgaagactcgcatagctaattaccaaatagtagactattttcatggaagaggcacatgttgctgggagaatagaaaggaggagcagctcacctagcctaggcaatcagggagagctgcctgggtgaagtaatatctaatccaggacctaaatgacaggtaacagaataggagatgaagggttctccaggcggagggaacagcatgtgcaaaggcctgggggtgggtcagagcctgatgcattcattaagggaattgcaagaagctgatgtggttggagcccagagctgaagtgtgggattgtaggaaagggactgagggagccctgacatttaggcagaagggccagcctgaccccacccaatgggtgtgttcacagaattgatattgccaagaccggcatttcagggtaggaaggaggaatcggagaaggaactggaggcaggcagggaggccagcagggagagggagtgaaggtggagccgtggccaaggtcagtgacagtaccagagtgggagagaaaaattccaaagccctcacacagccgaaaggactgacatgggacagtctgggacacagggacaaagacctcagagaactcagaaaagcatttagccaagtatcttctggcttggcgggtggccaaagtgggttttgaagtctgaaagacccagagcaagtcgtggcttgtccacttcctagctgtgtgcaaccacttcccagctctgagcctcagcttccccatctgttgaatcaaactagcacagcccacattgaagaactattgtgcagattgaaagtgaatgtgcaggaaagctctgggtatacagtgggtgctcattcccttccttgacccttggctttgggcctctgctttacctccctgggcctctgttttcttgactgtagaatgggaatcagaatgctttgcagtgctgtgggcaggagttagagatgactttgtgggctcagaacacagtctacagagtggtgatcacagatttcattatcttctctttcttcctccccagcaggaattgctgagacaggatggcctggcaggggctggtcctggctgcctgcctcctcatgttcccctccaccacagcggactgcctgtcgcggtgctccttgtgtgctgtaaagacccaggatggtcccaaacctatcaatcccctggtaggtttcaggcaaggttcttcaatgcccaggtccttggacctgtgcgaggcagcccagagaggggaggttgcaggcctgggcagctgtgtgctgtcttgtagatccatcccacctgtgcagggtggtgggtgtcctgccctatagatggcctggacaccaggggctgctgtgtccccactccagacctcgccatcatgggttcacttaggccaggacaagagactcaggtgtccagggagagtgatgcctggcaacagggagtgtcatttctgaggtggtgctgacttcggcagtcagcagctctagattgacttttcagggcttctttttcctgggctgatgagcacctccaaatctagacagttccatgagaggagctgtctccaacacccctaaatgcaaagatctggctgacaggatcaaagctttgaccctctcctgggccttagcacctcttgaccctaccttgtcggctttcctttgagttaagttcccccacatgtctctcccatgacagcagaaaggctggaatagaagtaccaagggcatagggacagaacacagactttgattctgtccctttctagctccatgaccttggaactccctctctaagcctcggtttcttcatctgcaaaatggaggtgattccatgagatagtgaaagaagttatttaattatttatttatttttccgagacagggtctcactcagtagcccagacttgagtgcagtggcatgatgtcggctcactgagacctctgcctcctgggttcaaatgattctcctgcctcagcctcccgagtggctgggactatgggcacccaccaccacacccggctaatttttgtatttttagtagagacggggtttcaccatgctggccaggctggtgttagactcttgacctcaagtgatttgcccacctcggccttccaaagtgctgggattacaggcatgggctatcaagcccatgccagaagttattatttatttatttatttatttatttatttatttttgtttgagacagagtcttgctctgttgcccaggctggagtgcagtggcactatcacagctcactgcaacttccgcctcctgggttcaagtgattcttgtacatcagcctcccgagtagctgagactacaggtgcacaccaccacacccagctaatttttgtatttttagtagagatggggttttgccatgtctgcccggctggtctcaaactcctggtttcaagtgatccgccagctttggtctcccaaagtgctgggattacaggcatgagccactgcacctgacaaaagaagttatttaatacataattctagccactgagagatgcacacaatgggccaggtcctgcccgtgcccaatctcaaagagcaccacgtttaagcatgaagactcatggcactggacggcctgggttcaagttccatattctttgctattgtcatcgtcattatgattgaatgctcccaatggccctatgaagtgatgccattgccccccaccccaggcctgatgaaccctcctgtgtcctctcctgtgtgttctctgccatgctgcacttctctgtcccactttaccaagagttagcagtgtgcttcacacctgcagaagcctgggagagaatttgtatttttagtggagatggggtttcctgtctgggagtcagacgtggagggggaaaggtgagcacgcagaacactacgggaagatcttacttccaattctggcaattgccacctgcagccatgtgtcctgggtctaaagccatttcacctctccaggtctgtcttctctttctcacaggcacaaagtcccctacctttatgcaccaccagtagtatgaacatgggtagcccagggcttagcagtggcgttcattttggttttctcagacactggacaggggagcctggggcagaccagtgcatgtgttttgatcatttgccactgtggtctttttgggtcttttgcagatttgctccctgcaatgccaggctgccctgctgccctctgaggaatgggagagatgccagagctttctgtcttttttcaccccctccacccttgggctcaatgacaaggaggacttggggagcaagtcggttggggaagggccctacagtgagctggccaagctctctgggtcattcctgaaggagctggagaaaagcaagtttctcccaagtatctcaacaaaggagaacactctgagcaagagcctggaggagaagctcaggggtctctctgacgggtttagggagggagcagagtctgagctgatgagggatgcccagctgaacgatggtgccatggagactggcacactctatctcgctgaggaggaccccaaggagcaggtcaaacgctatgggggctttttgcgcaaataccccaagaggagctcagaggtggctggggagggggacggggatagcatgggccatgaggacctgtacaaacgctatgggggcttcttgcggcgcattcgtcccaagctcaagtgggacaaccagaagcgctatggcggttttctccggcgccagttcaaggtggtgactcggtctcaggaagatccgaatgcttactctggagagctttttgatgcataagcacctcttttcatggagtagagtcaggagaaacccctgacaccttttcaggttggagtgcattcattcatcctcttatatgtgccccttccccatgctcagctcagcattgtgtacaaaatatccaagcccagcctatctctcttctgcgtgggagtatgttatttctctggggtctgtgatggggaagggtggatgtcccttccccacaataggcttagtgcttggctcagacacctagactctaaaactatcagcagcggcagcagcagcagcagcagcagtttgtgatctgtccttccaacctgttcacgtgactcctcaattccagggaaccagagcgatgtgttctttgtacctgtaggtctatgatgtccaaacttaacagatcacatgcccctcttagaagaaatatgagcatgctccctcatgcagatagtatacacatcataaacaaagagtagaactttaaaagaaggtaaataatcatacacagaaatcctaacattatattcccaaatctcaaaagatctcctgtgcacctgactttggagacgatgctttaggtaaaaagcttaaacattgccttatattggatcaggaacccttacagtagagggtccagtcttctagtgggtttaatgtttagtcagtgtactctgagtcctcattgttcagaaaagcacctcttgaagaactgacttcctgaactcccagtcatgttggtaccctggacagtgcccaactccttacagaagggagtgaaaacccctttcggaaatgattgagagcagcctcttgaatgcttaaatgatcaaggagggagaaaggcaaaccaatttgttctgtgcaacaaactcaaaatgtggaccagttccctcagccctcattaaactaattaaactgatgggtatcatgcttctactccatggtgaactgaagcagagtcaagctgatgaagttaagcacaaccatgttcttgagcagctgaattggctgccaagagtccaagccatctggcccaacatacgcactgggcattgggtaagggactccagaagcagcagctagaaagagaaaaagccctcttcaatccccataatgcttctttcctcttaatgtctcaaaataaaaccagaaagaggaataaaatgattaagtgcttgaggccaaatgagttcccttgattcaaataaccctgaatcagaggcagagacctcctgatgtcttggtttccatcaaagccctccctgtctgtctgtctctcttttgctctctcattcccaggcactctcttttggtttgtgggtccaggagatgaggctggataggagaggaaaaggcttgagtctggataatttgtataagatgctgctgagcacatctcttcatgcgcagtccccaggtatctgatgatgttctgaaatggatagattgttttagagttattttgtgtcctttaaaaaaatcccatttatgcaatttacttggaatttgcttagcctttaataggcttgtgtaatttcctgctcctccagtacaataaataaaagaaagatgctgatgacttggtgggtgtgtgtgtacgtgcacgtgcacatgtgtgtgagcctcagtcctcagagagaaaaaaaatttgcagaaaagagtgctagggaataaagaagagttacacacacacacacacacacacacacacacatattcaggttggaaaaccaagtgtgggataacagaaagagcaaaaactgtgaagtgtcacagctttaaattggaacattggatctgtgcgaccttgagtaagccatttggcttctctcagccttagttcctgcctccataaaataaagactaatagtgccaattttgtagagttgctgtgaggattagaggagctcatatatgcaaagatcctggtacacagtaggtgctcagtaaatgagttttttttcctacattgtcttaagggatggtgacaaagcttgagcattaagcaacacaatgaggagagtggggagaggtgctgcagagggagtctgcatcccacataattcccatgggctgttttctatgctagatgaccaggacaggagatagagacatgttcccagacaaggatgagtgagttagggatggaggatgctgtagccatgggtggcataatgtcctttactaaaatgacattttgcattaaatgttgttgatgagatgtctttaaataggatgaatgtgagatttaatggctacagacctcatgggttccatttggacactggctttctgaatgacttcatagaaaatgcagagtgaggaaggtctcatacattctctcattcattcagcaaactcttaattaaaggtctactgtgtttggcaggccttttgctaggtggtggaagtacagaaaaatgaaatggacaagatctctgctgttatggaactaacagtctagtagaggagacaaacacatagacaaaaatataagtcaatcattaaaaataatggtaattgttgggaaatagttgggatgtggagataaaggataacaagggtaggggagaaacctccctagggtatttaggaaatccttctctgaggactgtgtcattcatgatattcataggatcatcaaaatggaaggaacctaaggcttgggttcatcttatccatccacctaccctgtgccaaaattgacacattgataggaaactttaatctgcttgaatacttttgttgactaggattccacaacatattcctattcctcaatgattcagtgttggaaagttccatctttatgtcaggttgaagttcaggtttctgttatttttacccactgagtcccgatcctgttgtcactagcctgggagattctccagggaagaactgtctaccacttgaaaacaaatgactcctaactctctcaaatgggttaaacaaataaactacaacaacaaaatccaagtaatttgttggttcacataaataaaaattccagggatatttagcttcaggtagagtttgatcaagggactcaataaggataacatgatctctgcatccctaggctctcttctcctctgtattgtgttcattctaaggctctacgtgcttttaagatgactggcagaagctctgggttatacccacatgctattttcaccaatctcaatcaaagtttcatgacatcttattggctttaattgggtcatgtgtcctatcctgagctcatgccagtcactgtggacagatggatgtgatgctctgtttgattagaaccgaatcacatggacatcactggagccagggatggattcaaccccactcgaaatagtggggaaggaagtgggtggttctcaagaagaaaatggagcatggatcccagtaggagagcaagtgaatgctagacctcctagggtatagagtaggaatatgttatggaatccaagtcaacaaaagtgttccagcagattaaagtttattatcaatgcatcaattctgacacagcgtaggtggatgccagtgagtaaggggagctggtgggggttggggccaactgga

SEQ ID NO: 16394 - DNA, 5040 bp, Human
atctataatatgagacagatagtggtaacagccataaaggctctaaaatgatggtaataataaccatccagatactgttccatgtactttatgtatatcatagtatctcatttatccttagagaaacactgtgaggtagatagttttatctttgtttcacagagaaggaaactaaggttcagaggggtttagtgacttgcagaatagtcagccactagtaaatggcaacattggaattctatcccaaagtctttgatcttaaccttatgggaagtacgaaagaggggaaataatgtatagttgggatattagaaaagtcttcatgaagcagattgttttttattttttatatttttgtataaattcaaggcatacaagtttagttttattacatagacagcaataacataatagtgaagtctgggcttttactataaccatcacctaaataagcttgagattaatgtggaagaatggctggaattcctagaaacaggaaaagaaaataagagagaaattcaagacagtatgaaggcactgaatagaagtaatgaaatcaagaaagccaggaaggtataaagaacaacaattagaggtgtttgactggagaataggattagattctgagataatagccaggttagagccagattgcaaatggcattggcttccaagcaaatggtctgtatttaattcaggagtcaatagatgcataatcccaactttatcactaacctatactgtgcaacaagccagataaggcttcacaacctgggattccatttagagaaaaaaagtagagaatggaaactccccagggatgagaataggaaggatactttgaacaatgatagagaaagtgtattcttggtggcagtgattgtgtcattgaaaaggctgattaggtctgtggtgagctaacagaagagagagtgaacaagaggctaaacagtaggatgagaaacaagacaccatataattcagggatgagagagaaagaaataatgtggctagaaagaagaacttcagtttgatatctcagaggcagagaaggtttgagtggtggttaataaactgtacagagagagaatgaaggagacatagaaagaatgaaggtggagatctctggggctgtgagagagccagtgaccactgaatccccagcacctagtgtagtaactgagagctagtgaataaatgtattagtggggtcatcaccaaagatggattagatatacactcaatgaccaaggactcaaagaagaggagagaaaaacttggggagatgctgacatctctgcaggtagcatgaagtaaccagaaaacaagtcgtaatgagaaatggaaagatctaggataaggaagcaccatgatatgcaaacgaaaaaaaagcactgagtagaagtagcagaaaaatactaagcttcatggggacagaaagtttattctccaagtccctctttccccttagctttgcctggatgtattacttgatgttgaattagtcaaagttgaaggcactttttagggtcttcagcagaaagcagaatcctagaatatcctacaaatacaagacaacttgagaactataaaagaaagaaaaggccttgttcccatagcccacaagagggctgagctcagcgatacactctgtgtggctcaggagcttctggcagagcacagagccatcagagagggggcccagagagcagagagaggctctgctgacatggccagcctagcgcctcatcccatccataaccctgctgccctgcaatgactctcttcccagcaataaaatctgggtcacaggagttggagctctagccatcacttgtctctaataaataactcccattgattttccagctcagggctcaccactccttcaccgtaagcgccaggaggcagacctggaaaatcactcacatattattggtgctcttcctcccccatcctcacccaaggtgcatataaaccctgaataacctgaagtctaagggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctttgctcacacaggtaaggaggtgaaggaatggtcaagaatcataaagtgagaaaataggttgaagctgagatatcttttccctgcatttatactgaaggtcattatctttctttctttatcccgcagacctcagtgggaaggtgtttgtatttcctagagaatctgttactgatcatgtaaacttgatcacaccgctggagaagcctctacagaactttaccttgtgttttcgagcctatagtgatctctctcgtgcctacagcctcttctcctacaatacccaaggcagggataatgagctactagtttataaagaaagagttggagagtatagtctatacattggaagacacaaagttacatccaaagttatcgaaaagttcccggctccagtgcacatctgtgtgagctgggagtcctcatcaggtattgctgaattttggatcaatgggacacctttggtgaaaaagggtctgcgacagggttactttgtggaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacctgcatttgtttagtgcttgtcatagtcccatatctttatcttatgtctactacttatctatctactaattggtgtttcattggtaattggtgtttcattatcctgaaaactccaattgccaagtacggggaggaaaacctgtaagtaactagaaagatatatcgcaaagccagagcactcaatgagcacaacagtggcaatacttaaaagctactaacaatcattttaatgacgattcaaaatatgtgtggaattgtaatcacaattctcctatttgtttttccagctacaaatcgatcaaaaaggggtctgaggttgcatcaggtagacaactataatgatataagtaagcaatagttgagaacctgacagcaagtaataagacaggaagaataaaactagaagaagtcagaatgaaaaccaaaaaagtatgagactgggatcattttgtatgaagacaaacataactttatgtctcaaaaacctcagtaggactgtacaatgcttgattttcataatgttctcttgatgtcatcaaaaaatattatactctgaatattgctcacatgaatatgctgtctaaaattcttccatggattcacacttcttacaggacatgatttaaacctctaaatatgacattgccctctataacctggtcccagttactctctctgaaatgtacacagagagtatacacagaatactctctgaaatggactttccatgtacatttcagatacaactcttagcagagcaagccacatcctaactatcacactgaaaaataattgtcagatgctattactagtagttatttttatggttatgaaaagcatggaacacagtgcctggcacatcgtcaacagatatgagttgcattcccagagaagcaaggatcccagagggagtttgagctacatatatgggaaataagacaggcttttctcactgataataagtagagcatgtagtcagtggaatcagaaagatagcatccagaagcttcaggatggtaaccaatgtcatgatttcaaactcatgaggccatttggccagaatgaacagaggcagtcaccagatatgaagaagtaggatagaatctggaaactccataatgggacaatggggtggaagcagaggagagcagacagaacctgggaagatttgctgaagtacttaaatggagcagcaggggcttcataagaacatttcaacctcatttctggtgaggtggtatgatggtttggatatggtttgtttgccgccaccacacgtcatcttgaaattttattcccaatatggtgttgttggaaggtgagtcctagtgaaaggcatttgggctatgggggtgggtccctcatgaatgttttggtgctgttcttacggtaatgagtgagttctcactcttatgagagtgcattaactcttgtgggatcagattagttcttgccagatgtagctgttataaagccaggatgtcccttagattttgttctcttcgcacatgttcacttcgcctttgaatttctccaccatgttttgacacaacacaaaagccctcaccagaagccagaggcatgatctttaacttctcagcctgcagagcgatgagccagataaacctcttttctttatatatcactgagtctcaggtattcttttatagcaacacaaaatggactaagacaagtagaacttacttagaacattgagttggttaggtagacagggattttagcaatatgagaaattattaatttctgattgacagctcatgagttaaggcttgctttacgctttctcaatattaacgacctttccataaacttgtactgtgagtactagaaaggtctatctattcttgcataacagatatttctatcatgttcactaacactgtgttttggtttaacaacccctttgcctaggaacccaagacaattttagaaatgaaaccagtgtacttccaagtgatataatccattcattcaacta

SEQ ID NO: 16395 - DNA, 5913 bp, Human
gagggaacaggagatggaaaatagaggttgtcaacccacgtaaacttttccttccttcctccctctctccctcccatccttccttttttctcttttctttcttctttctctaaaagattaaatatattatagtatggttttgtggaaatgatcaagtaaagatgaataaattaataatacagaagatagagaggatacctataggagcaaaattccttgcatagtcgacagggtctgggatccactgaagaattgcaagggttggccttagatgtaacacagggagagctcatcccttttaatagaggaagacagaaaggctggtacattgggttgtaggaggatatataaggatatcagttaggtgttaagaacagaaagactgagttaacagtgatttaacaaaagaggagagtatttctcctttaagtaaattttcaggtaggcagcctagagctgatgcagtggctccatacccaattatccaggctccatctatcttgttgccatgccaacctcaacatgcagcttacacttgctggcctgaaagtgaactattccatctcctgctatcatgactgaatactagtcaaagggaaaaagggggaagtgggaggggaaagcacatacctttcttaaagagcacaacctagagatggtccctattctgttcatatctcgttggccttaatttaatcacatcatcactgcaagctacagtgggggctgggaaatttggtgtttgaggggatgaccaagcgcccaactgaaaatgttattcttctcttatgagaagtagagaatggatgttagggaatggctagaagactctactacaaaggatacggtggttcttttctgattgcttctaacttctcaatgaaaggtgagttcatcagctgaatgaaagaataaatgagattttggggacttgaggagcaaggagaaggagtataatagtcattttgaagagtgagttaagtagggaactgtagtaagattgacagacagtgtggagggattacttgaatcttgtgaatagaggaaagagtagaatcagattatcctgactcctgcctgaagctttacatattcagagaaaaatgttggaagaaactttgatataatgctatgtctgtgatcaggcacacattttactggacttttactgtcagggccgtcatttagtgccaagatgtctagagagttcttaataagtgtactcaattggctgagaaaatgtgtccatgcaaaaaaccaaacaccgcatgttctcactcatagatgggaattgaacaatgagaatacttggacacaggaaggggaacatcacactctggggactgttgtggggtggggggaggggggagggatagcattagaagatatacctaatgctaaatgatgagttaatgggtgcagcacaccagcatggcacatgtatacatatgtaactaacctgcacattgtgcacatgtaccctaaaacttaaagtataataataataaaaaaatgtgtccatggctctgggaggagcatgtttgttttcctcatttcccagtctgtaaataagcaaattgaaaggggttagtgataatgtccatctccagaagctgtcagatttcctttgtcaaactctatgatttgggctgaagtaggtgttggagaggcagctaccacgtgcacccagatggccacttgtttaatatgttaccatttcccattattttcgcaggatagatagccaaagtggagccctgagagatttcttcatttttcctgtcataaagaattggtaattcagtagtcataggagtttgtaataaataactcacattgatttctctgttctgaaataattttgcttcccctcttcccgaagctctgacacctgccccaacaagcaatgttggaaaattatttacatagtggcgcaaactcccttactgctttggatataaatccaggcaggaggaggtagctctaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacaggtaagggccaccccaggctatgggagagttttgatctgaggtatgggggtggggtctaagactgcatgaacagtctcaaaaaaaaaaaaaaaagactgtatgaacagaacagtggagcatccttcatggtgtgtgtgtgtgtgtgtgtgtgtgtgtgtggtgtgtaactggagaaggggtcagtctgtttctcaatcttaaattctatacgtaagtgaggggatagatctgtgtgatctgagaaacctctcacatttgcttgtttttctggctcacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaatggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgagtgagtccaagctgttttctgatagttgctttagaagttgtgactaacttctctaatgacctttgaaatcaagtccctgtaagtttacacttcccattacacaacatatccatggcactttaacctgtccaagagtcccctgaagggattccctctgacaagcacagtccctcttttgagatagctggccattcatgtagggccagttgtgggggttttagtactctcattctatcattattccaatttgaggagcaaaaactaaagatcattgagatccatggatctgctgccaggttcagtgactggaatgcacttgccccagcgggttcaagttctttgtagaaacagacccctcaaagatgacagcagctggcttcctccagaagtgtccttcaacactgtctttcagtactaagtgaccagtagaagttactccataaagaccatagccaggaatgaattatggggcttcctgcatatcaaatggttacctagggaaggcatatggtaaactagttaagcacagaggttctggaatcagactgcctaggtccaaatcctggctttacaacttactagctatgtgaccttaggtgatataacctctttacgcctcagttttcttacctacaaagcaggagaaataatagtaattagctcaaagggttgctataagaatcaaagaaaatcatgcaagcaaagcacttactacagtgcctggcacatagtaagctcttataacagttttctggtattattcttattaagccattttgtattatatccataaatgtagattcataaaatacataaaaatacaacttggtagaatttgtcttggttggcagcagttgaagcttctcatttgctaagaattaggtttagaatgttagaagggtgaacaacaagtctttgaagccattatttatgaatattgacttctctaattgacttttgataaccatttgtaagcatagaagctaaggatacattctcagacaaaaatgagagtgcaaatactctctgttgtccaattagggcagatccatccatcctcacattcagctaagcagaagagaggattgacactcttttctagttaaataatccagatacgtcttaattatagaaggccatcccaactccccagggatgtaggttgagctaatattttcttcagaattcagttgcttgcatcttactatacatagtctggtagacagcctctggccttaataatttgagccaggaaaatcttaacagctggtatttgcattcagagaacattaaaaaatcttaacaaagcattcgtaggatgtttagatttaagcaatttagcctactggtgggtacatcaatgtaaacttgttggaaaatgtatttccaggtaactggtgaattgtcataccatatagagctattagatgtaatccaattaaatgttagatgacatctgccaaagaagatgattctgatttgggcatgttggttctaagcaatgcttttttttttttgcagtaagtggagagtaagatcaaacatccaccgtggccacttctagctgatgctaataaaaccatgttgtcaggactggttttctgttagagtagggaccatggatccaatttttcc

SEQ ID NO: 16396 - DNA, 124264 bp, Human
  misc_feature (1)...(124264): n = A,T,C or G
aaggcctgggcaaaactcttggtgcgcttttgttacattccagcctttgtataacagcactggcttttttttttttttttttagcttttaatatttaacttaaccactcagtcagtactgaaacagttgttatggaggcctgcgttagtgagacctggcctgccacagtcttaactccagattctgctcggtagcaggctggacacacaggcagggtttctatgttgtagttcttttccaggaaacctcagtctttgctcttaaagcctttacctgttagatgaggccttcctgtattatggagggtaatccactttactagaaatctgttgatttaagtgttaatcacatctaaaatataccttcacagacatatctagattggtgtttgatcaaacaactggacaccaaagtctagccaagttgacacataaaattaactgtcacacttgccttctgaggattcagggtaaattattttggtgtacatgtagtctggttgctgtctgtttcccactgtatacccttgctctagctaaactagcagctccagctgtttcatatacatgcttctgcttttgcacatccatgtctttggtcatagtgtacctgcagcatggagtgcttcctgtgtccagatcttacctgtccttctgaggattagatcacagatacttatacatacaattttgtttgcagcctatacactagctttcctaaacttcttcctgtcacctaattatgctgtgttctgtcttgccattgtgcttttgcacacaagttcctttggtttagaatatccctccctctgtcttttctttcttaaagagacagggtctcagtgtgggctggtctcgaactcctgagctcaaatgatcctcccatctcggtctcccaaagagctgtgattacaggcgtaagctgctgcacctggtccttccttcctactttctgtaaaacttttacagcttcctcaggtcaattacatgctccttttcattatgctcccattgtccctttgcgtatttccacggaggcactcatcacattttattgttattgtttacatatctgtctgtcaaaaggctttgttttccaacagcagaagttactatactgttttccttttcaaagttggtcctcagtcgagcctatctggtctgtagtacctaaataaattgtgggataataaactgaatctctgttaaagatttggaagttgtttcatatttcttctataatttctcattgttagaatgtggagataatgactgcttggaggtaaagcaagtctgaatagcagagatcagccttgggttggactccagacattcttgggcttattaaatatttggttgactcactgatagaaatagttttatttattttccattctttaccaggtacatagcttcaaaattacttcattaacaaaagctgtttctgattataaacattgatttatttttactcaaatttgtatatactgtatatactgagtaaaacaaattttactcatttgtttttgttttgttttgttttgttttgtttttttgagacagagtcttgctttgttgcctaggctggagtgcagtggcatgatctcagctcactgcaagctctgcctcctggattcatgccattctcctgcctcagcctcccgagtagctgggactacaggcacccgccaccatgcccagctaattttttttgtatttttttttagtagagatggggtttcaccgtgttggccgggatggtctccatctcctgacctcgtgatccgcccgcctcggcctcccaaagtgctgggattacaggtgtgagccaccgcgcccggtctcaattttgttttaagaatatcaaagaatccaagactgtttcagcttctttctacctaaaatgcagtggtgataactggtgactgatttgtaagcaatctcaatgtaatgataaataaccttttcctttctctactagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaagtgagtagaagatacgttttttattttgactctatatttagctaataatgatctatacatatgtatgtatgtgttttatgtatatatgtgtgtatgttcctgtgtgtatatatagaaactgaagaccttttctggaacagatacagcttcattgatgaggtttctttttttattaattctctactagtttattacagatgttcacttatttatacttcattttttcatttatatatcgtggccctctttatttgtttgatggatacaaacccaccttacaggcggtgaaaagccttcttcagggtctcagaccttaatgccaatcattcagttttagtggcttctgatttctaatttctagatattgttgttaatgaggatagttggcttttgtgtggattaaggttaaaatcaggaagtgcatatatcatgttaatgagcacatagtgaattataagcattttgaaatttttagtggtagagaaaaataaaagcttcgtctaacctaatctcttcattttatggacaagaagactgagtcacagtaagattaaaacgatttgttcagatttagatggcaaggccagaattcgaatctgtgccttggtctcaatgaggtcgtgcttttctccgtggcattttactacgtgttgtgcttcctttgtcatctgaaggatataacctctcttattttttacaaaaggctagagaatctccaaaatttggaagcctaatccatacaagaagttccttggattcaaaacttctcaaatgatgatttttagcattttgcttcttttcttatgaagtgacaactagtataccctctaacctgtcttgatgacttatatacctggaatgaggatataaaaatggaaactactattaaattcaggtagcatctcttcatgaagaagagttggctataactaaattttatttttgttttttttcttttatcaaagtaatatataacacctgtaaaaaagaaatatataaggtgttatatatacatatataaaaagaaatataaaaggtgttatatatactttttatcaaagtaatatataacacctgtaaaaaatactttccttgtgtgcccttcttactttcaccaaggaatatctgcttaatttttttttgctgtatagaacttgtatagtaaatagatttcttatgtagataatctcaaaggaacagctgcctgcctgtaccaagctttcaattattgattataagttatgacataccatcattgtagtggctctaggttgtttttattgattcaaagaaaatttcagctctggctactctgattgcagtttattattatttccagataatagactataattgatttttaatcacctgtattaggtatttcagtctttgtgcttgtatgttggcccggcaccgatgccacctacatctgctaatataaaaggaggccattagaccaccagcctcttcagtagggattaaagagatatgcttaagttaaattttggtgctaatcaggaagagaacattttgtgtatatacttgctatgtttaaggtaaacataaaggccaagaaaattcatagaaattatattatgaattaatgaattttagaaagtaaagagatgttacttagcatttcagtatgtggaatggaggccctgtaaggctctatgttttttcaaaaattaacatgtcacaatcatgagtagaacctaccatgcttattccaagatttttgcatttggggtctttctagtttggggctattatggatcaaagttgctaagaacgttcttgtacattacttttggtggatatagcattcatttcttttaggtatataccaatgaatagaattgctggatgacaaggggtgtgtgtgtgtgtgtgtgtgtttgtgtgtgtgtgtgtgtgtttaacagatactttctaacagttttccaaagtgtctctatcattcatgtatggctgtactgtaaatgaacatgttctagttgcctcacatctttaccaacacttggtattttagtcttttctggtaggctacaattgttttttaaaacttaaaagcaaaataatatttgaacccctttttgaaagaaaatcttacccagaattccaatataaaacaagagctgctttggttgaggtgagtctaaactagaccatatttccttcttttgtttttgagatggagtctctctgtgtcatccaggctggagtgcagtggcatgatctctgctcactgcaacctccatctcccaggctcaggtgatcctcccatctcagcctcccgagtagctgggattacaggcacgcatcaccatgcccagctaattttttttttttttttttgtatttttggtagagccccatgttggccagactggtctcaaactcctgagttcaggcaatccatgtacctcagcctcccagagtactggggttacaggtgtgagccactatgcctggccagccatacttcttttttaaagattgaatccctactctcaaaaactgctttttggggaataaggcagaaaatacaaaattattacatagtgccaagttgtaaatatcccatgttcattataataaagaatttattgcccacagtcagtcatcctgtgtgcttttcgttttatttaaacatttttattctgggaaatttttttttttttttttttttcttcgagacggagtcttgctctgtcgcccaggctggagtgcagtggcatgatctcggctcactgcgagctcggcctcccaggttcacgccattctcctgcctcagcctcctgagtaggtgggactataggtgccccccaccacgcccagctaatttttttatttttatttttagtggagacagggtttcgccatgttagccaggatggtctcgatctcctgacctcgtgatctgcctgcctcggcctcccaaagtgctgggattacaggcgtgagccaccgcgcctggccgaaaattgtttaaagtaaatattttaatacttagttcagtattacttagtattacaatacttaaatatttaggcagccttgaaggtttgaagatgtcaccagatggcctagggatacttgtagaagctgttgaaaatagagatatcaggagaccttcacagttctgcctcttatcttgttaatttttgagagttaacctttactttgcttagaaatttccagttatttacagtcagggtggcatctcttgcgtctctgggctgttccagttacagaaaagtcagaggctcctgctcaagtatcttgaaaagaaagcagaagtaaagtttgaggctatttacgttgccctcttctcatggtttgtggaattttttgtggaattttagttgtctccatcagggaacttttgggaagttacaagagcgtacagttacttctgttattaaactcattatgataccatgaaattacgtggaacaaataaaagtcaagtttgctaggtcaaaagagcaaatccagaaaagcagattaatgtaacagtgacgcttagacaacaagtacaggaatcacaactacaattcagagacgagttcttatctacacttagggcagaaagagaatatagcaactattaaacacaaataaattagaatgaaaaagataatagtagtgataagtacaagagaacaaataagaacatgaaaactgacaccctacagcttctaataagtaaagcagacaaaaaatcctctaaatcagatcaaaagcaaagaaagactgaataaatgagtgaaaataatgtaaaaaggtttttggaaatggagacatttttgaggaagtaggaagaataattagtaatttattaaattcataactttctttttaatatagaaagtgaaatttagttttgttaaagaaaaaattattcagtgatacctgctaaggcatgaggcagtgtttatttagcaccactgcaggaggtacagggaccactgcagtcgggtcttgcagtggggaatagagattggacttaactctgaatacagcatgggcaagtgagaatttgtagccagagagtaaggtgagggtcagtggatggaaaattactacgaggaaacatcaggggtcaggggcattctggctaaatttacctgataggattctcactgaagacaggccggggtgatcagacatcacctggagggtggtggaggatgagaaacccgatcagatcctgagagtgattagatatcaagggtaggaggttcttgctaaactgccttagcagggttctttgctaaaactggattttataaagaagtgcacagatggtcctaggagaaggttcaggagcctgactgaagtttggtcacacaaagaatctttgtcagtttggaaacttaaaattcttatgtcttatgggattaacagaaagataactcaatagccacttgaaattcttctgaaatttaaggataacaagaatattttgagcaagtgaagagaatgacagaccatattcacaaagatatgagcattaatagcatggaaaattaacagcaggcaaattaggatcacctgagctctactagctcagtctgaaatatcccagaagaattttataaatattacatgtggtgttttgtttttgtttttgttttcatgaagctatcagagaacaagtctgtttatttgtgaaaacttctcctttgtgaaggcactgcctaaggatgctattgggctattggggttgtgtcttttttggttttttttttggagacagggtcttgctccatcacccaggctggagtatagtggcaagattgtagctcactgcagccttgaactcctgggttcaaatgatcttcccaccttagcttcctgttagtagctgggattacaggtgcatgccatcatgcctggctaattttttttttttttttttttttttttttggtggagacagggtctcactatgtgttacccaggctggattcgaactcctggcctcaagcagtcttcctgccatggcctcccaaagtgctgggattaccgctgtgagctgccatgcccagcctccttttacaagctatattgaagagagaagtgactgagacatcttagctggagaggaggaattgaataaacaagggatacaagtgacagagtaaaatgggctgtgaaaggaaatcagagagctgatgaaacattgcatttcaaagtgtgtcagggaaagattgagaagaagcagaaccagaacatgaattaataaggcaacatttgtacttttcttggagaatatagcaattggtagcaaaaattagaagttggatatcagatcatttattagtttgattagatttctctacaaatagtagagatccaaaataacaaagatttccaaataatgactactatgtagaaggcagaccagggctgctttgtcagctttgcagtcatctggcatttaggctgcttccagcttttgtctccatcatccccaggatccaagttggagcgccagtcatttcatctacattctaagcagcacagcaggggtggatgtgtgtaaaacaaatggcgtttagtattttttgaggatatttcttagaagcttccaggtagtacttcttgcttttcactggccataactggggttccttttactaagaaaaatcaattggatattgggataggcagatagtagtctctgctacattattgagcacctactatgtgccagacactgtgttagctccttgagataaaaggtctttgccttaaaggaacatatgatctaatagaagacttagattcatatataatgcagggttaagaactatggtcaccactgcttcttcattggtgaataattaaaaacaaacaaaaagaggccaggcacagtggctcacacctgtaatcccagcactttgggaggctggggtgggcagatcacctgagggcagtagttcaagaccagcctgaccaacatggtgaaaccccatctctactaaaaatacaaaaattagccaggggtggtggcccatgcctgtaaacccagctactcgggaggctgaggcaggagaatcacttgaacctgggaggtggaggttccagtgagctgaggtcgtgccactgcactccagcctgggtgacagagcaaaactctgaacaacaacaacaacaacaaagaactatggaaaaccaaggagaggtgcctaacccagtctgaggtgttcagagaggtcatcttgggcaatgtgtcatgaaactgagccctaaagaagggtttcctcaagcttggtatgacattttagtcagataattatttgttgtggcagccatccaagatgatcaacagataaagggaagcgcatttagttttgacttagggaatattgtgctccctgggtgacccatggttaaggcgctgtagttcttccttgactgtccagaatgtctttccttttccttagccaatgagccacccaagaaatgttactcctgggagaagcctgtgcctaactgtggtttacagaattcaaagggaagaggtagtatggaggactccttgtggcttcactcctggcccaacccagggcctcaaaaggacctaaggaacaactacgccctgttatgcctgacctatggaccctaccctcttgaccatataatggaagtcagctaagcttagtcccacctggacctagaacatggtgtttgtttcccataggtgaatatatttttgaaaaatatatttttgaaaaataagtaaaacaaaaccaaatcaggaaataatcattgagaagttacaatatgaacaccttaacaaagatgagtaacaatgtggtgttttttgctagagagttcatttccaggcaggaagtagtgtgaaacaaggtttgagagaaatgatgcggaccaggctttggagggccttatattttaagctaaagatattgaattttaagccagttgccttcagacttctcttattagtggagcaccctttttttcaagtgaaatcttgttcggaaccttggtagatgatgtacttggaagtgaagtggccctcctttaggcagcatttaattttggttggatttaacaaagaaaactgaagtgaagctcatggaattgcaaaactacaattttgtttttaaaagaaaaacattgattgtaatgtgtaaaatttacaaaactgatacacttttaattgggattatattggtttataaaaacatttagtgttttttttttttttttttgagacagagtctcgcactgtcttctgggctggagtgcaatggcatgatctcggctcactgcaacctctgcctcacgagttcaagtgactcttctgcctcagcttcctgagtagctgggattgcaggtgcgtgccaccacacccagctaattttttttttgtgtgtgtgtttttaatagagatggggtttcaccatgttagccaggatggccttgatctcctgacctcatgatccgcctgcctcggcctcccaaagtgctgggattataggcgtgagccaccgtgcctggctcaaaacatttagttttaataggcattttagggtatgtcttagtccatttgggctgctataacaaaataccacaaactgggttcttacaaacacagaagttgatttctcgcagttttggaggctgggatgtccaagatcaggcactgatggattcagcatctagtaagggcctgctgtctggttcatagatggcaccttgtgtcctcacatggtaaaggaggtgaagaatctctccctggcctcttttgtaagtgcactaataaggacacttcccaagttcccatctcctaatacagtcacattggtgattaggttttaacatgaatttggggggacacaaacattcagtccataatgaggtataaaacttagaagattcctgttttttttaaaaaaattcttttttttttttaagatttaaaatgtaagcctagttcagagtattttgccaagatgaagtgtagggcaaattggatctttaagtagagtaacctattacattgattaactactgtcaaagaaaagccaagcacatcaagggaattatggttggtacccatccagatattatacatgaattcatggttcctccttggtccttttctgaattacctgtctaatgaagaattatttcattgtttttgaaaacatccttacatttcctcattgctgaaaatcatgttttcaaacatcaaccattcatcacaatcacatacagaacctttaaaagacctaaaatttctgattcaggaggtctgggataggcccaagaacttgcgcttctaacaggtttcccggtgatgctaatgttcctggcctgatttcactttgagaaccactgcttaaaatcatgctacgttttgtttgcttcatttgtggactcagactttcttgcccctacagcctgggctgcagccacactgaaataattgtagctacaattattgccacaccatttatttaatcagttcctttgaatgtgttgtttcctgtgcctgcaacacctttctctcacttcatttcttcatctgaccaactcatggttgtatttcaagatttagttcaggtttcctttccctaaggaagatctctccaaggcccccctctgtctgggatgtacttcctatgctttcatgagacacttggcaaatggaaaagggttgatactttgaagctggctagactttgtttaaagtctttcattgacactaactggttttgtaacattgcatcaaatactatctctctccgtgtctccattttcttatctataaaacagggaagatggtgatgatggtaatgataccatccaacatctactgaacatttgttatgtgccaggcagtatgctgagctctctgtgtgccttatctcatttagtttttatatttaccctttcacactcacccataggtgccttaaacatcttaattttatagatgagggacttgaggctcccagaagttgaggagcttgtcctccgtcccacagttggaagatggtagagccaggctgtggactcaggtctttgtcttcatctatacttttagctcttgttgtatatacttacagcatttatgaagacaaactaaaacagtgtgacagtggctaagcacacgttttagagtcagacagacataggttcaaatcctagcactgtcctttattgattatgtgaccttgagtgagttatttggttttgtctagtcttggttatctcatctttcctttagttttcttatcctggaaatgggaatgataatatgttagatcccccttatctgcagatgatatgttccaagaccccagtggatgcccgaaaccccactgatggtaccgagccctatatatactatgttttttcctgtgcatatatacctgtggttaatttataaatcaagcacagtaagattaacagcagtaactaattataaagtagaacaattataacaatatgccagtattactacttttgagctttatggccatgattaagttaaacaagagttacttcaacgtaagcactgcgatactgctacagtccatctgataacagagggctactaagtgactaatggtgggtagtgagtgtacattgcatggacgtgttgaacaaagggatgatttacatcccagtctagacagagtgagacaatgttagatttcatcatgctactgagaatgacatgcaatttaaaacttatgagttgtttatttctggagtttcccatttaatgttttcagaccacagttgactgcagagaactacctgaaactgtggataaaggcttactgaaatagtatccattaaggatgataataataactatccatagggttgtcgtgaggatttagttagaatgactataaagcccttagccaagtgcctggtatataatgagaggttgaaaatgttacctgttgtctttattattataataataaggatgataataataccgattgcagatgatggtaagtagtatttatagagttgtgagaattaaattactacaaagcctttagaatagcacctggcacatagaaattgttcaaagtggtacttattagtatgttatttttattgtcgaacgcttatgcactgttcccctccctctccccatcccaaaataatgagtgtgaaacacctaggttagtagcaagtgcaccacaggcttttgttaatgttcttacacatgctcctgtaagcttgtttagggcaaaggtagtcttgaagtcatgaaatgtttgtctcaatgaagcaaagtaagcacccgatttgaatagctctagtaggaaactaacatggcaggttgggaatgctggcattacagtaacaataatctctgaaactacttggaggtgacctttgatatttcattgtcatgttttccctttttcctttgtttctttgtttagtttgcctgttggtaaactttatataaatgggatcatggtctgtgtttttttcggtcaggttctttttttttttctctggcctaacattttcttttgagatttacctgtgttgtggtatatagctatatcatcagttttaattgccaaaatactattctctggtataatatagattatttatacatttttactattgatgaacatttggattgtttttagtttggagctaaggacatttttgaaggtgtttccttcaagagtttctctaagatatacactttggattagaatagctggattatgagcagtatgcatattccacttgtttttcttttttgttttttgagatggagtctcgctctgtcgcccaggctagagtgcagtggtgcgatctcggctcactgcaagctccgcctcccgggttcacgccattctcctgcctcagcctcccaagtagctgggactacaggcgcctgccaccacacccggctatttttttgtattttttagtagagacagggtttcactgtgttaatcaggatggtctcgatctcctgacctcgtgatctacccgcctcggcctcccaaagtgctgggattacaggcttgagccaccgcgcccagccttttttttttttttttgagacggagtctcgctctgtcgcccaggctggagtgcagtggcgcgatctctgcccactgcaagctcacaccattctcctgcctcagtctcccaagtagcagggactgcaggcgcccaccaccatgcccggctaattttttgtatttttagtagagacggggtgttagccaggatgatctcgatctcctgaccttgtgatccgcccacctcggcctcccaaagtgctgggattacaggcgtgagccaccgtgcccggccagtagcttatcttttaacttcctttttaatatcttttttgtcaatgacctcactttaacagaattaagaaaaataagaaaaatcttttgatgaatttaagttttaaacttgtatttaccaatctttttctttagaattttttgtaaaaaaattcttccatactctgaggtcataaaaatagtttcccatgttttttccaaaacttaaaacaaatttcttttcatgttaatctggaatttattaatcaatatggaatttattttcttgtgtgaggtgcagattcattttcatattttttctataaagatgaccagtttcccggaaccatctatggaaatacagtcagtactttggatccatgggttccacatccatagattcaactaacctcaggtcaaaaacattcaggggggaaaaattccacagagttcccaaaattacaacttgagcttgccatgtgctgaatactacattgaatctacgtgaatgaagtgatgtgtgggcatcgttaggttaggtattataagtaatctagagatgatttaaagtataagggaagatgtatgtaggttatatgtaaatactgtgccattttatatgagagatttgggcatctgtggattttggcatttgtggggagtccagaaacctaggggattgtcctaatgacatgcagtaccagctaggttaaacatcaggtttccatgtatgcattattcttttagtgagatcgctttcttttttttttttttttttgagacagagtctcactctgttgcccacgctggagtgcagtggcacgatctcagctcactgcaacctccgcctcctgggttcaagcgattctcatgcctcaattctcccgagtagctgggactacaggcgtgtgccaccatgcctggctaattttttgtatttttagtagagacgggatttcaccgtgttaaccaggatggtctctctctcctgaccttgtgatccgcccaccctggcctcccaaagtgctgggattacaggcatgagccactgcacccagtcaagaaatccttcttcacttagtctatcctaatgccatataccactctattttaattactgcagttttagaaaatgtcttcgagttagccaggcgcggtggcttatgcctataatcccagcactttgggaggctgaggtgggcggatcacttgaggtaaggagttataccccagcctggccaacacggtgaaacgccatcattaccaaaaaataaaaattagctgggcatggtagcgggcacctttagtcccagggaatggaggcagaagttgcagtgatccaagattgtaccactgcactccagcctggttgacagagtgagactctgtttcaaaaaaaaaaaaaaaaaagaaagaaagaaaatggcttagaatctaatagggtaatctccctgcttagttcttctctaggaatgtctaggctgtttttaaaccctttggtcctccgtatatattttaaaatcaacttgcctgatttcatgaaaaatcagactaaatttacattgaacctgtaggtaatttgggggaggattgccattcttaaaatattaagccattctatccataatacagtgggcctctccttttatttaggtcgtctacaatatcctttgatggtattgtattttataatgttcttcataaaagtattgtactttatttgataagtttattattcagtaccttcttttcattggtaatgtaaatatgtgtattgtttttatttatttaagttattcatttattcttttgggatggagtctcactgtgttgcccagggtagagtgcagtggtgcgatctcagctcactgcaacctccgcctcccggattcaggagattctcctgcctcagcctcccgagtcgctgggattgcaagtgtgagccaccaagcctggctaatttttgtatttttagtagagacagggttttgccatgttttccaggctggtctcaaactactgaactcaggtgatgcactcgcctcagcctcccaaagcgttgggattataggcacaagccaccatgcccagccagatatgtgtattgtttttaaatgttcttttagttgctggtgtatataattgtaaatgacttttgtatatctatatcccgcagctttcctaatgttttgtggttttgcctaggctaggacttctaatagtagtaagcaaccttattttaaaacagttgttgttgccaggcgtggtggctcacgcctgtaatcccagcactttgggaggccaaggcgggtggatcactaggtcaggagatcgagaccatcctggctaacatggtgaaaccccgtctctactaaaaatacaaaaaattagccgggcgtggtggcgggcgcctgtagtcccagctactcgggaggctgaggcaggagaatggagtgaacccaggaggcggagcttgcagtgagcggagatcatgccatgcactccagcctgggtgacagagcgagacaacgtctcaaaaaaaaaaaaaaaaaaaaagttgtttttaagtggggacagtttgttccctaggggacatttggcaatgtctggagactttttggtcatcacagttggggaagtggaggtgatactgctggcctcaaatagaaagaggccagggtgttgctaaacatcctgcaattataggacagctactacaacaaagaatttattcagccccaaatgtcagctgtgccaaggttgagaaactgtattttaaagggaatgccttaaacaatattttattattatgcagaattccaaacacaaaaataaattggtaaacagaattcccaataccaacagttaactattgtaggccagtatttaactcctttccttcccccaacttctgctgaattattttaaaacaaatacaagatatcacatcattccatctgtaaatacttctctgtgtgtcactaaagtagaggttcccaaattatggtttcagaatacccaaaaaatccttcagaccctcccagaagatctccaaggctaaaactattttcacaatggtactaagatgttatttgaattttcattctgttgacatttgtgctgatagtgcaaaagagttgaaaattgtggatgccttagcacaaatcaaggctctggcaccaaactgtacttagtggtcattgtacttttagtactgtcaaattctcttctgcttaaaaaaaaaaccaactagatttaagtaagaatgtgattcatgaagcagtacagttttttttagtcttctacctaatggttttagtgatcattgatgaatcattgcccagacctactattttattaagtctggccaaatggtggtagtctaatttaaaatttccttctgtattcattaatgatatttttctataaagaagactgtgcttataccaactgtttagttactcctaaatatcctttgtgtaggaaatggaggaaaatgatttatttattttttcccagaacagagttcactctaaagggaatatgtttaatgaattttgttgtatttattttaatgtacattattggtatatgctgttagttttctttctctttgttgatatcttttatcaagttaaagaatttctcttctatttctagttcactaagagttttcaaagttaatggatattgtattcattttccattgctgtgtagtaagttaccccagaatttagtggctgaaaacaacaaacataaaagtttctgtgtgtcaggaatatggacacagcatagctggatcttctgcttcagagtccctcacaaggctgcatcagggctcgactggggaaggaatgatttcctagttcatgtggtatttggcaagattcagttccttctctgtcttaggtggagggccttagtttcttgctgtgtgtttctgtatatggctacttaacatggcagcaggcaaacaagaagagccagagaaagtaaagaagatggaagttacatcttttccagccttatctcagaagtgacatcctatcacttttgccatattcatgagaatcaaattcctaggcccagctaaaatcaagtagacgggattacacgaaggtaggaatatcaggagttgggaaccatcaggtgctattttagaagcagccttccagcctgccctgtggcccccaatgactcatgtctcttgcatatggccctcttaatttgccccttcctccaggtctccaaaagtctcattctgttacagcatcagctcaaagtccagaatcttgtcatctaaatcaggtccagttgtgagtgaggcttatgggtgaagtttcttttttttcttgagacagcatctcactctgttgcctaggctggagtgcagtggcgcagtcatggctcactgcagtctcaacctcctgggttcaagtgatcctcctgccccagcctcctgagtagctgggattacagttgtgtgccaccacacctggctaatttttttatttttagtggagatagggtttcgctatgttgcccaggctggtttcaaactcctgggctcagccccccaaagtgctaggattacaggtgtgagccactgcacctggccaaagtttttaaaatacagttccttgtgtacagttccattcagtctgtagaaatgtgacattaaagatacaagttatcctcccttccctatatccagtatacaagggtggaacaggcatgggataatagacattcctgtttaaaggagggaaaataggaggcacagaagtgttactagtccatatcaattctgaaatccagccaggatgttagaagttccttgattccacctctgagttattcttcctttttcatgaaaggtagcatgtgttagcagctgtgtagttttttattagtctgcttcctgccagtagaattttgggagtctagtgacctcttttcgtgttatactatttctgggtttttttggtccagcctggcagtgttgctgctgatataattttctcaaaaactttgtcagtcctttgtgaaactcactggtgttcattccattgggtaatagtcacacccacgaatctaaggtacacccttctttactttgtgatctttctcagatggctgagggacaatgttcttaagtttcctagagcccctgttgttgagtcgcgaggacctattaggcacacccttaatttctttaaagagccctttgtatgacagaattactgggaaccattttccaagtagcccaccacaaaggttgtattttgtcaaattgaaggagtcatctgactttccttaatcataagctacaaatataataagctacattaatagattttctaatatttatttaactttgaatttctggaaaaaacccaacttggtaatgatttatcatctgagctttgtttttggctttggtatgctaatttttggcttaggatttttatatctatttcatgagtgacactgacctgtaattttcccttttcttactctctatgtctgtttttttttaatatagttatgcttcccttacaaattacttttgattgtcttttccctcaattttggatcacattttcctgatgctctcatttgagtaattttggagttatattttgtgtttctaagtcctgttaaaatccttggaagaatgctgattttatttttgttttggtagactgtcaggctggttaggttctaaaccacaagttttctcacctgtgaatagtatttccagtatcagttcaaagactgtgctatgctactttgggtctttcctatccacagaccatttattagttagtttggagctttggcaacagtttatattttaatttattctcagagcctttgctgtgcttccctgaatctctcttatgtgtgagctagaagttgtgctggttcatgtgcaaaattacgggaaaccctttctctggctcatcttttcctggattccccacatctctctggctcacagaggctcctttcattgttattctagtcagacgtttggatttctttcagagctttagctgcctgcgatgcgtttctgtatggctggtgccacccttagggtgaagagctcagaaaaagtgttaaaaataatgagaatgattcttacgctccttagaccactgtggtctttcccaattatttttgcctgaaatgaggggttttgcccagagtttttgctgctcacatttgtgcatagtgtggacttatggttctaattttattctaaggatctttatatttctcagggttttttgttttgttttttgaaaaagtcttagtttcttagcaggttatttttggtttatttaattctgggttggcaataattttctcttagtgttttgaagatattattccaccatccactagttgcagtggttgctgttgaaaaacctgctgtcaataattgtcaggcctttgttatatgtcatttctctgaccactttaagctctttatcttttgtgtattttgtttttattactgtattttgtgagtaggtgtggattcctttttttgtttagcttggtaaatgctcttcttgtaaatataattttagtttctttagacaacatagggctatttaaattgtttcttaagtgagctttggtagtttgtctttcaaggaatttgttcatttcctctaagttgttgaatttatgggcataaagttgttcataatccttattatcattttcaatccatagaatctgtagtgatctgtagaaccttgcattcctgaaatcagtaatttttacttggaacgtgttgagctctttggatcagtgagttttatagtttatataaaatttggaaaattgtgtactttttttttccaaattttttttctcttctttctcctttccttcaggactccaattacacatatatgagactgttggaaatgtttccatagttcactgatttttttcaattttattttcaaaaataggctttgttttttatagcagttctggattcatggcaaacttgaacagaaagtgtagagagttcccatatatgacttatccacacacatgcactgcctaccccaatatcagtatcctactggtatatttattacaatcgatgaatttatattgacacattattataacccaaagtccatagtttacattaacgttcactcttggcattgtatattctgtgggttttgacaaatgtatactaccatatatctaccattttagtatcatacagaatattttaactgtcctaaaaatcctccgtgttccccctatttatcctttcctttttcagccccttggcaaccactgattttttattctagccatagttttgccttttccagaatgtcatggagttggaatcatacagtatgtattcttttcagattgggctctttcacttagtaatatgctctttactccatgtcgtctcatgtcttgatagtttatttctttttagcactgctgtcaatacagcttaagtatctcttatccgaaatgcttggactagaagtgtttccaattttggattattttggattttgaaatatttgcatatacctgattagatatcttgagaatgggatataagtctaaatatgaaattcatttatgtttcatattacaccttatgcacatagcctcaaggtgattttatacaatattttgaataattttgttaatgaaacaaagtctgtgttaagtatgtgtggaatttcccacttgtggagtcaatgtgaatgtcacaaaatttcgtattttggagcatttcagatttttagattagggatgctcaacgtgtacttgaatgactgtactccataataactgtggaataatctgtggaataactgttttaatgcatttggtaattctaacatctgtgttatttaaaaatgagtatttttctcattacgagttgtgtttccctgtttatttgcatgcctgataatatttggatgccagatgttgtaaattttacttttttggttgctggatattttttgtttgttttatttttgtttgctggatatttttgtagttctgcaaatattcttgagctttgttctgggatgcagttaacttacttgaccagtttgatctttggggtttttgcttttatgatttgttaggtgagtctgaagaaatacttagtctgtgcctgattattccctattactgagtcaagacctggctgagtactctactaatatccaataaattatgagtttgtccactctgggtggtaagagcaagcactattccttgttctatgtgagttctgggcacagttccctgtaaattcgttctttccatttagcacatctccagaattctctctgtatacagctctctcctctttgattctctggcctgaaaactccaaccaggactttcagctccatttctcaacttagagtctgctgggctctgcctgggacccccttcttataccacagtctggatattttctcaaggcagtaagctggggcaattatggggatcacttttttccccatttctcgggaaacagtcttcttcattgcccctaatatccagtgttttgaaaattgttgtgcaacgtatattgtctttttttttttttttttggttctttcgggttggattactttgaagcctttcatttatagatatttcaatatggtcctttgaaagataagcactctttacttttttctgaaaccttttatattatctgaactcatcacgtgtgggcagcactgtgttgctgtgttcatgaaacatttataagttatgtactagtttgctttatttcccagtatatcagttttgttcagtaacaatcatttgatagattagtgctcacctttaaattttttaaaattttgggcagctgatggctatgtgtgttatctcctatttctttatgttatcctggattcagagccatagaatactacctagattctttaggaaagtctttgtgtgcctgacattctgtttattcttttcatatatttaaaaaaatatatttaatacatgtatttttccataaaatatatgttgtcatattgggttcagatcttggctttaccacttactgactgtgggaccttgaatcagatacctaacctttgtatgcctcattttcttcatgtgtaaaatggtgatagtaatggcatttacgtcatagggttgttaataaggtttaaatgcattaataatatgtaaagagcttaggatagtatctggcatctaagtgctataaatgtgtgttagctcttattatttttaccacaactaccaccaccactgcatatattactgctagtgtccatgccaggagaaccatgtctgttccctaggtggcatatgggtgtgtgtatgtaaagatgaggtgactgtgtggtcttgtgctgctctctctgagccctccttggcctctggagtaatagtattgctgtccacctggtcaatgtgtcctgctgataagtgctgttgcagtctgtggtcagcaaatggtccagtggttctccttgcttcactggcctcaccttggctcatgctgactctgaggtttgggtgtcatattctttaagccctggacctgggcagtaagacaaatagcccttagttactgaatctctttgcctcccctggggcaaaaccctgtccttcagtgattttgctagcagaatccccacctcccttcctcttctttcattgggcatacagaaaatttgggatgccttttatgccttgtgggagccagagaactctggataactaaatccatgccctccttcctcctaacccttctatgttgatgattccgcccccacattttcattaagggtcatcttgtgtagcagtctcctcccagaaccccaaatgggagatggatcaaagatgcctgtttttttagctttttcttccatctgcctagcatgtcttttcccttttggaactctatcctggagagaggagatgagaacagacttgtgtcactgctgcttccttcccactgttctcttctcctgtcatgaagacaccagaagtctaggccgggtagactttccatttcctcttccactttcctttgggcatgatggcaggtgtgatactgggaagggggaatctgcttgctgataaggaaatgtgtgttgggagatattttaaaaaatataatccttggctgggtgcggtggctcatgcctgtaatcccagcactttgggaggccgaggtgggcagatcacctgaggtcaggagttcaagaccagcctggccaacatggtgaaaccccatctctgctaaaaatacaaaaaaattagccaggtgtggtggcatgtgcctgtagtcccagctactggggaggctgaggtactagaatcgcttgaacctgagtggtggaggttgcagtgagcccagatcgtgccactgcactccagcctgggtgacagagtgagactccatctccataaaaaaataaaaaataaaaaaataaaaaaataaaataaaatattatccttgttaaacaggttaaagggaaaaagaatattttagggtaaaggtgggggtgccagtttagatgggaattagggaaggtttctctgaggacataacacttgaacaatttcaaggctgttttgtagtattgacaaaatttaatactaggatcaagattgcttgtgcacaaagccaaaagatgggctctcttatgccctcttcttcccatactgcagttagtacattctgttttctgcagtggtaactctttctggcctaattgctcagtttctcatactagtctctgtaacacatttattctgcttatcactatagagtcctagtatgtagaggctgacaaaaacctgaggcaatatttcttcaagcaagctaccggtttcagaaccatctggaacacttaaaattgctcctctcgaacccactccagtgtcataattactaacagtttcatttggaatctgatactgttgaatttatcatattacttgaggacgagcagtttgttattgttatctttttagccacacagcattgtaaattctaagtaaatgcttgataaattgatttattaggaagctaggagagaggcatttcaagtggtttaaaaagttttgctatttgggggtgacatcagcaaaagcggcacagtaaagaagtgtaaaattttacccttccataagagcgacagaagaactggcaacacctgtcagaatcaactttttcagaactctagaaattaaccaaagacttgaaaaaaagtgtgaagagtgctcattcacaaaaaatggctgaatcttagtaagaatagtgagcttacccaagccccattccctgttccatgtgtcagctggggctgaaataacagcctgtgtttctgtactggagggagcagaacagacctcattgtaagtatttgttttgccttcttaggtggatccctggatgaatgacttcaaaaccttgtctctatttctcctgactcagaactgccctacttctgagatcggggaggacagtagttatcaagaaacatttacagacaaataatttagtcattgcttcctgaatcaagaaataacaatgggggcaaacagtagactaactaaagagcctaggagcagagattgggaatgagatgtctatgagagctttgaaaagcttcacatattcccaagaatgtagaaggccacatgcttggcaaggactgtatgcatgcccagggaagacttctacctctcgctgatcttgaggctctgtgaaagcaggaagtgaagcctaaggcagagttagaagctacctggctaagtagtgaaggtgtatcccaaacctacccagagcccttctgcaaagacagacaggttttttggttccaagcatttaaggcagtctgttcagttgttagctggccattaagctaacagaatagagactccagtgactgcacataacaaggaatacagattttacagaattagttttgataagtcttgaaacaaacaactacaacaataagcagcaacaaaaaattctggagaggggagagaatctgattcccagagttgccacattataagatttaaaatgtctagtgtttaacaaaaaagtgtaagatatgaaacacaacaagaaaaaaagccatgaatagaaattgtccctgaggaagcccagacgttagaatttctagacaaacactttatattagctatttaaaataattcttcaagagctaaagaaaaccatatcttaaacaaaacaaaacaaaacaaaaaacccaaaaacctaactgaaagtttgagaacagtgtctcaccaattgagaatatcaacaaaaagatagaaattatgaactaaaccagatagacaagcatggtaactgaaatgaaaaatttgcttctagggcccatcaggagatttgaacaggaagaagaaagaaatttgaaggtagttctattgactttatctaatttgaagaacagaaaaggaaaaaagtaattaggaaatataaatagagcctaaagagacctgtgggataccatcaagtgtaccaacatacacatgacaggaatctcagaaggagaggagagatggtggggcagaaggatatttgaagaaataatgggccaggtgcagtggctcatgcctgtaatcccagaactttgggagaccaaaacaggcaggtctcttgagcccaagagtttgagaccagcctgcgcaacagcgtgaaaccctgtctctacaaaaaatacaaaaattaaccatacgtgatgacatgtgcctgtagtcccagctactcaggaggctgaggttggaggatcacttaagcccaggaggccatggctgcagtgagctgtgattgcactactgcactgcagactggacgacagtgtggaaccctgtctcaaaaaaaaaaaaaagaaaaaagaaaaaaagggaaagggaagtgaaatagtggctaaaaccccaaatttgatggaaaagcatgcatttatgcatacaagaagctcagtaaactccaagcaggataaaaccagagattcacagctagacacatcataatcaaactgttgaaagccaaagatagaatctttaaagcggcaagagaaaagcagctcatcatgtacagggtaacctcagtaagatgaacagcagacttctcaccagaaactatggtgcccagaaggcaatgggttgatgtactcacatccctgaaaggaaaaagcccaacaaaaactaccatatctggcaaaactccccttgagaaatgaaagagaaagaagatattcctcataaaccaaaactgtgagaattgtagctagcagacctgcctacaacaaatgctaaggggaattcttccagctgaaatcaagatgcactagatggtaactcaaatctgcatgaaagaataaagaacatgggtcaagttaactacatcggttaacttagcactggcccaagctggttcccagaaaaaggagaccgtccaataatcaactgccagaggacaggaaggatgaaaccatatttttctctcctcttcactttcaggagccctgcacatttcccatatttcagtatataatttttgagtaaattagcaaggtgagatcttttcaccagtctaattctactaaaaaaaaaaaaaagtaggcttagtattattagtccatagggaatgcagtttaaaaccacagtgagatacccctctatattcaccagaatggttaatattaaatgaatggacattacagagtaatggcaaggataatgttggtaggagttaaactagtataaccatttggggaaactatatattatggctacttagcaaaacatgcctagcttataaccctacaaatccactcctacatatattcacaacataaagaagttatacactttaaaaattacactaaaagacttacagaagaatatttatagcagcactattcatagtaatagctgaaagctagaaatggatccaagtacctatcaacagggggatgtataaataaaatacattatattcatgcaattagatattactcagcaataaaaagaagcaaaccagtgatacatacaacatggttgaagctcagaaatatactaagtgtacacagccagctgcaaataagtatatactgtaggtttccatttatatgaagttcaaaagtagctaaaaccaatcttttgtgatagtagttagaatagtggttattctggggggctgactgggaggcaacacaaaagagactgttgaggggctagaaatgatcactgtcctatctaggtggtggttacatggctgtatatataaaattttgagttacacacttcagacagtgttgctgttaagatctgtgtatactccatattatgaaagataatttttaggatcttaaaaaaaatcttgattgctctgtcagtgttattgaaatcaaggatgtataatattatcaagttcaatcatcctaaaaggaaattcaattatagtttcatttttgtaactgttaaaagcattaagatataaacatgttaaacaattctcctttgagacataaacataaaaacaggtctactgatgagtctgttgattaccctattgcattttagccaatgtttaaatatttggtcatgtatgttattcttgaagtgcagaatgtgcttagggtaattattagcaacatttaaccaaattggttctgttatttcacgctggaggaccagagcaggatgagtcagtaaggggacttttgagaaatgaaatgtcagtgtttttgcaaccatttgtaggccataaaaaaaaaaaatcagatttgttcttacaaagaatgcaggactggccaaacaccaagatgttgctacacagagagaataaaacaaccagagacaaaaccacagcagaactgctttcatccccaaattgcagaataagtactgagatatgaccgagaaacaggggagagaaagggtaaacagtggaggaaagagatttttttgaccttatgctaactattaatctgaagctagaaatgctgattttatctgaaaaattagagctttccacagttattcatttattcaacaaatatttgttaaacttccattatgtacctagaatcatcctgggcgcataagatggagcagcagacaaaacaaaaattcctgcccttatggaacatatattgggggagggggtgtggcagaaatgcatacacatattgtacatgtagcaatgaggttagattagatggctactttttctctttctttccttctttccttcctttccttcctttccttccttcctttcgtcctttttttttgacagggtttccatctatcacccaggctggagtgcagtggtacagtcttggctcactgcaacctcctcctctcgggctgaagtgattctcctacctcagcctcccaagtagctgggattacaggcatgtgccaccacgcccagctaatttttacatttttagtagagatgaggttttgccatgttgcccaggctggtcttgaactcctgacctcaagtgatccacccacctcagcctctcaaagtgctgggattacaggtgtgagccactgcacccggccaaggtggctactttttaaagtatgccatagtttagccttcaactatatatgccttatggaacctccagtttaatgctgctgttgatacccctcttagattttctaatgagaccttcctcagcactttaataatgaaatctactatatgactcaaggttgatgtgtcttactcagtggcaaagaacagaataagaaatagatccaaacatatcggaatttaagacagtggaatgatatcttacagaaaggagtcagggtattgggtcctaaaatcaacacagatcaaagctgaaattaataaaatagagaaaaatagaataggataaataaaaaccaaaatcaattctttgggatggtcagtagaaatgtaaaccctttgcaatattgatgaaaataaaagtgaatatgtatcataaaggatgaggaaagagaaataatcacaactgtaaacgatttttttttttttgagacagaatcttactctgttgcccaggctggagtgcctggctcactgcaacctctgcctctcaggttcaattgattctcctgccttagcctcctgagtagctgggattacaggcacgcgccaccacgcctagctaatttttgtatttttagtagagacaggatttcaccatgttggccaggctgaactcctgacttcaggtgatccgcctgccttggcctcccaaagtgctgaggttacagggcgtgagccaccacgcccggcctataaaagacatttttaaaaaatgataggagaatacaagaaagtacatttgtaatacatttgaaagtctagaaacagtggctgatttttgaagatagatggagagcttcagtaggttgattagcaccaaagagattaaacggtgattaagagatatcatttaaaaaggaagagatgatacacaactgaattatttctaatcagtggagaacagatgagtccgatgctatttaagctattttagtagatggaaaactccccattcattttccaaagctatgatttaatgtcagaacccaatagaaattacataaaagaaaactttagattagttttcttatgcatgcagatgctaaaaccataaataaaataccagtaaatagaattcagcagtgtagcaaaaactgatcagctattatgaccaaatagtttttatttcagcaacaaaagaatagttcactactagaaaaatctgtcaacagaatgtactacatcaataaattaaaggagaaaaccatatgatcatatcattcagtgctgaaaaggctctgggtacaattcagttgtcattcataataaaagctcttaagaaggaacaggaaaaacactacctagatatagtaaagactgcactcaacatgtttttactaagcatccattatatgcccagtaatattccagcagttaacagacaaaacatttagagccatctcattttttaaaaaagaaggagttgaatgtttagtttgtcagatggtaataagcgctttgaaataagaaataaagcagggaataggaggttgccaagagctgggatgtaggaattgtcagggaaggactcattggtaaggtgatatttgagtagagaactgtaggagagcaagtcaacaaagcaggcaaaaattccagccatcatgtatcctacggtctcatggtgggggagggggcaatacaaaaaacatgataaaaacatatagcatattagaaggttatagtggaaaaaaggaaaaacagaggaaagtaaaggggaccagggcccagaggattttgaaggtcagattataaagttagtagtctcattgagaaggtgatatctgagcaaagtctcaaaggaggtgagggagttagccaagtagatattacaggaaggagtgctccaggcagagagaagagtcacagtaaagtagctatcaagagaccacgcctggcctagtcaaggacctacaaagatgtcaataggactggagtagagtgaacaagggagtgtgtgaaggtcaggttattttatgtgggaccttgtagaccactggaaggactattttaaaaattaccttaatgaatttttataaggcaaacactcttataactattacccatgttaagaaatagaaccatatcagtcagtccagaagctttttcatgtaccctatcccaaactaagtcccctcctcttctcccaaactatccactattttggcacctttagaaatcacttactctgcttctttatacttttattacccaaatgtgcatttagacattgtagcttattcttactcattaaaaataatttgacaagtcttctcttttaatcgacagatttccaagtgatccattcctttctttaccatacactattttttgaagaacccaagctatttagcctgtaaagttattcacaatctgaattttgctgattggaaaattgtgcagttttgcaatcgaactgctgattatccagcatgttcttctgaattctctacttcctgtaaattgatcgctgagcccagaggcttaatcacactcaaggtcttatttggtgaggctatatacattatgtgtggttgtcatttttcttgtgattttagcagccattgatcctcagtgcctagattcatcaatttgttgactattgtaaagtgctgatattctaattctgatctcttttctacatcttacttggaacaattttatgaagagacatatccttgcctctatattttttggttgcccagggttacagcttttcatatacaaaaagcataataaatacttgattcttttgcttttttggggccagttttcaagataatggtttggttccttttcatcttcccaagagaccaattttatatgtttctatctgttgcaattagcatttttattgagttcaaattgttccttctctggccactagatgcttctacacattgcctcctgagtacttttgctgtgacctcagttgtgtctgatagcttccttgctacctggtatgataacatctggtgtgacaagatagtacatgctcagctgagcttagtgatcagctgggactacaggtgcccgccgccacgcccggctaatttttgtatttttagtagagacggggtttcaccctgttagccaggatcatcttgatctcctgatctcgtgatctgcccgcctcagcttcccagagtgctgggattacaggcgtgagccaccgtgcctggcttgtttattttatatcagtgcaagttggtaccctttgacctacatctccccatttcctcccatttctgcccctggtaaccaccatcctactctgctttgatgtgttttacttttttagattctgcatataagtgagatcatacagtatttgtctttctgtgtctaatttatttcacttagcataatgtcctccaggtttatccatgttgttacaaatggcagtgtctcctttttaaaggctgcataatatttcattgtgagtatatattaatccatatatatgtatatatccatatccatatcgtatatgtatcaccatttctttagccattcatccctacattttaggatttttttttttcattttaggacattttcaaaggattgtaaaaattctaaaaagagaatacgcaacagattattctttggattatagagcctaaactatttgctgtctagtcttttacagaaaaaatttgctgacatacactctagtagattcttcagaaagtgtctgtgggaacaatattctctgagtttgtaactttgataacagctgctctgtgccttttatacttttacaagtcatttttcctggatgtaagattcttggcttatttttcttccatatgtatattaaatagattgttcaatttcttctgggggaaaaaagtattgatattctacaagaaaagaaaattagaagccagtatttctggtgaatatagatgcaaaaatcctcaacaaaatattaggaaacaaaattcatcagcacatttataaggatcattcaccataatcaaatgggacttatatttgggatacaaaggtgattcaaaataatgcaaattaataaatgcgatataccacatttacagaatgaaggacaaaaatcgtatgatcacctcaatagatgcagaaaaggcatttgacaaaattcagcatcttttcatgataaaaactctcaaccaaattagatacagaaggaaggtatgtcaacacaataaagactatcataagcccacagctgacatcatcctcagtggtgaaaagttgaaagcttttcctgcaagatcaggaacaagacagaatacccactctcaccccaattctttttttttttttttttctgagacatggtttcactctgttgcccaggttggaaggcagtagtgcaatcacagctcactgcacctcctcctccgggctcaagcaatccttccacctcagcctcccaagtagctgggactacaggcacataccctcatgcctggctaatttttgtatattttatagagttggggttttgccatgttgcccaggctagtcttaaactcctaggctcaagcagtccactcaccttgccctcctaaagtgctgggattacgggtgtgagccactgtgcttggccttactctcaccacttctgttcagtacagtactggagtcctagccagagcaattaagcaagagacagaaataaaaggcatccacatcagaaaggaagaaactaaattgtctctgtttgctgatgacatgatcttacatatagaaagtcctaaagactccaccaaaaattgttagaactagttaatgaattcagtaaaatttcaagatacaaagtcaacattcaaaaatcagtagtgtttctatacactaacaatgaactgtccaaaaaagaaatgatgaaaacaatctcattcacaatagctaccaaaaaaaagacttatgaataaatttaaaatttaatcaaggaggtgaaagacttgtacactaagaactataaaacactgatgaaagaaactgaacacactaataaatggaaacatatcctgtattcgtggattggaatattgtttaaatggccacactacctaaaatgatctatagatttcaatacaatccctatcaaaatttcaatgacattttcacagaaatagaaaaagcacttgtaaaatttatgtagaactacaaaaagccccaaatagtcaaagcaatcttgatagaaaagaacaaagctggatgcatcacagtatttgacttcaaaatatactgtaaagctatagtaatcagaatagcatggtactggcataaaaacagacatataaacgaatggaactgaatagagagcccccagaaataaacccacatatttatggtcagttgatcttaagggtgccaagaatacacaatagggaaaagacagtctcttaaataatgttgggaaaactggatatccacatgagaagaatgaagttagactcttacctcacatcatatacaacaaccaactcaaaatggatcaaagttttatcttggaaaaaaaaaattttttttttcttttgagacagggtctcactctgtcacccaggctggagtgcagtggtgtgatcttggctcactgcaacctccgccttctgggttcaagcgattctctcacctgagccttcctagtagctgggactgcaggcatgtgccaccatgcccaactaatttttgttgttgttttcttttttctttcttttcttttttttttctttggtagagacggggtttcaccatgttggccaggctggtcttgaactcctgaccttaagagacccaccttccagctgggcacggtggctgacgcctgtaatcccagcactttgggaggccgaggtgggtggatcacaaggtcaggagatcgagaccatcctggctaacacggtgaaaccccatttctactaaaaatacaaaaaattagtcaggtgtggtggtggtgcctgtaatcccagctactcaggctgaggcaggagaatggcgtgaacccgggaggtggagcttgaagtgagcgttgagatcgcgtcactgcactccagcctgggcgacagagtgagactccgtctgaaaaaaaaaaaaagatccactcggcctctcaaagtgctgggattacaggcatgagccacctgtacctggcctcaaaatggattaaaggtttaaatgtaaaacctgaaactgtataactatcagaagaagacataagggaaaagctctgtgacattggtctgggcaatgaatttttggatttgacctcaaaagcactggcaacaaaaacaaaaatggtcatatgggattatgtcaaacaaaaaagctctgcacagtaaaggaaactatcaacagagtgaagagacaacctatagaatgggttgatatatttgcaaaccatatatctgatatggagttaatatccaaaatatataaggaactcaattcggcaagaaaacaaatctaaaaaaatgggcaaagaacctgatagacatttatcaaaagaagacatacaaatggccaacagttatatgaaaaaaatgcttagcatcgctaatcatcagagaaatgcaaattaaaactacagtgtacctcatacctgttagaatggctattataaaaaagataggccaggtgcagtggctcacacctgtaatccctgcactttgggaggccgaggtgggtggatcacgaggtcaggaggtcgagaccatgctggctaacacggtgaaaccccatctctactaaaaatacaaaaaattagccaggtgtggtggcgggtgcctgtagtcccagctacttgggaggctgaggcaggagaatggcgtgaacccgggaggcagagcttgcagtaagccaagattgagccactgcactccagcctgggtgacagagcgagactccgtctcaaagaaaaaataaaaaaaaataaaaaaagataacaagtgttggcaaagatgtggagaaaagggagacctatacactgttggtgagactgtaacttggtacagccgttatggaaaacaacatggaggttcctcaaaaaattgaaaatagagctaccatatgatccagcaatcccactaccaggtatgtacccaaaggaattgaaatcagaatgtggtagatatacctgcactcacatgttcattacagcactattcacaatagccaagatatcaacccaagcatccattcacagatgaatggataaaaagaaaatgcggcatacatacacaatggaatactatttagcctttaaaaggaggaaatcttgtcatttgcaacatcgttaataaacctgtagaacattattgtaaatgaaataagccaggcatggaaagacaaatacttgggatcttatttctatgtagaacctaaaaaagtcaaattcatagaagcaagagtagaatggtggttaccagggcctggaggttagaggagtggggattagagatgttggattaaaggatataaaatttcatttagacaggaaaaataagttcaagagatgtatactgtggtgactatagttaataacagtgtattctatacttgaaaattgctgagactagattttaaatgttctcatgacaaaaaagtgattatgtgaggtaatgcacatgttaattagcttgattgagccatttcaccatgtatacatattttaaaacatgttatatattcagttttcatcagtttaaaaaacttaatttaaaaaaaaaaagttttgatgttgaaaagtctgatctaattttcttctcctataggtaatttggatacctatactttgcctagatactcaaatattttttctttaaagtgcaataattttaatatgttttgttggtcatcatatagcagatattctcagatataccatgtgttctgtcaatatatagattaaaaaaactttttaaaaataatgttttcttaaattttggtttttagtatttgctgtgttccctttgattctcttcttcaaagactcctatttttcattaaagactttttttgcctgttaatatttttcactttcttttgaattgttttatttcttcttaaattttaaaaacatttcatatatatatatatatgtatttttttgaggcagagcctcactttgtctcccaggctggagtgcagtggtgtgatctcggctcattgcaacctctgcctcctgggttcaagtgattctcctgcgtcagcctctcaagtagctgcgagtacaggcatgtgccatcatgcctggctaatatcttctattttcaattagtttaaattggaaagcttttaaatctttgaaggcattctatttcacttataatttcttttaagattctcttgtatttattaactcttgtcttccttctagtttagtttatttttgtaatgatttttccttccatttctaaattcctgagctctatcaccttatttctaatatgatttatgtatcattttctcagtgtcttttagcttgttttaaaatagtaagttacaattttaatgttttgtgggcatgtctttttttctctataggaatgttcttcttcttctctgttttcttttaacaactctttatggtatttgaccaaatacttttttgtcactcatttttactgaaaaacagttttctcaagcttttgggaggaggaatagttcaagctgtctttattaatttcatagctctccatctcctgttttttggttttgttctggtaaagcgttaaataatatggtggcttgctttctgagacttcctgactccatagcctcccctcgcttgtatcggggccttctctttcctttgtctctgtcaccattgtaattagcccaattctgattctcctcccagaagtttctaattgcgatgtcctgtcctggaaaggagctttggctggttggtttcaagttcatgtttcccatctttctctggcccctttgagaacctaccagtggcccttatagtcactttttggtttgatgaaacccttcccaatttcaactggtgttctcaaatagatctgctctgatttttagagtttggtttatggctgctgtggtgtttcccattctcagttttcagatgcgttgttgcttctttttctttcaccacattaacattcattccatgaggggattgtggttactgttggttgtctccacgaacttgtattttggagtttgtgagctactttgtcatctagttttgttgtccatggtgttttagttttgttattggattactttgcatgtttttagggaatgatttggtgagatgaaaactattcagaatagttttttctatttggatgatctcatcaaatcatcccctaaatctatacaaatcaggaaatctattcaaataggaaaaactattctgtgattactcagattccctctcatttccagtgcctagtcactctgagtgactagggagtcattgcaggattttgagcaatggagtgacatgacctgactggtgttttaaaggctctgtctggtgatagactgagaatagaccatagaaatgtagaggaagaagtagggggacctattagaagaatgttgcagaaataggctgggtggatcacttgaggtcaggagtttgagaccagcctggccaacatggcgaaaccctgtctctactaaaaatacaaaaattagctgggtgtggtagtgggtgcctgtaatcccagctactcaggaggctgaggctggagaattgcttgagcccatgaggtggacgttgcagtgtgctgagattgtgccactgcactccagcctgggcaacaagaatgtgactccatctcaaaaaaaaaaaaaaaaaaaaaaaaaaaaattgcagaaatccaggtgagagatgtttgcttggacttggggagcagcagtggagttaatgagaagtggccagatttgcatatattttgaggtatagttgataagatttcctgatggatttgatgtgaagtatgagagaatgtagttgaaaaataactctggttttgtcctgagcaactgtaagaatggagttgcttttaactgagattagaaggctgaggctgccgtgcgggtaaggtagactttaggggtgacataaagagctcagtttggactatgttgagcttgagatagttattagacttctgagtgaagatactcttcgtgattctgcgagtcccatgacagcatgaggtaaaaaaagaaagacattgggccgggcgcagtggctcacgcctgtaatcccagcactttgggaggtcgaggtgggcggatcacgaggtcaggagattgagaccatcctagctaacacggtgaaaccccatttctactaaatatacaaaaaagtagctgggcttggtggcgggcgcctgtagtcccagctactgggaggctgaggcaggagaatggcgtgaacctgggaggcggagcttgcagggagccgagatcgcaccactgcactccagcccactgcactccagcctgggtggcagaacgagattccgtctcaaaaaaaaaaaaagtttatcatagaaaattggaaaatatggataagttaggtaagaaaataaaaatcatgctgcattgtaaacattctgatatgattctaaacatacatataacatgcatttagaacacatcgcttttttctttccaacttttaggttcagggagtacatgcacaggtttgctaccggtaaattgtctgtcacgggggtttggtgtacagattgtttcatcacccaggtaataagcatagtactctatgggtagtttttcgatcctcaccttcctcccaccctcgacccttaagtaggcccaagcgtctgttgttcccctttgtatctatgtgtgctcagtgcttagctagcacttataagtgagaacatgcagtatttggttttctgttcatgtattaattcgcttaggataatggcctccaactccatccatgttgctgcaaaggacactatttcatttttttatagctgtgtagtattccatggtgtatatctaccacattttcatcatccagtccactgttgtgggcatttaggttggttccatgtcttagctattgtgaacagtgttgcgatgaacatacagttacatgtgtctttatagtagaacgatttatattcctgtgggtatatatccagtaagggggttactgggtctaatggtagttctgagttctttgagaaatcttcgaactgctgtccacagtggctaaactaatttacattcccaccagcagatataagcatactcttttctttgttttgttttgttttaaaactaaagcttattctggccaatttactctactattttctaataacagctcatagatcagaaacggtctttgttttaaactttcctatccatatgaaacacaatgatgttggggtaagaggggccttttctctaaatgaaaatacaatacttattctgtacaattctagagggcccagagatgtggaaataatgtatttgtaagaattatattaaacaatctttatttgataaatagtaccttacaatcctaatgctatctatcaagcttcagtaagagcaatttcagcatcaagtaatgaacagtagctaaactgacaagagatcaatcaaaagggctttaaatggagcagcaccagctgatgtgctgctaaggctctgggcattcaggactctcctatggggaaaacggaatcaaaccagcaggtgctctggacctaagccttcacatcgtgacctgcctccctcctgggggtgtggtggcccacagtccccctggcatttctcggcccttgtgggctgcagacggaaatcctggcaccaaaggacagcttgggaaaggctgaaacttgacctcacagtcagctggcttctgcctattgtggtcattttctttccagagcacctagagcactcgcacagtggacgtggaagccacccagcattcttgggctgttttctcatagaagaggaccttcctctaagcattggaagcgtctttctccaattcctgggccagatcttgggccatcttcttgtaggtcatgggtctgacacacatggttcaagttttcgtggctattgtgaatgggattgtgtttttgatttagctctcagctcggatattgttggtgtatggaaatgctatttttgtacaatgattttgtatcctgaaactttactgaagttgtttatcagatctagaagcttttgggcagagactgtggggttttctaggtataaagtcatatcgtctgcaaatatggaagatagttgacttccactcttcctggatgcctttatttttcttactactctatctaggacttccagtactgtgttgagtaggagtggtgagagagggcatcctggtcttattctggttctcaatgggaatacttccagtatggtatgcttccagcagcacatcaactggtgctgctccctttaaagcacttttgattgatttcttgttagtttagctattgttcattacttgatgctgaaattgctcttattgaagtttgatagatagcattagaattgtaaggtactatttatcaaataaagattgtttaatataattcttacaaatacataatttccacatctgtgggccctccagaacatttcagcatgttctggatgttggctgtgggtttgtcatagatatcacttattgttttgaggtatgttccttcgatgcctagcttgttgagagtttttaacatgaagggatgctgaattttattgaaagcattttctgtgtctatcgagatgatcatgtagtttttgtctttagttctgtttatgtgatgaatcacatttattggtttgtgtatgttgaacccaccttgcatcccagggataaagcctacttgattgtggtggattagcttttgatgtgcttctagtctctgtttcctagtatttttgttgaggatttttgcatctgtgttcatcagggatattggcctgaagttttctttttttgttgtatctctgataggttttggtgtcagaatgatgctgacctcatagaataagttggcaaggagtccctcttcctgaatttttgggaatagtttcagtaggtttggtacaaggtcttctttatacatctgatagagtttggttatgaatccctcctgtctagggctttttctggttggtaggttttttagtactaattcaatttaggaactcattattggtctgtagaacacattttcacaaagttgaatttctattgtatatacattttaaaatcttctttcacaagacatgacctgagcattttctaatagtgaaagtctttgaaaacatggtttttaatggtatttcattacatgttttactgtaataaacctaaccacttggattatgtactctttcactcattcctttttgcatatctgttccatcccctatgctttaatatggaggatttggtttcttgtagtagttgctgggtatcataattcagacctgtggtttggcagtcagcctggctgtagtgtttaactgagtctcgtggaagatccatgcttaaaatgaatgtcgtggagaattgtattcacctcagtcattcaagactttggcatagaccccattccttgaggaggagttgccgccactgtgactgccacagacggaaggaagcctgggcagttgggactggggagaacttgctgagtcacagatatcttgtctcagtgtgcatgggccgtgtgtattgaaatgtaccagtctgtgaggcactatgttttgaggtctcagtaagctaaaggggtgtagaatggtatctagttcataccgtagtatgctttagatctaagtgttggttaattctgtaaggactgaaggaataggggagatttaatgagctccttgcagtctgcaggttattatcgagaaaagaaaattaggctctcagttccaggcccatttccctctaatcactgtgtccttttgaacaaaagttggcaaactttttctgtaaagggccagatatttttagctttgcaggccatatgatttctgttgtaagcattgagctcttctgttatagagcaaaagcagccataggcagtacaggaacaaatggccatggttatgttctagtaaaactttatttacataacaggcagcaggccagattggagcaatagttgtcaactcctgctttgaaaatgttttggaaactgtgtctccgtctgttagtggtcattatcctcagtctcttaggatcagagtttttcttagattacaaaactggatcatacagacctgacttccaggtctgcgttctctccactacactttgctgcctcttagaaaaacataagctaaataactagaacccatggaaagagggaaaagtgaagcccagagagctgatgcgggactaagaggcaactctgagagtttcaatgtggaatgtttgtgtggctccccaaccagaccgtgacctccttgaagattgggactgcatcgtatcttgttctcattttctattttattttaatgatctatcctttgggttgaacgaatgtgtttcttgaacccgataagtgcaacactgagtaaacacttgtttcttttctcccttccatcctcccaacttagtagcttcaatacattcttagctctcctcacttgctattctctaaccataccacgtggctgggcacggtggctcatgcctgtagtcccagcactttgggaagccgaggtgggcagatcacctgaggtcaggagttcaagaccagcctggccaatgtggcaaaaccccactaaaaatacaaaaattaactgggtatggtggtggcctgtaatccccagctactcaggaggctgaggcaggagaatcgcttgaacccaggaggcagaggttatagtgtgctgagattgcgtcactgcactccagcctgggtgacagagcaagagtccgtctcaaaaaacaaaaacaaaaaaaaccccaggttatctccatgaatgtgaatattgatgtggtccttctgtcaggaagacatcacctgagaccacacacagaaagcctatttttccttaggatacagtcctacatcagggttgacaaagtttttttgtaagggttagatagtaaatattttagattttgcaagccatatggtctcttcctcagctactcaactctgccgttgtactacaagagcagccatagacaatctatacatgaatgagtgtggctgtgttccagtaaactttacttatggatattgatactcagatttcacatgattttcatgtgtaatgaaatgtgattatttttatttaaaacattaaaaatgtaaaagccattttttgcttgcaggccagacaaaaacaggcagtgtgagtcaatttaatttaatgtgtgactcatagatgctaacccttgccttagctgcttagtaacttgccctagtcatgtgttaccccatgaaaagaatggcctacttctgtcatattgtctctaacctctgtcatttcatttatgatgctatgtattatgtgtacctttgtctctcttgctggattctgagtatcttgagaggtaggccatggcctagtcagtcatctttgtatccttaatatcaaacccacatagtgggtatttaagaagtgactgttgaatttgaattttatgcttgatatatataaaatgtcatttctgctgatcttaaagagaaacacttgactgatatgcataggtttcccatgttcttccccttgagaggccatagttaactgcatttgctgctagcggctcttgtaaactcagtggttatacagcaaagcctttgcaaagtcttttattttagagctctttttcagacaagaaatgattatactttttcttcaaatcatttattcaatcataatgataaatatggctttcactattctgatgaagcagagctaccatcagtgtgaaataataatagccgttgtttagtgagcatctactacattccagtcaattcagattttttctctagatttttggtgaccttctgattactattaatttacattttttttattgttctctacatgtcaaacaaaacaaagcaacaatatcaaaaacccacatgctttttcttcatactgtctatattattgaatgacagacaaacatctgtccttcaagtcaaatattaattaatcatagactcctttctctttttcttcaccccgccttatctaattggccactgtcttagcttttttttttttttttttttttaaagatggagtcttaccctgttgcctagtctggagtgcagtggtgtgatctcggttcaccgcaacctccatctcctgggttcaagcaattctcctgcctcagcctcccaagtagctgggattacagacatgcaccaccacacctggctaatttttgtatttttagtagagatgggatttcgccatgttggccaggatggtctcgaactcctgacctcaaataatccacccactttggtctcccagtgtcttagcagttttaaaaattatctttggaatttgtctcatctctatttctaattcatttaatctaattgaagccttaatcatttcttttcttccaacatgttgagcatctgttctgattttcctgaccccacttgcctcattctccaattattcttcccatagttatcagcactgaatgctaataataatactttgttcatatcagttgttattaaaactcttcacttattccttattatcttcaaggtaagcccagcttcccagtcatgacatacaagactctatgtgtgaccccaatacttaacacagatgtgtttcagaattcagaattttttggattttagaaaagtaatacagtttatgcaatacatatataacatcctctgctcattcctgaacactgatgggagtgaatggcaggtgcttttaataattacgctgaggtaaattatgctaggtgtaaactggacctgtcctgggcaaacgaggatgttctttacacagtttaagaatgtcaagcaaagaacattagggatgaagcaatacagggagaatagatagagtgaagggagcagtgggttaagtggagtcctggagaaatatttgaaaagggagaaaggaatgtggctcctgaggtaggagggaaacctggagcaggtagccccacagaagcccagggaagaggcattgtttttctattattttggaagcagatcccctttaggagactcctcatcagataatgattattcactaagaggttatattcttaattaaaagggcctttaccttttcttagaatactatgtttgaataactttttatgtattacgatataaaagtctcttttaagcatttctgttttatagtcatttggccaaaatctaattcagatccagcttaaatccaaatgtcatttgatgctacattttatcctgaggttgctagttatttagtcaaatatagtgagtataatcactacaggcttagagtaaatttccatgtcaagaggtagaacacatttattctgtaatattgaatcctgtaatattgaaaatcaaaaacagcccttttttttcttctgtagaaaataagatttttaaggaaggcagcaggaaaatagaacaagtgaatattttacgttcttagtggtttatggttggcagttttcccccaacattttgttacgaaaagttaaaatgtacagaagaattgaaagacttatacccaccagctagattgtgccattaacatgttgctgtatttactttatcactgtccatctctctgaccatctatttgtccctctttccatccatcagtctgtcttttttttggtaagcatttcaagtaagttgactggcaatttttctaagcagctgtatctttattttgttactgtttttttcctggatgttgtaattacagtgtcaagacatttaataatgcacatgtttcagctaacccttttcccaatttctagaaatctgagattgccaataatccctgtcaatcttaaattattttttaattctggtaaatagtgtcaaacctgattagtgccctctttctcaattgttttgtaatccagacaactgttagtcattaaaacataatttatagtggttttaaagcatgattttctaaaaaattttaaataaatatttattcatattatgttgttttcagagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggtaagtgagattttttaaagcaactgagaaaactagattttgaatttgggatctgaatacgtttttttcttattttatttcttgctatttaatgatcagaaaaatatattttttttttttttcatttatttttattttattttattttattttttttattatactctaagttttagggtacatgtgcacattgtgcaggattagttacatatgtatacatgtgccatgctggtgcgctgcccacataatgtgtcatctagcattaggtatatctcccaatactatccctcccccctcccccaaccccaccacagtccccagagtgtgatattccccttcctgtgtccatgtgatctcattgttcaattcccacctatgagtgagaatatgcggtgtttggttttttgttcttgcaatagtttactgagaatgatggtttccagtttcatccatgtccctacaaaggatatgaactcatcattttttatggctgcataatattccatggtgtatatgtgccacattttcttaatccagtctatcattgttggacatttgggtaggttccaagtctttgcgattgtgaatagtgccgcaataaacatacgtgtgcatgtgtctttatagcagcatgatgtatactcatttggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctacctggtgtgagatgatatctcatagtggttttgatttgcatttctctgatggccagtgatgatgagcatttcttcatggttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggatgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtcggcaaacgagggacaattggacttcctctgttcctaattgaataccctttatttccttctcctgcctgattgccctggccagaacttccaacactatgttgaataggagcagtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggctctgtttatatgctggattacatttattgatttgtgtatattgaaccagccttgcatcccagggatgaagcccacctgatcatggtggataagctttttgatgtgctgctggattcagtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagacagtttgttatgatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatattgacagtggggtgttaaagtcttccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaccttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaaccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaatacactgccgtgtgaggtgtcagtgtgccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatatttgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctcccccagaaaaatattttgaattagaaaaatttgggcctagtggcctggcacgctggctcatgcctgtaatcccagcactttgggaggtcgaggcgggtggatcacaaggtcaggagatcgagaccatcctggctaacacggtgaaaccccttctctactaaatacacaaaaaattagccaggcgtggtggtgggcgcctgtagtcccagctacttgggaggctgtggcaggagaatggcatgaacccgggaggcagagcttgcagtgagtagagatcacgccactgcactccagcctggatgacagagcgagactccatctcaaaaaaaaaaaagaaaaacttgggcccagcatagggctgacacctgtagtttcagcactttggaaggccgagatgcgagtgagcccaggatttcaagactagcctgggcaacatagtgagacccccatctctacaaagaatataaaaattatccaggcatggtggcacatgactctagtcccagctacttgggaggctgaggtgggaggattgattgagcctgagaggtcaaggctgcagtgagctgagagtatgccactgtactgtagcctgggtgacagagcaagaccccgtctcaaaataagaaaaaagaatgaagaaaaattatatttgtagaatgctttcttatcagcagtcttccactgcattttaaggataactggctcgttggggatagttcttagggtattttgctcagtttctaggaatgatactcactgttgggagatttattctcagccaattactgcagatctgcataaacaccataattattagtgaccttacttctgatttctttctttctgtaaatctaatagccactttacttttaaacctttgtttagatgaggcataatttttggatacctaaaagctaaacattggttacactagaaaaattattaaacactagccttctgattaagagaaagttgctattaaagtgacattacagtttttattttaataagttatgctcacgtctttacaatatattatttcagaaagtgctgaaaattcagagctagattatatagcctaccagttgagtctatttcaaatcagatcttatacattcttttctttattgcagtaagatatatttaacataaaatttaccactctgacactttttaaagtgcacaattcagtggcattaaatacattcacattgttgtgcaactgtcaccaccgtccatctccagaacattttttgtcttcccaaactgaaattctgtacccatactcttcattgcctggtccctgtcaactgcagttttttgtgtcacttgtatatattcttttttgaaactacatttcaaataagacaaccatgctagcataagttcactgataggctatttgattccaaggtgaaaattccttggctttgtctgatattctcttgtttatatcagtgtccttccctccctacaaccatataaccgtatcatgtttttattctgtcttttgataactttaattgacaaatttatgccacatttatttcatgagattaatttctatgtgaattcctttctcttaggtattacttttatttccccttttcaattcattattagcagctatatgggaagagctgccttcttgtaaaccatcacatatgagggcaaattaaaaaaaacaataatcgctatcctctttacactttttatatatatataaatatttccattataaaaatataagctcattatatgaaacttacaaaattcaaaggataagagaataaaaatcacctgtaatgttcccacctagacacatacacatattattcttttttattttcttatttatttacacatattattcttaatattttgatgtattttctctcctctgcattatgttaaacaaaggtaagattacgtatatcatcttacctttatatacacagttttgtatccagtccttttaatattcacgagcattttcccattgtgtgcatgctttttaaacataatttttatagttataaaccttcatagaagccaccttaaattctttctgaagcacagtagtaaatgaatgaataaatcaacaaacaaaatacatttccctggtagatgttctacaattgattttaccattttgttgtttaccgttttctctttgacaaattgtgctgcagtgaacatctttgcagatactcaattttaggattttttttttaaggtaggatcaataaaaatagaactaaaccagggtaaagtatctgagatttttaaaaggtgtttgatatctattgatactaaaaaacctttgggctggccacagtggctcacgcctgtaatcccagcattttgggaggctgaggtgggtggatcacttgagctcaggagttcaagaccagcctggacaatgtggcaaaaccccatctctacaaaaaatacaaaagttagccaggtgtggtggcacatgcctctggtttcagctgcttgggaggctgaggtgagaggattgcttgagcccagaattttgaggttacagtgagctgagattgtgccactgcactccagcctgggtgatggagcgagatcctgtctcaagaaaacaaaaacaaaaaacaaacaaacaaaaaacctttgaactgccagcataattgaggtaatttattttagatttttgttggttttaatagatttcattgattaatgtaattgaacattttccagttattagctatatgtatatattcttttatgaactaagtttttactttatttatttgagacagagtcttgctctgttggcacaatcttggcttactgcaacctgtgtctcctgggttcaagtgatgattctcttgcctcaggtgggattataggcacatgctaccacgcctggctaattttttttaattttttatttttagtaaagttagggtttcgttgtgttggcctggctgatctcaaactcctgacctcaagtgatctacctgccttggcctcccaaagtgctaggattacatgagccactctttaaagttttatatgtattaaagttttgtgagctctttgtaattggtaattcatagctatctcctttgcacaatagtgaaagggttttttattaccaagatacatgtacaatgctattttgagggttcttaggcagtagacattatagttttcctacatgcaaattggcttggctagattatcctttgctttcttgagtggtgggttgggaagaatgctatggtttgaatccatgtgactaaagaatctatttcatacacacttgtggtttttgaaaggatttcaaaatacccactgaaattaaaaaacacccacccttcccccccccctcccccaccgtctctgcctatctttaaagtgacagataattttgaggaagaaaagatgaagtgtgaactatagtggtgtttttgggccttttgtggtaatgcatacaaactgacagtcttgtcttgtgagggtaggtttcataagacctttttgcaaactaaatcctgtgtatcttcaaagcttttttgcctgtaataagtcagatgctaatgtatccagcactgatgatcatgaggtttttgtaaagcagtgcttgaaaagagattgttgaccgttagctatgatatgagatgggccccagagaaagaggtggctggcgaaggtgttttccttagttatggggtgagagtgggagaaaaataacattttgactgagaatataggatttatatctctaagcctaaaaatactgggttggtttttttttttttttttttttggtacaattctgggtagtctgcaagtaatattgagtcagcacattttagggacatattacccaatattgaatggataatcatgcttcatggttactgtgactcacatagtaaattggtaatgaaacgttaacatattttataccctgtcccaccatagtctctaatcctaaaattatagtatatttcagtaaatggtgctgtctaggttacatcgtcagccttcttgcatagattcttaaccttttagacttaggaacttatttgagaatttgatgaatcctgtggatccccacctcagaaatacagacacatgaatacacagatttcactcacaatttcagtggatacatagatataccagaagtccatcagattaaggactcctattagccacaatttcagtggatgcatgtgtgccagaagcctgacagattaaggactcctattttatagtctccttgctcaagctcatccactcatagggctttcattacagcctatttgctgattatcataaatctgtatttcctagtgggtctctttcctgagccctaggttcattatttccaactgtcttctgtatgtgtccaccgaaatgctctcaaggacctcaaattcaaagtccaaaattgaatttattttctaaacttgttccctgagaggcagaagctaggtggaattgttcattaaactgagcaggaatccaccttgagagtggggatgatgctgtgctcatctatacttgcggtacctatgagccagagagcagatttgaggaacagagtcctcagggcacatggctcaaaccccaaaacaattcaagaacctggttgctaaagttagagagctgaaaagcagatccaatttatgaatggaatatttagttggaaacctgagtagatagtactgaggaagagcaagtgatcaaatggaaaagcatgtaccaaggtgcagaacccacagtaacagacaagaagaaacatgaaaatgaagtcagctgggggacaggggttagattaaatccctaaaccaaacaacaaaaagctgcagcagcagttggaattgatattcttacattaaaggtaaagcctggaatgaatgcatacttgtgttttctggttcctatactcagcaaaaactgcttgttcctgtttttttctatctccatacatagcatgcttattcacccagttacccaaattaggtctcctcacttaaaattcatgaatgactccactgttactacaggatagagtctagacttcttagaatgacatttacttttctagtatttgggtattttctcattatctttttgttgttgatttctaatgtgaccattatggtcagagaacactcattatggtttgtttcagtcctttgaaatatattgaatattgttttatggccagtatatggtcttatgtgatcagttgaaaaaatatgtattctgtgattgttgcagagttctgtaaatatcagtgaggtcaagaaattttatagtgttgttacagtctaaatcttatttgattttttggtctgctttattaatgttgggaaaattatgaatttttcaaattttccttacatttctagcaattttgtttcatgtatttaggatctatattattgggaacacacccatttagaccttcttgaagaagtaactcttttgtaattatgaaatatttctctttatctctgctgttaccctctgaaagtctactttatctgatatgaatatagccacaacagtgtttttatgtatactatatacatggtatattttcccgattcttttacttttaatctgtgtctttatatagctggctttgtttgttaatccagttttatagtctctgccttttaaatggagagttaatccacttacatttaatgtaattattcatctgattggatttaaaactaccatcttgctatttgttttttatttggatcatctatttttgtttctttgtttctcttttcctgccttcttttggattaatcttttttggtattccattttatatattatctcctctttttagctatacctcttctttttgttttgtttttgcttatagtggttactgtaagacatgggctgcacattttttatattgtaaaaatccagatagtaggccgggtgcagtggctcacacctgtaatcccagcactttgggaggctgaggcaggtggatcacaaggtcaggagatcgagaccatcctggctaacatggtgaaacccccgtctctactaaaaatacaaaaagaattagctgggcttggttgtgggcacctgtagtcccagctacttgggaggctgaggcaggagaatggcatgaacctgggaggtggagcttgcagtgagctgtgatcactccactgcactccagcctgggcaacagagcgagacaccgtctcaaaaaaaaaaaaaaatccagatagtaaatatattatgctttgtgggccacagttgggctctttgttctttacttgaagatccagattttcatctggcatcatttctctttagcctgatgcacttcctttagcagttcttatagtaaagacatgttgactactaatgctcttaggtttttttttttttttttaatttgaaaatgtgtttgttttttttttaatttgagaatattttgctggacatagagttctaggctattggtcgttttgtattttttttaactttcaacattaaaaagatactattttattggcttcccatgtttttgatgaaagtcagctgacattcttatgaatgtaattttttttctttgactgctataagatttttccctatttttggttttcagcagtttgattataatataccaaattcgtagctccgttctactgccatctcctgtgtgggcctcagttttgattagtttttattagcctacctttgaattcattgatcccttctttttctgtgtccagtctgctgttaaacccatctggtgacttcttcatttcagatcatttatttttcagttctagaatttccctttctctgctggaattctttgctctttacccattctgttgatcttttcctctaaattatttaacatattcataataacttttaaagtcttcatccacggatctctccctgttgactttgtttctttattatgggttataggcacaccttggagagactgtgggtttggttccagaccaccaaaataaagtgaatatcccaataaagcaagtcacacataatttggtttcccagtacatataaaagttatacactacattgtagtctgttcagtctgtagtagcattgtgtcaaaagaaaacacaatgcatatgccttaatttaaaatactttattgctaaaaaaaaaatgctagcaatcatccaagccttcagcaagtcataatcattttgctggtggagactcttacctccatgttgatgactgctagaccattcagggtggtggttgctaaagattggggtgactatagcaatttgttttgttatgtaatattctatatcctttgctgtcttttcaacaatattcacagcatcttcaccaggagtagattccatctcaagaaccactttctctgctcattcttaagaagcaactcattcattcaagttcaatcataagattgtagcaattcaaccacatcttcaggctcacttctagttatagttcttttgctatttctaccacatctgcagttccttcctccactgaagtcttgaacctctcaatgtcatccgtctgattcttccaaattcctgttaacattgaaattttgacctcctcccatgaattacgaatgttcttaatggcatctaaaatgatgaaccctttccagaaggtttgcagttgactttgtgcaaatccatcagaggagttggtatctatggcagctatagtcttaagaaatgtatttcttaaataataatcttgacagggccaggtgcagtgtcttaaacctgtaatcccagcactttgggaggccaaggtggatggatcacctgaggtcaggagttcaagaccagcctggccaacatggcgaaactccatctctactaaaaatacaaaaattagctgggtgtggtggcgcatgtgtgtaatcccagccactcaagaggctgaggcaagagaatcgcttgaaccggggagggagaggttgcagtgagccaagattatgccactgcactccagcctgggtgacagagcgagactccatctcaaaaaaaaaaacaaaaaacaaaaccaacttgacagtagaaattactccttgatccatggactacagaatggatactgtgttagcaagcatgaaaacagcattcatctccttgtatatctctatcagaactcatgggtgacaaggtgcattgtcaacgagcaatagtattttgtgagaaatcttttttcctaagcaataggtctcaacagtgggctgaaaattgcatttttatgttatggagatagcttctttccttaatcttcataaacaaacaacctctactagcctccaacttttcctctcacagcctttataaaattgaagagaattagggccttgctctggattaggctttggcttaagggaatgtcatggctggctttatctgtctagtccactaaaacttttgccatgtctacagtaagactctcactttcttaccacttgtgtgttcattggagtagcacttgaatttacttcaagaacttttcctttgtattcacaacttgactatttgatgcaagaggcctggctttcagcttatcttggctttcaacataccttcctcactaagcttgattgtttctagcttctgacttaaagtgagagatatgcgactattcctttcgtttggacacttagagcccattgttggattattaatcggccttttttcaatatcaatgtgtcacaggaacagggaggcccaaggagagggagagagatgggggaacaaacagccagttggtgtagcagtcagaacatacacaacattgattaagttaattatgttatatgggcttaggatcgtggcaccccaaaacaattacatggtaacatcaaagatctctgatcgcacatcaccgtaacagatacaataatgaagaaggttcaaatattgcaagaattaccacagtgtcataaagagacatgaagggagtgcatgttgttggaaaaatgtcaccaacagacttgctcaccacaggattaccacacaccttcaatttgtaaaaaacacaacatctgcaaagcacaatgaaatgaggtatgcctgtactcatttgcttcttcacatgtcttagaagttttaactgcatactggaccttttgtataacagaggggtagagaatgaactaggtaatactttttgttttatttttgttaaagagagcagttctttcctccagcaggtagctaaggtgatcactcaaatttgacagtgaatcaagctgagctggggctgagcagtagctttaattgatttcagtttgcctctggattcaaatgagattaaggaaatttgacttttagcccaaccttagctttctatatcatttagacgaggggttcatttctttgattttagcaagattgcagctgggaggcagttgggttgaagattaaattaatttactttacctctggattgcaactatagcagggccctggaacccaagcaccacacagcattgggagatctctttctgtctctcactgtgctcccaccagcacttactaagattctcttgtagtattacatgtaattgtcaggtcaagagatttgtttttacacttgggactctttcagattctaattaatcataccagtccacagtctcactaaaagtttggcttgtttcagcaaaatctttccacctatgggagacctccttttctgcccacttgtacccagacaggcaattgattcaaggtagctagaaacaggcttttgtttctctgtgaagaactcatccttctccagaaattggctcagttagacttcttggcattcatttactgctttttcatggctttacagaaaagtatgaagtttagtttatctggtgttttcttgttttgatgagagcagtggtcttttgggatcagctgcattcaaaccaggttggaacgctttagaatgatggcattaagattctttgccttctgctttcaaccttccttttcaacctcatctctttttattcttttaaccacaccacagtgcctccctttcattcccacagcacattgtatacctccatacctttgttccttctgccttgattgtccttcttctcatcttacaactttgtcctttaaaactcaactcacatgacacctcttctgtgccacagatcctcctgctacaatgtacctacctttacttgtgtactttcacattatattgtgatgatttatattatatgctgctgcttttaaactaaggacatgccagacatgccttcatctgaaaatgttaatatagttcaaagtgttgctatagtctttgtttagttaaagtaacaactttctggtctgaaaaaaaaaagactatgcatcccttcaacagaataagatagttttaaaagtaatgatatgggagcatctcttaagatatggtcagtgttatgttttaccatttgtatttagaaaaacagctgtgtgtgtatgtatgtatgtatgtatgtatgtatgtatgtatgtatgtattaatttattttgaaacggagtctcattctgtcacccaggctggagttcagtggtgcgatctctgctcactgcaacccccgcctcctgggttcaagcaattctcccacctcagcccctagagtagctggtgttacaggtgcatgccaccatgcctggctaatttttatatttttagtagtgacagggtttcaccaagttgcccaggctggtctgaagctgctgacctcaggcgatctgctcaccttggcctctcaaagtgctgggattacaggcgtgagtcactgcacctggcttgtatatgtagttttttaaaaaaataaataagtaaagacttttcaaggacaaagatatcatttgcattttgtagcctgagtgccagtaatacttgacaattacttgatgctcaataaaatgattcttattagcaaaataaaccttacacgtagaaaaagaatatgccaggaaccaagaaaagggatattcagatatgaggctcttggagttacggctcagctcacaaggattctgccgtaggtgagaaatgctccattacccagaggcaaagccccagaggttgtggcagcactttatgactatgtatcagtctgggctcagtcagggaaacattgagccactgttaagtgttataggagtgaggggtttaatatagtaattaaggcctatgcaaatatgggaggactagagaagtgaaggtctgcacgttttttattgtatactggacacgttgtttacaataggagtagggaatgagctggatacagctacagttggaagaccagaggaataggcactgatgactgaaacctgcagctctagagagggcagagaagtgctaggaaactgcctctcgctgccaaagtaggactcagtgtgggatcccaaggaaaggtctgtgaagactgccacggggataaagtggagctttaggagaggccagtggagcgactgcatctgactgccctgacctcttaaaaataatggcttctacttcatttccaccttctaaaactcacagaagcctctgacccagaaccacacagggaaaggaattctgggagacttaattttctgtcctagacaacagtggtggtggtgccagttgaccatccagcataggccattcctttgccagcctggcttacatacacacctacttaaaccatatttaactgccagataaagctaaatgctctgcttaacatgttgtaactatcgcttagcaaactgaaaacatgctaagcactccctcaaagaggagatgctgtatttcatattgtgctttgtacatttctggctgatatgaatgtattccactagctgagtcacatcccctctttgatatcctaaaacttacatatactgagatacagagttagccatttcctttttttttttttcttggcaaggtcttgttctgtcacccaggctgcagtgcagtggcgccatcatagctcactgcatccagaatctcctgggcccaagcgatccgcctgccttagcttcttgactataggtgtgcaccaccacacctagctaaattttttttatttttaactttttgtagagacaagaggtatcactgtgttgcccaggctgctcttgaactcctggcctcaagcaatcctgttgccttagcctctcaacgtgttaggattataggcatgaaccaccgtgcccagccagagtcaatacaccttatattagagagtattattagacagggaaaagtggaaaaaagaattcgttaatatattcagtatatattcatatcaaagcaaagaagaatatctgccaaactattgtagttctcattttctgtacctttcatgtgatcatggcaggtatctgtcatttctttcttcctctagccattccatgttcctttggtcctcagtagtcacctcagatggtctttgttctttgcctggtggggtggcctaaaccttcattctggggtgtatgtaccaataaatggccatattgttttgctctaatatcccgttaactttccataataaacaagtgtaatagaaaatcctaggttccaggcaatttctttccttcttccattgagtatttttttcccattgtgtattttaaacttggttcttccttgataatcgggatcaatcagcctagctattatagtacctgccttacttgtctttggctaagtggcatgaggagcaagaagtgctgagttaacagtctcagctctctgttcagtggaaataatgttgtgtctcccccaaagaagcacttctcccttgaggattaagacctgtaaactgggagagcccacagctgctgcgagttttcttttggggaaggattttgataatatttagtgaatatagggctatttcgattttcttgttcttgtatcaattttgataaattgtattttttaaagtaatttggccatttcacttaagttgtcaaatttgttggcaggaagctgcagtattttcttagagtccttctaatctttgtcaaattgatagtgataacttttctattcctcatgtgatgaccccttgattccgcctctgtccacacctgttagtgattccctccacctgaatgtggacaggacctgtgacttgcttggaacgaatagaatacaacaaaggcgatgggagatatgtgattgcatgattatattatataagattacagcactggactggctggagtgtgcacgtctctctctctctctctctggacataaagactgttatcttgtatagactctgggttcctttataatactcttgtgaatgcatttacttttgttttagcaggcaatcaactcaggtaggctggattatacattgttttgccttttgcaggcagtgattcaaatcccaattcagttatcaaagcaaagcctttgctaaactggtttgggtttgtcctgtgcatgtgtgattcagaggttaaggtgagacccgtgtaggtgcatacataaaagtggagagctccttcacctgctgtttctgctccaggagtttgctctgactccctgtctttctttggctcctttccctgcttgctctgaccagaaagaaaacaattcctatcagagttttagccacctacgtgtgctgcttagtgactgaagctgtcccaccctcaaggaaaaacttgatgagaaaaaaataaacaaacagaaaactcaccctgtaaggtcacttctccaactttttacttccctccacaatctgcctgcttttatttactttccagatcctcatatagttttttgttttgttttgttttgctgtgttttgagatggagtttcactcttggtgcccaggctggagtgcagtggcacaatcttgtctcactgaaacctccccctcccgggttgaagcgactcttttgcctcagcctcctgagtagcttgggattacgggcagccgccaccatgcacggctaatttttggtatttttagtagagacagggtttcaccatgttggccaggctggtcttgaactcctgacctcaggtgtcccacccacttcagcctccccacagtgctgggattacaggtgtgagccaccgcgcctggcccaaggtagttattttttaaaagtttgctcaaactttatagttgtaattagagggaggaacaactttatgggatgtaggtggcttaacctcaccataatggaaccaaaactccacttcattcactttttttttttagatggagtctcgctctgtctgcagtgatgagatctcggctcactgcaaggtccgcctcccgggttcatgccattctcctgcctcagcctcctgagtagctgggactacaggcgtctgccaccacgcccggctagtttttttgtatttttagtagagacggggtttcaccgtgttagccaggatggtctcgatctcttgacttcgtgatccgcccgcctcggcctcccaaagtgctgggattacaggtgtgagccactgcgcccggcccacttcattcactttaaaatgaagtacttgaccagaagcagtactgtttagaatgccattatggtgaataagatattttgtaagggaaaggatgctggtttttgacagaaatgttgtgggcagagaaggaaatcttcattgagtaaaagcagtgtcctttttagatggaagcggtccagtgtgatcatcctgctacagatggctgcccagaccccctgggagcagcgctttattggggcaccattgttggcctctcctgttggcaggttggacacttagccatgattgttgccaggtcagccttgacaggtggaagcctgtgtcactgagcacatgcatgaccttcattcctgttgctctcacagtaggatatgaactttgttcattagcgttctgagcaagggaaacagtggctgataaaataatgagtcattttgtccacttggttattgagagcctcctctgctgagattatacattggtcatcatttacatgggacacaaataccctcacactttgtcctgtttgagaatagtttattgacatagctcttttctatatcttaccacaagtttcccaaccttattctaagtttctgaatttccagtcaaaccatctgctgctgaccacaaatcagtgtggattcgtatttatagccatcactcctttgacacaaaatgtgcagtcatgtacactgcttcgagtgtatgatgagcagcctaagcgacttgggcaacttggtagccagtggtaaagtgttcagtccttactaaatcctagtagcaagcaagggctctttctcaaaagggagagtaatgatctccagaagttagcatagctttgctctaaaatcctagggttctatactgtgatttacctctagggcctgccatacctccacacatcactcatgaagtatcatcctgtatcttaagtttttgttggcgatactaatctctgcagttcctctaggaatgcagtattacttttggtgtaatattttggtagagagaggcagctctaatgtaacccctgaggtatggctttagtatgctacccatctctgttagtcctagggacaccatcaccaatcagccaccaccagagatctctacagctcacaccattctcttttcctactctacctctgcgtgtgcttataaagtatagccatgtgcccattgtttctgtcatgaagcgtcaccagttggctgctgtgactcagagatcttttcatccttcccttgggttcagggaatctatttctctgacagcctttcccattgttatttctagcctgcagcgaacaagcactaaagagctttttagggatgttgttgcccccttcaccaatgtatttctcaaaggcttggtaaaggagtgagttctctagacattcctgggatgtagttaggagatcagtgaacagatcagtcatacgtattaaatacaccccagtattccttattttctaaccttttgaataaattttattttgagactgagttttgctcctgttgcccaagctggagtgcaatggcactgtctcagctcattgcaacctctgccttccgggttcaagcacttctcctgctcagtctcctcagtagctgggattacaggtgcccgacaccatgcccagctaatttttgtatttttagtagagacagggtttcaccatgttggtcaggctggtcttggaactcctgacctcaggtgatccacccaccttggcctcccaaagtgctgggattacaggcatgagccactgcacctggcttgaacaacttttatttacagtataccaaggaggttctggcatctaagcttcatttaatgtaagccactgatggatccaggttttggccaaccaggtgaggaaattgttagagttattccctgattactcaagccaatatactgcatccaaaatatctggttaatgtactcatatattgataaatttgaccaagtccaacgttacattccttcttgtctggtctaacattcttaggattcattgctacacacttcctaggtttctgcaagtacaaatgggcaaaatctagcacaatgaccctagccctctgagggtcacagcaggttggttcaggagtaggaacctgacccaacacaggcaaataaaggtctttccctgggactgtgaaatggtaccaagggaagaaaggtggtttctctctggtagggagggccactggatataaggcacaggaactgttgctggaagcgttagacactgctgactgcttgttcctttttccctgttagtaaagactattcctttaaaaaaccaaaaaaggtagataaaaatgccagatattcattttcccatatactcttgtgggtggaatgaccacttgaccatttttttgtagccagtgatacataaggagatttttttttaacagggaaaaaaagagcttacaaattttatgtgcacatgtgtgcatgggagttatacaattcttttaaaaaaaaaactcaaatggctagatgattgacacttttgtaccaccctgagatacagaaagaataggggcttggatcatggccaaacaagttatggtggcaaaacaggttatgggaggaagagaagaccacctttgcctggctagcaaaggtagtcttgaactctcacaggcagcagccctcagaaagaatggatagtagccagtgataaatgtttctagcagacctttaaaggtgttagactctcagttaatcattcttaggtctggataaggagatgtttgctagggattttctgggagagatttagctttctgagaaaataaagaattgtgtgaaaagagcttactctttccttcctgcttttgaacattgctgtgaaagaacattatgcttagccctgctgcagccactttgtgatcctaagagaagttatcatcaataacacactgaaggtgacagaaggaagattagggcagaggcttcccttgatttctgggcttaggactgtccatccacctcatgtctggacttcttgttatgtgtttgacatacttgtactcagttattctattaccgtgtgttcactgcaaatggggtcgtgttcctcagtgtgtaagggaataaagccaacccatcgagagaagcagagccaaagaggtcaagggagtgtctggcaggggttgaggtcctggttctggttgcccatgaagatcatttccagctctgcccttgccacagttccaggaaacatttccctttttgactgtattacttgaattgggtttctgggctgtagtaggaatattccaactaataccatactgggtaaatttgaagtatgataaattttaagctacttctcactttatttcttgtgcctaaatttgaagagtatttatttatttatttatttatttatttatttatttatttatgagacagggtctcgctctgttgcccagagtgctctggaatgcagtggcacgatcatagcttactgcagccttgacttcttgggctcaggtgatcctcccaccttggcctcccaaagttctgggattataggcatataggcatgagccactttgtctggcctaaattttagttaaagaaattcttatctcattctttcagaattttcataggccttcaaagcaacaaccatggagttaaattcatttcctcaacttggcaggattttttttttcccctattgaagtattttgtcttttttttgtgtgtgtgtgacagggtttcactcttcgctctgttgcccaggctggagtgcagtggcatgatgatagctcactgtagccttaaactcccctgggctcaagccatcctcccacctcagctccctgagtagctgagaccataggcatgcaccactatgcccaactaattattgtattttttgtagagacaagatgtcaccatattacccaggctggcctcaaactcctgagctcaagtgattcacctggcccggcctcccaaagtgctgggattacaggagtgagccactgtgcccagccattttgttttattttgaaagaaggctgaattgattcctgcaggcattctgtaaagaatatataaggaagttcaaagtagcacattttaccatctctcagaatacctcagtctttcttctgatgcatcactttaaggcttcgattattaaacaagcaattactaaacagttgctttttggaatactaccttctagtgcttcaggagatgcaaagatctggcttgtatccaggaagaaaatacaggtaattggattggagagagaagacatgccatagaagaaaatgaaataataataagatgggagaagaatttttactgtgttttaaagggttaaaaactgttggaaacctaaaaatttgtccacaggacgaggctgaaagtctgagactaccccacaggaatagccttgtcaaggcctgattgtgccctttgactcatccttcaaagtcaaacctttctcatcttctctcccagctttggcactgtcattccataagtgtatcccaataatttgtgttttctgccagaaatccttttggggctaatgagtttcatgcacttgtatttgctgtgtaaagtaggttttcctatacttgtacttaccagattaaatgtcaaaggatccagctctttgttggttttgtgtacaagcacaaattgcacttgctcatgccattcagaatttcgtacattttagttgtcttttacaactgtaatcccatctgaaggtctatgggaaattcagttccttaagaaataggttcccctcatccttctctttctgccttcattagtgagagtactttttgagagcaagagaacatttgcagtgaagaggtttagttggatagctatttatacagttttccttggaattttaaagaatgaaataatttctctttatgtcagcaaatgcctattctgaacattcagaatgactgttctgaacagtaatgtttaactcttaaaaaacatggtatttataaatgagaatataataaatcagtattagaagtcattttttaccccatgctctaattcaggagaaaataggagatacttataggttaacttggtgtctgattaccagtgcctgatataatttctccaattccctttttaaaaatctattaaaatatcgttaatttaaaaaatccctttaaaatgaagatatgaaaagctctatgctaaagaatagggaaattttccactaagtcgatcattgattgtattgtggcttttccttaaacccaaagattacccaaagattactgtagaagtgacactacgaaaaatcaaattaatgatagggagagtatacattagatgctcttccagaatgtacagcaaaagaacagagatgaagattgatagatgagagaaaatgatacctatgaaagaaaaaaatagagatttaactggtgactaatagatgtctgcaaaggagacaacagaagtggaacaaaagcatggatcaaatgtctcattgtggaagactttccagggttgaaaatgacctgaagaataaaagagctcactgtattctaaagaacattatgaaaacgtgtctgtacctagacatattttgctggttttcttttgattttaaggatcctgaaaaaaaaaaaaatcctgcatatatcaaggcacaaaaaaatgagctttcaacaaagaaacaaaaatgatgctggtagccaggcgcggtggctcatgcctgtaatcccagcactttgggtggccaaggtgggcagatcacaaggttaggagtttgagaccagcctggccaacatggtgaaaccctgaatctactgaaaatacaaaaaattagctgggtgtggtggcatgtgcctataatcccagctactcgggaggctgaggcaggagaatcatttgaactcgggaggcggaggttgcagtgagccaagatcatgccataactctccagcttgggtgacagggcgagacttgatctcaaaaaaaataaaataataaaataaaataaacaaattatgctggctacaaaattttcttttgcaaatactaaatgttggaaaatgatggagcagtgggcagtgatccttagcttatgtggtctttgaactccctgcagtaatatttggacctctatgtcttgatgcaagttgattttcctgggaatagaatctatatcgttcctcatattttccaggatttcatgaaacaaagagttaagaactacagtagtggagcaatattcatggtgctttttctttttcttttgaaataattaaaaacttacagaaaggctgtaagaataatacagagaaatcctgtgtattctttcccaaattcatgtgtttgtcttctctctctttctctctccttataaaatatttcaatgttgttagttatctcaaaatggactttgtagtttttttttcctcccctaccagtacaggtttcagtctaagatcacatcatatatatagttttatattgttttagttttctttatctgtaacagtttctcagatgctctctgtcttccatgatactgatatttttttgaagaatgctggcaggttattttacagtgttcctcattctgggtttgtctgatgtttcctcttgattattattcgggttatgcatatgaggccacaatactaggtaaattgtgtggtttcattctcaaggtatccacatctgaaggcgtatgatgttcatctgtcacaccgttgatgttaatttcgatctcatggtaaatgtgttttttcggtgtctccactctatggttacttttttatccctttcaattaaaaaacaatcagtggtcgggcactgtggctcatgcctatgatcccaacactttgggaggcagaggcaggaggatcgcttaagcccaggaactcaagaccagcctgggcaacatagggagaccccatctctactggactggtggcatgtgcctcttgtcccagctgcaggaggctgaggtgggaggattgtctgagcccaggatgtcaagcctgcagtgagctgagattgcaccactgcactccagcctgagtgacagagtgagaccctgtctcaaaaataaataaattaattaaaaataaaaacgatcaatgtggaaaaaacttgaagactgtgcaaatagccatatgttgcttaacgatgggaatacattgtgaaaaatgtgttattaggtgattctgtcattgtgcaaacaccatagggtgtacttacataaatttagatggtatagcctgctacatagctaggctatatggtttagcctattgttcttaggctacaaaactgtacagcttgttactgtactgaatattgtaggcagttgtaacactatgataagtattatataaacatgtctaaacataggaagatacagtaaaaatacagaattataatcttatgggaccactgtcataagtgtggtttattactgaccaaaatgtcattatgtggcacatggctgtatcttgcttttcatcaggctttacactctagatgagcatccattgattattcttacccacaccaatggtacagttatgatagttggaaaatgctgcttttttccaactccactactccctccatttcatggtattctaatgaatgatcattgtcacaaaattcaacacctaattgtatctgttatgataatgaaaagaaacaaatgacccattcaaaacagttcagttgaaaagagtttatcaaaggaatgacttaacacggtgtggccacagtaagggaatcaacaaggaatggtgaagcacccagtaactagcaacagtgggaagccattgccacccttagacctgcggaggcaaagggagggcacatggttatcaggctcgtgaaactggaattcatagaggaggaaccacctacaggtgctgtgtctctagagaaaaacagccactgtcagcacagaggcaaggttgagacaaagctgggggaatcagctgagttcttcctgctgctgctctgacctgttagtagtgctcacggttgcccagtcataagccaaaggacaagaaagcctgggtgatgcaatctggagagcttgacctcctggggcacagaaggtgttggggggttgtgggaatggtagtataaccagcacactagctaagattttattaatgtgacaagacaagaaaaagatctctgatgcgcaagaactgaatggagagttcagatcatgttcttagatgggaagattgaatagtataaatatcttggttcttgccacatgaatttgtctacttaattccaacagtctaatggaattacggagggagtaggggtgatggtggggtaacattgttaaaatgattctaagttcaatcaggcaagaataacaagaaaaaaaaattcgggccaggtgcggtagcacacgcctgtaatcccagcactttgggaggccaaagcaggcagatcacctgaggtctggagttcgagaccagcctgaccaacatggagaaaccctgcctctactaaaaatacaaaattagccaggcatggtagcacatgcctgtaatcccagctactcgggaggctgaggcaggagaatcgcttgaactcaggatgcggaggttgcggtgagccaaattcatgccattgcactccagcctgggcaacaagagtgaaactccatctcaaaaaaaaaaaaaaaattctgatttcactgcgtaattttaaaaataatattttaattttgttttgaactaaatattttaaaattatttgtgttcataaattatttagaattgtttttaagggttttctaagttacatttttgttactcctttctgacttaaatataatatagttaaagaatattatctaaatgatactaattctgtaaaatgttgttgaagcttaatgatctaagacgggtcagtttttgtgaatcttactgtgtgtgtgttcctgagaaggatgtgtattcactaattaatgggtgctgggttttattggtaggccagaagtcaaacttgacagttatgtagcccttaattcatgctaatgttttgtatcattggtctgtaaataactgaaagagctgtgttgaaatcttccactttgtggatagatttgttcatttctctctaaagttgtcaaattttgctttattttgaggctattttttgagagcttacaaatttagattcattagcattttctagcaaattgaacattttattgtaacatacggactatcactaaaaatgctttttgtcttacagagtagaattgctaaataaaatacaggatgctcaattaaatttgaatttcagataaatgttgagtacttttttagtataagtatgttctacatattgcaaaaattattcatttttcacaggaacagaaaaccagataccacgtgttctcacttataagggggcactaaatgatgagaacacatggacacatggcggagaacaagacactggggtgtactggagggtggagggtggaggagggagaggatcaggaaacataactaatgggtactaggcttaatacctgggtgatgaaataatctgtacagcaaacccccatgacatgagtttacctatagaacaaaactgtacatgttcccctgaacttaaaataaaagttaacaaaaaaagtctggcatggaaagacataaacatgcgtggagctggttgtctctgatcttgcaccacttgtgataaagttgtttgtagtatttaatgaatgtgttcaaaaatctgtatctttagttatatgtacttcttggtcctaatattactgatttgtgctacctatacagttttggtggggggtttgcttatttgggggataaccttactactggtttgtctctcttattagtcttttcaagtaatactttctttggctgtattctgttgctccttttctagcttgtttaattgaacatttaattaaatattcatcattccttttgaaaaaattgttgtttatctgacattcaaatttaactaggcatcctatgttttgtttgtttttgctaaatttgggagcctatttaaaaactattttgtttgatactaatatagctatccccaatattttttggttataatttccctagtatatcgtttttataaatttcattctttgagtctttgtgttttaatgttttttttttaatatcctatagtcagaattgttagtctaatcttacctatgttgtttttctaggaagtgtagggcttttttattgggattgcagacctattgtcccttttttaaaactatattttcaaatgctttttatttttcccacttgttttgtgcttttgtggactgttttctttttgcatgattttaaaaaaattccatgttctcttactattattttagacattacacatatttattattttgttaacctttaaatattactgtcaggccaggcacggtggctcatgcctgtaatcccatcactttgggaggccaaagcgggtggatcacctgaggtcaggtgttccagaccagcctggccaacatggcgaaaccccgtctctactaaaaatataaaaattagccaggcggggtggcaggcgcctataatcacagctactgagaaggctgagtcaggagaatcgcttgaacctggaggcagaggttacagcgagccgagatcatgccattgtactcgagcctcggcgacagagcaagactctttctcaaaaataaataaataaataaatatatattactgttcaaactctacttgataaagttatttaatatttttaaatccccacacaaacatcctaactctgataactacccttttaatgcttatgctattactgttgaatatttaagttctttttttaacactatatgttagacatcatcattactgttactttatatggacagtattatgtttatgtatatgtttaccatttcccatgctcacaattacttcttgcatctaagatcatctttctcagattggtttccttttttttcccccaagtacattcttcagaatttttttttttttttagacgaagtctcactctgttgtcaggctggagtgcagtggcacgatctcagctcactgcaacctccccctcctgggttcaagggattctcctgcctcagcctcccgagtagctcctactacaggtgcccgccaccacgcctggccaatttttgcatttttagtagagatggggtttcaccatgttgcccaggctggtctcgatctcctgaccatgtgactcgccgccttggcctctcaaagtgctgggagtataggcgtgagccaccacgcccagcctagaagtttttttggtaaaggtaaattgatggtagactcagactttgcatatttgggaatatttttacttcactctaattcttgaaatgttgttttgttgaatagactaggtttatagtaatcttccatcagcactttgaagatattttaacattttctgggccctagttttgcaattgagaagttactatcagcgtagttgctatttctttgtgggtgactttactctctgatttttaaggtcttctttatataactgtattttccaattttactacaatatagctaactgtggcttttctcatttatttgttttgttttgtatatttatatgatttcctgtattttatcagttctataaaattctcgaccatttttctttgaatatttcttcttctccgttctctccattttgtcctttgaactccagttatttgaatattaaaatgttgcattctgtcctccagatagtttaacaactctttcatgttttctgccttcttacctctatctgctagataatttctttagatcaattgtctgattcactcattctttcttcatctgtttcatttgctctttaacgtgtccagtatattttaattaaaaatatatatgttgggttatttttagcctgcctgctactttaaaaaaatactcttttgttccttttaaaacatcaaaagttgatctgaagtgtttcagcagttgaactcctaggtcttcattgtcagcctgctgtacttgttttcttcaagaagatagatatctctaaatgttgtcatatccttttttgttattgaatcaaagtagctgaatttgatagaagttcagtgttgcattgtccagatacacagttttgaggtttgaaagcttgaataagtgccagtggacttcatgcaaatgctttatatatttttcacctaatatattttgaatttcaacaagtaacacattctcttaaatactgacttgataggcaagtgagcatagcaagcttcatcttttagtgaaagtccattgatcctgtttcgtaattggatgaagagtgtccaaactattgccagtagctttctgttttcccatcatttttcaacccagaaatatttatttttctttccagggaggcattagcagtaccctggaagctcccctcctacccctccaaattattccctcctcctctttacttttctccaaagataatctctgtcctgaatcaaaaatcgtccccgcttcctggtagcacccgatctggaagaaacccaaaatcacctaaccaaaacctgaatcatataatagtcttttctaatactcttttactgagacattccacaattcccaattatatgtgttattccttgctgaaatgaataatgaacccaacatgtgcaactacagctatgttcctggtaacctttggctgggaggattgacaatattcatttgtgtctggtttctttctttctttttttctttttcttttttttttttttttttttgagacggagtcttgctctgtcccccaggctggagtgcagtggcacaatctcggctcactgcaagctccacctcccgggttcactccattctcctgcctcagcctcccgagttgctgggactacaggcgcccgccaccatgcctggctaattttttgtatttttagtagaggcggggtttcaccatgttagccaggatggtctcgatctcctgaccttgtgatctgcccgcctcggcctcccaaagtgctgggattacaggcgtgagccaccgcgcccagcctggtttctttctttttaacattttgtaagattcatgtttttgcatgtagtcatagttttttttgtgtgtgtgatggaatttcactcttgttgcccaggctggagtgcaatggagtgatctcgtctcaccacaacctccgcctcccaggttcaagcgattctcctgcctcagcctcccgagtagctggtattacagacatgtgccaccacgcccggctaattttgcatttttagtagagatggggcttcaccatgttggtcaggctggtctcaaactcctgacctcaggtgatctgcccgcctcagcctcccaaagtgctgggattacagttgtgagccaccgtgcccggccttgttcatttttgttatttaatattatgctataattacataactatttggaactttttgactctgttttaatgttgatacacagtatctttgtacatatcatttggtgaacatgaataatgcatttttgttgggagtatgcctgggagttatattgggagttcccaagaccactcatagtaatcagaagttatgattatgattatagttgattacagcaaaaggatatgaagtaaaagtcaagaaagggaaaaggcacatgggcaaagtctggaaggaaccagctgctcactttccaatgtgccctctcagtggagtcagacaggacatgtttcatttccccagcaacatgtgtgacaacacacacaaaatgtttccaatcaaggaagctcacctgagcttttgtgtccagagtttttattaggggtcagtcatgacataggcatttggtattacctgcacaactgacttcagggtcaggctccagatccccagagaaaaagcaggtgtcaaccataaatcacattgttagcataaactatctggttaaaccagtacagcatggcccaaggcctcagacacatgaaacatttcttatcagacataagattctatgataggaggcagccaatagccagtcctgaaaacaggcctgtcttgggaatgtgcaaccaggcctgctgagttaataaacttttccagcagagattgaaaaggatgggtcaaaggatatctgtaggtacaaatttgagagatagtgccaaagagtttttcaaagtgattatacctgtttactctctaaccagcagatgtgtaagaacttcagttcttctactttgccaataccttgtacagtttaatcttctaaaattgtaattttcttcctcgtgtctattgatatctcattttggtttacatttttatttccttagtaactgagactgagcaccttttcatatgtcattgaccagtagcctatgttgtgaagtgccagttcaggttctttgcctggttttcttttgaatcatttgcttttttctcattgatttttaggaattatttacatgttttgatatgtacacttcatgtgtgtttcaaataacttctcccatctatctgccttgccttttctctctcttaaggctgtcttttgaaaaatagaagttaattttaatgtctaattttgtgatctttttctttactgcttttggcataccatttaataaatcttttttccaattcaagtccttggatatatcctcctatgttatctaatgaaaagtttattgctttacctttctcttttagatctgtaacctgcctggaattgatttcttttcattgtggtaagaaacacatgacataaaatactctcttaaagatttacaactgtacatctcagtagtgttaaacatatttacagtgttgtaaaacagattcagaaactttttatcttgaaaaacggaaaactttatactcattaaacaataactctccattcttcttctccccactcccctccttgctgctcctggcagtccctattttacttttgtctcgatttaagtacctcatgtggcatcaaatagtatttgtctctttgtgactggcttgtttgagttagcataatgtcctcaagtttcatccatgttacaggatgtgacaggacttcctttttaaggctgcatagtatttcattgtatgtctgtaccacattttgttcatccattcatctgttgatcaatttgggttgcttccatttcttggctattgtgaatagtgctgcagtgaacatgatgtgcagatatctctttgagttcttgctttcagttattttgtgtatactcagaagtggaattgctgaattatatgggagttctattttttattttttcaggaagctgccgtactgttactccatagcagctgcactattttacatcccttccagtagtgcacaaaggttccagtggtgcacaaaggttccagttttccacagctcaccaacacttgttattttttttatttttttattttttatttttttaaatagtagccattctaatggatatgaatggtaactcattatggttttgatttgcatttctctgatgattagtgatgttgagcatcttttcatatgcttgttgtctatttatgtatcatctttgggaagaaatactttgttcatttttaattggattttttgattttttgctgtgaattgtagaagttctttatgtaattctgaatattaaccccatagcagatacatgacttgcaaaattgtgtttctttagagttgatttctttaactttattttgattctttaattgggccatctatccagaccaggctggtctcggactcctgagctcaggcaatcaacccgtatcagccttccaaagtgctgggattacaggcgtgagccaccctgcctggccgctgtggatttttaaataaacgtcctttatcatgttaaagaagctttcttctgttcttagtttactaagtgttttgttatgaagtgatgttgagttttgcccagtgtttttttctgtgtgtattgagatgatgtgtttttctttatattttattattatgtattacactggatgattatcttacattgaaccaccctagcattcctgagataaatccaaattgggctgcatcgaaactaaaaacttttgtattacaaatgttatgaagaaagtgaaaagacaacccacagatgctatctagagattggtatccagattatataaagaattcttgcaagtcaaataataaaaatttacatcacccaattagtagtttaagtcagccagagttggttcctcttgaatcacccaatttgtggtgaattgaaactataatcagatactacttcacacccaccgggatgcttataataaaaaatacatgggaaatagtacagtagttcctcaaaaaattatagaattaccatttgatccagcagttccacttctgtgtatatatacaaaagaggtcaaagcagggatacagatatttgtgcaccagtgttcatagcagcactattcacaacagtcagaaggtggaaacaacctaaatgtccatctacagatgaatgggtaaacaaaatgtggtaaagatggatcaatagatcacaaaggaatattattcagccttaaaaaggaatgaaattctgatacatgctacaataaggatgaaacttcaagacactgtgctgggtgaaataagccagacacaaaaggacaaatgttgtataatttgacttatggggtacatagaataggtcaattcatagagatagaaagtagaatggaggttatcaggggtggggtatgatttcattcctgtaaagttcagagttactcttattggaggaaaggatacattatgactagaaggagggacaaggaaggccactgggtcatcttctatttctcaatctgtgtttactccatagaatttgattgagctgtttagctgtggtttgcacattttcctttacgtataaactttttacatatatacttttattaaaatctacttaaaatgggaaaaaaaaagatatctagatttcagcttttaaatgctggtgcaatgatagccattttcggctgggtgcagtggctcacacctgtaatcccagcactttgggaggctgaggcagctggatcacctgaggtcaggagttcaagaccagcctggctaacatggtgaaactttgtctctactaaaaattagccaaacctggtggtgggttcctgtaatcccagctactcgggaggctgaggaaggagaattgcttgaactcgggaggcagaggttttgcagtgatccaagactgtgccactgcactccagcctgggtgacagagtaagactctgtctcaaaaaaaaaaaacaaaaaaaaaaacaagacaaaacactcatatctgaaatgtggtttacatagaatgttcttccaggcaaaaaaaacaagattaaaattactggttttgaaaatgtattctgttctttcttatatcaaagtcttgatgttggtggctagagagaacttcttaggttttctacctgtattagtccgttttcatactgctataaagaactgcccaagacggggtagtttataaaggaaagaggtttaattgactcatagttcagcatggctggggaggcctcaggaaacttaaaatcatagtagaaggtcaagaggaagcaaggcactttcttcacaagtcacaaaggagaagtgctaagtgaaggatgaagagccccatataaaaccatcacatctcgtgagaactcactcactatcacgaggacagcatgggggaacctctgccgtgattcagtgacttccacctggtctctcccttgacacgtggggattatggggattataattcaagaggagatttggatggggacacaaagcctaaccatatcactaccatttttcttttctttttttttcatgcctggattttttcgttgttccctcatgaacattttaaagtgtaattaagcaaaagagaatactatacaatggtttttaacaatttttttaagtttcccccctccccccaagacagggtttcccaatgttgcctaggctggtctcgaactcctggcctcaagtgattctcccacctcaccctcctaagtagctgggactacagacatgtgccactgtgcccagctgcctatacagtgtttttattttattttatttttttaagatggagtcttgctttatcacccaggctggagtgcagtggcattatcttggcttaccgcaacctctgcctcccggattcaaatgattctcctgcctaagcctcccaagtagctgggattacaggcacccgcctccatgcctggctaatttttgtatttttagtagagacagggtttcaccatgttggccaggctggtctcgaactcctgagctcgtgatctgcccgccttggcctcccaaattgctggggttacaggcgtgagccaccatgcctggcctttaatttttttaaaaagtaaaacttctttaattttcttctcgcaagaattgaatagaatgatagaatgaatgccagtattttataatgttgtatccagcaggttgcaatcagggaggctccaacagagtcactttttctgtctttttatgttcaatctatgctgtaaattggtttcagaaacttctgtgagtctatcaactgtaaaaatggagatgactatgaaaggatcttacgcttttattcttctttgatccacatgtctgtttgttcctccatctagaatataaagatgattaagactctacctgtctcctttaagtccagtgaagaagatagatttacaattaatggtaattcagtataactgccgtaagaacagggcattcagaatgccctgtgagctcagagatggcgctactgtattctcatgtttaaaggataagtaaaagttccccagtttgagaaaagaggggaaaaggactccagtgaaaggaaattgatgaaattactgttgactttacttgtatatattaactgtctttcagtgtctctgaaaacttgatttgggactatttcctttgaacagaaataatagcattcctgcctgataaatgtcctgtggtcaaataatatgatttcctaatcattctgcacactaaacttccccccaccaggaaatcaatgccttaatgctaaatttcctctgtactactttctgtaagagtaagaggttcctatttcacagtcacgacacattcccaactcaattcacattccaatccatcttgtccaacttcattgaaagttgatacactgaaccatttcctttacttaaaagaaatagaattcttcctaaattctatctactgttggaatagaaagaatatcatgcttctagactgactaattttttttcttcttgatataagtattgacaacatttattcatttgtttctaggcagcacaagactgttgaactttcctagaactgagtctgagatttgcaaagctgccaaaatattttgaaacaaatgaaaatatgtaaacatgaatgttatcagctgttttacagtatttgtgttttagagataatgagcatctggtggaccacaggagcccagggggatttcaaactccagattcctttttgtgtaatcatatctggctggagttatttgttttctctgcatgtgaaactatcaagtcataattcttcaaaggggaatgtttattgcattatttaaaaataataaattatattactaaataaataacagcaggccaggcataaaccaatgatgaaagtttgtcagaaactaaggcttctgattaattctgtgctctggactataattggaaggaaggattatattagagtttacaatgagtttacagaaagaaaggagagggataaattatatttagttcacagtaaatctgaattcagaacccctggttgtaagactagtcttttaacctttagagttaaaaaatgtatatgtacagctgggtgcagtggttcacgcctgtaatcctagcactttgggaggccaaggtgggtggatcgcttgaacccaggagtttgagaccaggatgggcaaaatggcaaaaccctgactctataaaaaatacaaaaattagctaggtgtggtggcaggtgcccatagtcctagctactcaggaggctgaggtgggaggatcccttgagtctgggaggtcaaagctgcagtgagccgtgattgtgctactgtactccagcctgggtgacagagaaagaccctgtcttaaaaaaaaaaaaaagtgcgtgtgtgtgtgtgtgtatgtacgttgaagaaaactatgagaaaaagcaaaaatgtagagtccataatgcataatgttgtgttaagcacatagtttagtcattggtacatatttctggagatggtctaaagatctattttttaaaaactgattttagttaaatcagaggttagcaaatcacagcctgcaggccaaatctggcctatcatacattttgtttgtctctttgttgtgtttttggtgtttttttttctttcttttttttttcctttcctttttttttttttttttttttttttttgagacagagtcttgctctgttacccagaccaggctggagtgcattggtgcgatctcagctcactgcaacctctgtctcccaggttcaagcaattctcctgcctcagcctcctgagtagctgggattataggtgtgcaccaccatgcccagctaatttttgtatttttagtagagatggggttttaccatgttgcccaggctggtctcaaactcctgagctcaggcaatcttctcgccccagcctcccaaagtgctgggattacagacgtgagccaccgcgcctggccctatcatacattttggtaaataaagttttattagaacatactatgctcaatcatttatatgttttgtgtggctgcatttgccctgcagcagtagagctgagtagttggaacagagactgtggttcatacaacctaaaatatttaccctggcctttgttacagaataggttgctaacctctgagtttctcagttttagcccattcacaaatgaaatagtttttttttgttgttttttttgagacagcctcactctgtcgcccaggctggagtgcagtggcatgatcttggctcactgcaacctctgcctcttgggttcaagcaattctcttgcctaaacctcctgagaagttgggactataggcacatgccacaacgcctggctaatttttgtatttttagtagagaccaggtttcgccatgttgaccaggctggtcttgaactcctgacatcaagtgatctgcctgtcttggcctcccaaagtgctgggatcccagcctctctctctctctttctcactctctctctctcccgctctctctctctctctctctctatatatatatatatatattttttttttttttttttttttttttgagacagggtctcattctgtcacccaggctggagtgcagtggcataatcacagctcactgcagcctcaaccccacgggctcaagcaattctcctgcctcagcctcccaagtagctgggattacaggtgcgcacaaccacgcccagctaatacttgtatttttttgtagagacgaggcttctccatgttgtccaggctgttctcgagctcctggaactcaagcaatctgcctcaggcaggaatcctgaaattctgggattataggtgtgagccacttctcctggcccacaaatgacatattccttataatctactacagtgagctttgcatggttaatatatttgttgtgttgaaactatcttcctgattttttccaattttttatagagaaacctggaaagaatagtaccataaatacctatataccctaacagagaattattgttaaaattttgccatatttgctttatcttctctgtgcatatgtatactcacatggctttttttttattggtattagttgaaagttgcagatattatgcttcctcagcgcatatccctaagaataaaagcattttcctcgacaactgattatgttaaaatttgaagacgtgtatgaggtttttgtttgtgagggctatatgactggcgtttctccagtatatgacactttgttcatccctatgttcctctttataaactgcagaaattctaaatataatgcattagttgtctattgcttgcaagtagtagactgaatgatggctccataaagatgtccacttccattagataaagaaaatgtgtacatatacaccatgaaatattgcacagccataacaaagagcgaaatcatgttctttgcagcagtttggatggcgcttgaggccattatcctaagtgaattaatgcagaaacagaaaaccaagtacctcatgttctcacttgtaagtgagaggtaaacactgggtacaaatggacataaagatggggacagtagacactgggaatacaagagggcagaagagggaaggaaaaataagggttgaaaaactacctattgggtactgtgctcactacctgggtgacaggttcaatcatatcccaaacttcagcatcacacactatacccctgtaacaaacctgcacatgtaccccctgaatctaaataaaagttggaaaaacaaatcaacccagatggccatttcctaatccctggggtctgtgaatatgttaccttatctggcaaaaggaactttacagatggaattaaggaattttagatgaggagattaccgatcatctggtgggcctaaagtaatcaccagggtcctcataaaggagaggcaagggagttgaaggtagagaaggggctctgaagatgggaagcagaataagtgtaggaaatgtgagcttgccacactgctagtgttgaagatggtgaggctaagaattttcacatccactttcaaaaccattgtgtcctggctccttttaaaccatctttccctcaatttctctgtcctcttacatcttattgtaaacaccaagaagaaacctggcagttaactttgcttggaaatctttttagctagaccatctaattcattcggcacattttctaccttccacatcactgtaaaattgggttgctaaactttccacaactacctaacagagatcccttgcctccagtttctactcagatgttcctcacattccttaaaactcacagtccacctcctaacaatctaaaatctaccaactatcaattcctggcaatttaggctttactgctcctctcctgaaaggccttaaagtattagaactgggccctattattagaacctatttcccagttctaatattcctcccacatttttggtatgtgtgacaatggaactttactcctgataccaaaatctgtatgatttatatatgaagcataacaaattattctaaaacgtattaatggcttaaatcaacaaacgtgttgtctcataggttctgtggttcaggaatccaggcaaagctacctagatgcttctagctcaggatctttcatgaagttgcagtcaagctgtcagctgggctgcagtcatccaaggctcagctgggagaggatctgccttcaagctctctcatgtgactgttggcgggcctcaggttttcactggctgttggctggagatgccagttatttgccacatgagcctctgtctacggcagttgacaacatgcagctggcctacctcagagcaagcaaccaagcaagagagcaagatagagtgctcaagacaaaagataacagactttttgtaacttaatctcagaagtaacatcccatcacttttgccaaattctggttgttagaagccagtcactagatctgtcccacacttgaagagggttaaacaaggtcatgttcttcataagattaatccaagtacagaattggcttaataacatttctgacgatttttcctataacttgtaaaaccttggctatctgaaacccttgggaagtgaatcatccttaaaagctaagtttctggatagatttttaccatgaagggaccaaatcttaataatttggagtagaatcacttctgcatttgatcacatatttcttgccttttaaaataaattactgatcattatttgaaattttatttcatcaaaagaaaattagcaattgtgtgttataaagagaaggtgtctgtcttctccttatgtagggtatagaactgttcatctctttactaaaaacttaaggcttctgtctgccttttataatttctgtttactttctttgtttcatttgttacctcttagttatcagtacttgcccattgccttcctgtttactgtatgctagtaagttgctgcaaaagtaattgtgatttttgtattaaaacaaatggcattagattctcataggagcacgaacacttttgtgaactgtgcatgtgaggcannnnnnnnnnnnnnnnnnnnaatcaattgaaactgaccccaaacattagaaatagcatattaggatattaaaacagttactatacctgtattccgtatgttcaaaaaattaagttgagtcgtgaaaaatatcaacaagacacaaatgacctatagataaaaacggcaatgtgaaagattaaaaatacactggatgagattaatggtatattagatatcgcagaaaaaaaataccaaacttgatgacagcaatacaaatgatccaaaatgaaaccaccaagaaaagacaataatttaaagaaactaacagagtatcagtgagccagaggacaacttcaggtggtctcatacatttgcaattggagttcctgaagtagtagagcaaggggtgaggacagagaaaatatttgaagaaaaaatggccaaatttttttccacattttatgagaactataaatgcataggtacaagaagctcaacaagcctgagcacaagtaacatgaagaaaatttctttttttctttttctttttttttttttttttttgagacggagtttcgctcttgttgcccaggctggagtgcaatggcatgccatctcggctcaccacaagctccacctcctgggttcaagcaattctcctgcctcagcctcccgagtagctgggattacaggcatgtgccaccacacccggctaatttcgtattttttagtagagatggggtttctccatgttggtcaggctggtctcaaactcctggcctcaggtgatccgcccaccttggcctcccaaagtgctgggattacaggtgtgagccaacatgcctggcctgtttacatcttaattatgaattgttactatagtcagccctttgtatctgtggtttccacatccatagattcaactaaccatggactgaaaatatgtgggggggaaatgatgcttacatctgtactgaacgtgacggactttgtcattatttcctaaaaaatacaggataactatttacatagcatttgcattgtattaggtgttataagcagtctagagatgatttaaagtatacaggaggatatgtgtatgttacgtgcaaatactacaccattttatataaggcacttgagcacctgtggattttgttattcacaggggatcctggaaacaatcccctgtggataccaagagatgactgtataggggaggccgtggtgacagatgaagtggcactgggcttagtaagggtaagaaagctaagagtggcctgaggacagatgacaaacatgacatattgctcactttagccaatgctcagaatctcttaggtttttgaaacttcacaagcaatttaggcaaactctcctttcttctctatctctgtattctatgtaatcccacagttgaaggctgttcttatagtggaattaattatacctcactccaaaaacttgaccctgatttccgtctacaaacccaaagcagcaaatacaatttacttttatatttgaattattttctttgtaatggtgtctgttgacagccaaagcctcttgtatggaaacataccaccactgccacaagtaaaagctataaagcagtgttaaatactgtatatagagctcacatttgtatatgcatttcttttaggtcttatgtagtgtgtgtactgtggaagatcgagaaagtgcgttaggttgttagacaaaagacccagaaggcctgctagagatgccacaggtggaactaagaaagcaatctctgtgtcactcaggctttgagaaacttccttcagaatcataaaacattagaactgggaaggttaaaaaatctttagtctttttttcccagctccagtctcttgtgaataattaacagtaaagttaaagattatgggaattacgtgcctccttttttcccttgcacaacatagaatttgttttctaatagtagtttatttgttagctttgcattcccataagtgatggtttccagccttggcaaacccttgcagcctccagccacaagtcccctggacctcagagaatgtatatactgtatgtgcaccctaataacatgtttccttaaaactagtactactggatcctctaactttagtacatgtctttcatgtccaacttttcagaggccgccaaactagcaaccctaaactcatttgtcactatcaaaacataatatacgaatatggaaagctaatataaaaatggtaagggactgagccatttggaaggtaacttaatgtaagtgcctgaaaaacagggatacaaaaaagcaaagggacaagaagcaagccagttcaccctgaaccctacaaatgtttgggaattagaaacatcaagtattacaaattaggggaaacggatgaagtctgatactaaaaatagggaggttgacagtctgtgtaggaacagttagacttccagatccttatctctataccccacctccccctctgcagaagagatagattcccttagggaggaagaaaactagagaaaataaagacactagggggagagtgtgatgtcagcaagatagtggaataaaagatacctggcatcactcttcccacaaaaatgcaactagaaattattcaggctgggcgcggtggctcactcctgtaatcccagcatgttgggaggccgaaacgtgtggatcacttgaggtcaggagttcgagaccagcctggccaacatggtgaaacgccgtctctactaaaaatacaaacattagctgggcatggtggtgggtgcctgtaatcccagctactcaggaggctgagacaggagaattgcttgaactcgggagttggaggttgcagtgagccaagatcatgccactgcactccagcctgggtgaaagagcgagactccatctcaaaaaaaaaaaaaaaagtattcaaagacaagaatatcaacctgagttcaccagaacttggggaagaagtggagaaacctcctgggccaacaaaattttttgtaaaataagtggtcatttcagactgtgccaccccttccccccaagctggcataacaccactcagggagaattttcctagccctgcagtttccaaggtgagaggaaggaattggaggtgtgtattcagtctcctcactggtctgggaatcttcccagggagcccactcccgtcccatcagggagagccaggagagctgaactatctggggtaaagtggggacaaagagcagggcactgattgtagcaactagtatatggatcttgcagctactctgtactctaattagccgagacaccctattgacaaggatggccagtgtcttagtgccactggggtgtaatcagtgggaaggcctgaatccctggtcggattttccacaaaacttagtgctcacatggaaccttcccgtggcccagaaacagctataagattgggattaagctgggcatggcagctcatttctgtaatcccattttgggaggccaagttgggtggataatttgagcccaggagttcaagaccagcctgggcaacatagcaaaatcccacttctaccacaaaaacaaaagttagctgcatgtggtggtacgtgcctgtaatcccagctacttcagaggctgaagcaaagagtcgcttgagcctgggagacagaggttacagtgagccaagatcgcaccactgaacgccagcctgggcaacagagcaaaactgtgtctcaaaaaaaaaaaaaagttgggattaacttccagtgtacacttaagcacttaagactttcacagactgggaaatgatgacaggatagcaatatagttggagaacaatgtttacctttcggtggtcactataagtcttcctgtctgtgaaacaatgtcagggcaagttagtttagttttagtgcagtgttttgaacggcagggcaagttagttctgttttagtgcaatgttttgaatggcagggcaagttagtttagttttagtgcagtgtttcagttctgatgctcactgtaagtcttccccagaatgggaagaaacaataggccagtacttaagctctcatactaagtaaaggcccgaaatcaccaaagaacacctgcaaaacctagaagaaatggctgtgtcctcaaatgtgcaagcatcaacataaacaagcaatgattatgaaaacttagggaaatatgacaccaccaaaagaaaccaacaaagctccaccagtggactcagaagaattgaagatctatgaaatgtcagacagagaattcagaataagcctctttaaaaagttcagtgaatctgccaggcatggtggcttacgcctgtaatcccagcactttgggaggccgaggtgggcagatcacgaggtcaggggatcgagaccatcctggctaacatggtgaaaccccatttctactaaaaatacaaaaaataagcagggcctggtggtgggcacctgtagtcccagctactcgggaggctgaggcaggagaatggtgtgaacccaggaggcggagcttgcagtgagctgagattgtgccactgcactccagcctgggagacagagcaagactccgcctcaaaaaaaaaaaaaatgttcagggaatcacaagaaaatagagatagaaaattaaatgaaatttagaaagcaatccatgtatgtagtgagaaatttgacaaagaaatagaaacaagaaaacaaatagaaatcctatctataaacaatacagtaactgaactggaataactcattggaaagctttagcagcagacttaatcaaataaaagaattggtgagcttcaggacagaacatatgaaattacccattcagaggagcaagaataaaaaagggtaaagaagacctacaagaattgtggaataccatcaagcagactaacctctgcataataggaattcctgaagatgaggaagaaaagggtgtagaaagcatacttaagcaaatcatggctgaaaaagtcccaaatctagagaaagatgacactgtctaggtacaggaagctcagtgatcagcaattaaaatcaacccaaagaagagatacctatggcacataacaatctggttaacaaaaatcaaagacaaagaaagattactcaaggcagcaagagaaaagaaatgtgtcccattcaacataccccaatagagctttcagcagatatcccagcagaaaccctgtaggccagcaaagagtggaatggtatatttagagtgctgaaggaaaagaaaaaaactgccaagcaagaatactgtacccagcaaagttaccctttataaacacaaaggcaagataaagatttttccagacaaacaaaagttgagggaattcatcaacaccagacctgtcttacaaaaaatgctaaagggagctgttcagtcagaaagtgaaggatgctaatgggtaaaaagaaagcatctaatggcattaaactcaccggcaaaagaaagaaaactcactggtaaaagaagacttctgaaaaattcagaatattgtaatactgcaaatgggatgagtaaaccacttatattttaagtatgaagactaaaagacaaattttttttttttttttttttttttttaagacagagcctcgctctgtcactcaagctggagagtgcagtggtgcaatctcagctcactgcaacctgcacctcctgggttgaagtgattctcatgcctcagcctccgagtaactgggattacagatatgtgccaacacacctggcttatttttgtatttttagtagagacagtatttcacaatgttggccaggctggtctcgaactcctgacctcaggtgatccgcccacctcggcctcctgaagtgctgggattacaggcttgagccaccatgtccggccgacaaaactattaaaaacagtaactacaacggttatttaggagacagacaattgtttaagcaataaaaagattaaatcaaaacatcaaaaagtcaaaatggcaatggcggtgttaaagtatagagtttttgttacttttctttgcaaagttaagtgattatcagtttaaaataacctattataagatttttttgtaagcctcacagtaaccataaagcaaaaacctataatagatacactaaaaataaatagcacaaaatcaaagcacgctgctagagaaaatcacttaccatagaggaagacagtaagagaggaaaataggaagaaagaatctacaaagcaaccaaaaacaaggaacagtatggcagtagtaaacccttacctgtcagtaataactttgaatataaatggattaaattcttcaattaagagtggcagaatggattaaaaaacaagacccatccatatgctggctacaagaaactcacttcatctgtaaagataagcacagactgaaagtgaaggtatggaaaaagataatttatgcaaatggaaaccaaaaaagagcaagagagcctatagttttatcacataaaataaacttaaatcaagatggttaaaaaaaagacaaggccattatataacgacaaaggggtcagtacagcaagaggatataacaatggtaaatatatatacacccaacaccagagcacccaaatatataaagcaaatattaatagacctaaagagagagatagactgcaatacagtaatactagggaacatccacactttcaatgtgaacagatcatccagacagaaaagaaacaaagaaacgtagacattaaactgtactctggaccaaatggacctaacagatatttacagaacattccatccaacagttgcagaatacacatttttctcaacagcacatggaatattctccaggattgatcatacattaggtcacaaaacaagttttaacaaatttttaaaattgaaattatatttatcttgtcacagtggaataaaactagaaatctataatcagaggaacattggaaacagtacaaattaatggaaattaaacaacaaatggaccaatgaagaaattttaaagtaaattttaaaatttcttgagacaaatgaaaatggaaacaaaataccaaaacctatgggatacagcaaaagcggttctaagagggaagtgtatagcaataaacgtctatatcaaaaaagtaaaaagacttcaaataacctaacgatacacctcaaggaactagaaaagcaaaaccaaacaaacccccaattttttgttctttttttctccgtgaaaaaaggcatctaaaaaacaaaccaatgttaatagaaagaaataataaaagagcagaagtaaatgaaaccaagactaaaagaatacaaagatcaatgaaatgaaaatgtttttttgaataggtaatcaaaattggcaaacctttcagaagactaagtgttggggggtggtgggtggggggagagaagacccaaataagcaaaaccagaggtgaaaaatgggacattgtaagtgataccaccgatatacaaaaagatcattagagactactatgaacaactatacaccaaaaaattgcaaagcctagaaggaatgtgtaaattctctgacacatacaacctaccaagattgaatcaggaagaaacaaaagacctcaacaaaccaataatgagtaatgagattgaagccatataaaaaaagtctctcaaccaagaaaagcccaggacctgttgcttcactgctaaattctgccagacatttaaagagctaataccaatcctactcaaactcctcaaaacaaaaatttttttggaagagaagggattacttcccaactcattctacaagggcaacattaccctgataccaaaaccagacaggatgcaacaagaaaatgacaggccaacatccctgatgaacacagatgcaaaaatcctcaacaaaatactaacaaaccaagtgcaacaatacattaaaaagatcatcctgggatacgaagaggggaagaacagacttacttgagggtggggggttggaggaaggagaggatcagaaaaaatacctattcggtactatgcttattacctgagtgatgaaataatctgtacaccaagcctctgtgacacacagtttacccacataacaaaccagcacatgtacccctcaacctaaaaaaaaaaaaaaaaaaaatcatcatgataaagtggaaatccgagggatgcaaggatgattcagcatacccaaatcaataaacatagtacattacattaatacaatcaagaccaaaaaccatatgatgatttcaatagatgctcaaaaagcattcagtagaattcagcatcccttcttgataaaaattctcaacaaacggtatagaaggaacatacttcggtgaggtgtagtggctcatgcctgtaatcccagcaatttgggaggctgaggtgagtggatcccttgaagtcaggagtttgagaccagcctggcccacatggtgaaaccccatctctactaaaaatacaaagcctgggtgatagagcgagactttatctcaaaaaagaaaaaaaaaagaaggaacatatctcaaaccatatatgacaaacccacagctaatgtcatgttcaacagtgaaaagctgaataatgaataatttttctctaagattaggaacagacaaggatgcccactctaaccacttctgttcaacttagtacttgaagtcctagcccaagcaattaggcaagagaaagaaataaagggtacccaaattggaaaggaagaaaccacattatctttatttgcagataacatgatcctgtatttagaaaaacctgaagactcctccaaaaactgctagaactgataaacaaattcacttaagtttcatgatacaaaatcaacataacaaaaatctgtagcatttctatacatcaacagcaagcaatctgaaaaagaaatcagaaaagcaatcccatttacatagctacaaaaaaaataaaatacctaggcatgaacttaaccaaataagtgaagaatctctgtgatgaaaactgtaaaagactgatgacagaaattgaagaggacatatagaaaatgaaaagatacttcatactcatggattagaagaattaatattgttatggagttcgagaccagcctggccaacatagtgaaaccccatctctactaaaaatagaaaaattagccaggcctggttgtgggtgcctataatcccagctactcaggaggctgaggcaggagaatcacttgaacctgggaggcagagggtgcaccaagccgagatcatgccactgcactccagcctgggtgacagagtgagactccgtctcaaaagtcagtattacccaaagtaatctacagagtcagtataatctctatcaaaataccaatgacatttttcacagaaatagaaaaaacctaaaatttgtgtggaatgacaaaagaccttgaatacctaaagctatcctgagcagaaagaacaaagttggagacatctcactgcctgactttgaataccacaaagctatggtaaccaaaacaccatggttctatatatatgtgcacacattttatacacacataggtatataaaacacctacaaatttttgttttttgagacagagtctcgctctgttgcccaggctggagtgcagtggcatgatcttggctcactgcaacctccgcctcctgggttcaagcaattctctgcctcagcctcccaagtagctgggattgcaggcacccatcacaaatgcctggctaatgtttttgtatttttggtagagatgggttatcaccatcttggtcaggctggtcttgaactcctgacctcatgatccacctgcctcggcctcccaaagtgctgggattccaggtgtgagccaccgcactcagcctagacctacaaaattatacttggagaatcctgacaaaaaggctggctgagaaagcacacccataattatactcaactctcatatagagaactctatttaactttgtagtgcttcatagccaagacttgccagaaattggcagaacatctctaacataagagagaccaaaagaaagaaaaatgtacctcggagataacaaaaacaatgtaataagcaaaagaaatcataaatgaactgtaattaatattcttgtagaggtgaggtgaaggaacaagaataaattgctattttctaaaacattcagaaagcttgggaactaaaaataggagagctgaaatttaaaatcagtgattggataaagttgagaaaatatcttagtaaaacaaaaagaaaaaacaagagatgacttagagagaaaagataagaaacttagaagcaaaattcaagttgtctgatgtttaactgactggaattccagaaaaagagaatagagaaaacgaacagcaggatgttatcaaaatgacaatataagagtagatggacatgtatctgtttccaataccactgagtgaggaaaataagccacagtaccatgaaactgtagaacaccaaggacaaagagaagctgcaaaaactgaaaaatcaactcttcaatcagaaaattgaggcttcagggcaaaccattctcccaaaaactggagggaatggtgcatactgagaatcacagattacctccagaaacctcaccagattctcagggtaaagagaaaaatctcctcaagctttaggtagggagaaggggaaatcatcatcttgaaataagccgtagcactccttagcaatggtttgctctcaaagtaaactgtttaatcaagcctaattgacatgtgctttaccagagcctaacagacctggaggaagatgtgttagtccatcttgcattgctaaaaaagaatacctgagactggtaatttataaagaagaggggtttatttggctcacatttctgcagactgtacaagaagcatggcaccagcatctatctgcttagcttctggtgaggcctcaggaagctttcccttatggtggaacacaaaggggaacaggcacagcacatggagagagagagagcaagagagagaggggagggaggtgccagactcttgaacaaccagatctcgcaccaggtcttgcgtgaactatagttatagagtaagaactcactcacaagtgcagggacaacatcaagccattcatgagggatctggccccatgacccaaacacttcccactaggccccaccttcaacactgggaatcacatttcagcatgagttggaggggaaaaatacccaaagtgtatcagaagggaaacacccaactgcagccctctctagccttcctgtcttacctaattggggagaagggaacctgagaagcacttgtgaaagtcacggcccaggcacacaggctcactaaaagactgagaactaattatgtgattataagacactccccccaccacacacacctcaccaccacaccaatcagtctcctgtgtaatgatagtggattactgctaaatgaactaattttcagaccctattctattttaataaggagtctttagggaaacgaagaaatgatagatacaaaaacaaggatgtgattgtaacaacgtgggtacagctggaggccattatcctaagtgaattaatgctgaaacaaaaaaccaaaaactacatgttccgaactcataagtgggagctagacattgggtattcatggacataaagatgggaacagtagacactgggtactgcaagagacaggagagagggaggggagaaagggttgaaaagctgcctattgggtactatgctcacgacctgggtagcaggatcagttgtaccccagacgtcagcatcacacaaaatacccttgtaacctgcacgtgtacccctgaatctaaaataaaaattgatttaaaaaaggacactaaaggaaatgtaacctatacagctacacaaaacagtaaacacaacccaactcttagccagagaaacataaagcctcaaacaagaggactttttaccgcagtttcttctacccagtatatcatgtctgctttcaacaaaaacttacaagacatgctaaaaggcaaaaatcaaagttgcatgaggcataacaagaatcagaaccattgccagactcatttatggcagcgatttttggaataatcagactggaaattttaaataagtatgattaatatactaaaggctctaatggaaaaagtgaacaacatgcaagaaaggtgggtaacataagcagacaatagaaactctaagaaagaacccaaaagaaatactagaaataagcaatactataacagaaatgaagaatgcccttggacttattgatagagtggaaaggacaatagataacctgggaaagattcaatgagcttgaagatatgtcagtagaaagttccaaaacttaaactgcaaagagaaaaaagaataaatgacagaacatggcggggcctggtggctcacactgtatctccacacttcaggaggcccaggtgggaagatcacttgagaccaagagttgagggccagcctaggcaacagagagagatctgttgactccacaaaaaataaaaaggaaaagaataggatatccaaaaactgtgggacagttacaaaattatatatatttaagtccttgctttggctgaacctaacactaaaattggaacaataccaagaagattgcacaacatggccctgtgcaaggatgatatgtaaggtcatgaagcatagaaaaaacatttctaattgttttttttagatggagtctcactctttcacctgagctgtagtgcagtggcatgatcttggctcactgcaacctctgctgcccagattcaagcgattctcctgcctcagcctccagagtagctgggattacaggtgtctaccactgcgcctggctaatttttgtaattttagtggagatggggtttcaccatcttggccaagctggtcttgaactcctgacctcgtgatccacctgccttggcctcccaaagtgctgggattacaggtgtgaggcacctcacccagccaacatttctaatttttttttttttttttttttagacatagtctcactctgtcgcccaggctggagtacagtggggcaatctcggctcactgcaagctccgcctcctgggttcatgccattcttctgcctcagcctccctagtagctgggactacaggtgcctgccaacacatccagctaattttttatactttttagtagagacggggtttcaccatgttagccgggatggtctcgatctcctgaccttgtgatccgcccgcctcggcctcccaaagtgctgggattacaggcgtgagccaccgcgcctggccaattttttaaaaaattaaaaaaaatatgtgtatgtaaaattgtgtacacacgatgggaataacagaggaaaagagagaaaggaatagaagaaccatttgaagtaataatgactattttcaaaactaaagacagatgccaaaccacaaatccagtttagaaagttaagaaaacaagcaagatcaataccaaatgccaggtgcggtggctcacacctgtaatcccagcattttgggaggccgaggtgggcagatcacttgaggtcaggagttcaagaccagcctggccaacatggtgaaaccctgtctctactaaaaatagaaaaattaggcctggtggcaggtgcctgtaatcccagctactcaagagactgaggcaggagaattgcttgaacctgggaggcagaggttgcagtgagctgggcaccactgcactccagcttgggcaaaagagtgagactccatctccaaaaaaaaaaaaaaaaaaaaaaagataaatacaagaaagtctgtacccaggcacctaggcatatcataatcaaattgcagaaaatcaaagataacatcctgaaaaaacctagaggaaaaaaaacacctatggagagtggagtgaaatatctctatatttattatgtctttattatgtttttaattatgtttttcatttatttttgtggttacctggtaggtgtatatatttatggggtacatgagatattttgatgcgggtatacaatatgtaataatcacatcaggatgaatgaggtatctgtcacctcaagcatttatcattttcttgtattacaaaccatctagttatactctagttgtttttaaataaatagttaattattgactgtagtcgccgtgttgtgctatcaaatactagattttattccttctatctaataatatttttgtaccctataattatcccctcccccacccacctacccactacccttcccagcctttggtaaccattgttctactctctatttccatgagttcaactgtcttaatttttagctcccacaaataagtgagaacatgtaaagtttgtctttctatacctggcttattttacttaacataatgacccccacttccatccatgttgttgcagatgacagggtcattcttttctatggctgaatagtacatatatatatatatataatatttcctttatccatttatctgttgatggacacttagattgatcccaaatcttggctattgtgaatagtgctgcagcaaacgtgagaatgcagatatctccttgatttactgatttcccttcttttgggtatattcctagtagtgggattgctagatcatatggtagttccatttttagttttttgaggaacctccatactgttctccatggtggttgtactaatttatattcccaccaacagtgtaccagggttcccttttctccacatcctcaccagcattcgttattgcctgtcttttggataaaagccattttaactgggatgagatgatatctcattgtagttttgatttgcatctccctgatggtcatgacgtaatattgagtaccttttcatatacctgcttgccatttgtatgtctactttgtagtaatgtctattctgatcttttgcccattttttattgtattattcgattttttattgacttgtttgagctctttattctggttattagtttcttgtcaaatggatagtttgcaaatattttcttccatttgggggattgtcacttccctttgttgattgtatcctttgctgcatagaagtttttacacttggcatgatcccatttgtccatttttgctttgggtgcctgtctttgtggggtattactcaagaaatctttgctcagtgcaatgtcctggagagttttccaaatgttttcttttagcagcttcatagtttgaggttttagatttaagtatttaattcattttgatttgatttttgtatatggcaagagataggggtctagtttctttctttcttctttttttcctttgcttttcttttttttttttttttttttttttttgagacagggtctcactctgtctcccaggctggagtacagtggtgtgatcacaactcattgcaacctccacctcccaggttcaagtaattctaatgcctcagcctcctgagtagctgggatttcaggtatatgccaccatgcctggctaatttttgtattttgagtagagacggggtttcaccatgttgcccgggctggtctcaaacttctggcctcaagtgatccactggccttgacttactaaagtgctgggattataggtgtgagccaccatgtccagcaagtatctagtttcattctactacatatggatatccagttttcccagcaccatttattgaagagactgttctttccccaatgtatgttcttggcacatttgttggtaatgagttctctgtagatgtgtggatatgtttctgggttatctgttcttttccatcaatctgtgtgtctatttttatgccagtaccatgctgttttggttactataactctgtagtataattcgaattcaggtaatgttactccaccagtattattctttttgctcaggatagctttggttattctggatctttcatggttccaggtaaactttagaattgttttttctatttctgagtagaagaattttattttattcatagctattgtaaatgggattactttcttgacttctttttcagattgttcactgttggcacataaaaatgctactgatttttgtatgttggttttgtcttcttcaactttctgaatttattagttctaatagtttttttggtggagtcttttggtttttccaaatataaggttatattatctataaacaaggataatttgacttctttctttctagtttggatgccctttctttctattttcttattactgtaagacttacagaatgaaatatttaaagtattgaaagaaaaaccccaccaacctatggtaactccatgtttccagttggtagttgcttaggcaaaacaccttggagtcattcttgattctccttgtccctcacatcccacatcctatctgttaggatatcgagatgtaataagaaaaaaaaaattgtaatcctccccttcttaccacctctatttctatctccttggtccaagccatcattatctcttctctggattattgctatagactccatactacagtctaaacagagcaactagaatgattaaagtccaatctagtactactacagaagcttcccatttcactacctgtctatgaattacttaatttctctgtgtctcagttgcttcatctgttaaaagagaataatacctcctcaggagattgtgtgattgatgaggaggcacttacttaataccaacctgatgcacagaaaatagtaaagtttagcgattttttttattattttaatttccaatttgcccttcaaatcagaagcttagttttgtcttattcttcagtgcttgaggtgggagggtttgtagaaacatttggcttctgaatacctagctcattgctgtcaagcagaatcctccatcttttagtgcctgaaaatattcagatgtccagaaacattaaccaaaggaaattccatttctagctctgctgtttgtataggcaatgtagtgggtcagttttctgcactgtgtagaaattgctttgtcagtggaaaatgttattttcgtcggttttacagttcctaacttttgaggcatttgttccctggaggatactaaaagaaggaaatcttcagacagctgcccactgaatttttgcgtgagcctttatttgatattttacccagaccccttttggttttttattacagtaacatcgcatacctaggttttttttttcttcttcatataagccttacctatctggaactgtcagtactaggaaggtacttatagtgttgaatgttcccactcatatttcctgttatgccttatgctttttataacaagccaaaaagaggaagaaagatttcaccatagatttgctaaaggcaatgtgggatgcaatgagtgtggtttaatggaagagccctggggtgcggcctctgagccttgctctgccactgacacctgtatgactgcctgggcttgagttaaacgttctgcataaattctagcagaagaggctagctcaaagaggagattcagtgtctgaatgtctgagagagtgtgaaaataagaaaagttggctgggcgccgtggctcacacctgtaatgcagcactttgggaggccgaggcaggcggatcacctgaggtcaggagttcaagaccagcctgaccaacatggagaaaccctgtctctattaaaaattcaaaaaagtagccaggcgtggtggtgcatgcctgtaatcccagctactcaggaagctgaggcaggagaagtgcttgaacctgggaggcagaggttgtggtgagccaagattgcgccattgcactccagcctgggtgacagagcgaaactccgtctcaaaacaacaacaacaacaacaacaaagtcaagtcacttgagacctcaacccactgacaagagaagagggactggggcagacccaacctgaactggttctgtaaagcagccacggcacagaccagagtggactgtgggcctgagcagtgtatgcccctggggcctggaaagtaggggctgggacttcatttcttgaatagagggagaaggaaagacacttgagaatctggtaaaaacaaaaacaacaacaacaaaaaacccaaaacaaataaaacattctagtagcttcagcccctccactgggcatggtgtcttcttgacccacagacaataggcaggcaaagtagatggaagcaagtgctaacatgatacacagctcccagggcttagacacttcccacctcagcaagctggacccatccaagctgtggtgtcagggtagaacaaatgattctttttttcgagatggagtttcgctcttgttgcccagtctggagtgcaatgctgagatcagctcactgcagcctccgcctcccaggtttgagcaattcacctgcctcagcctcctgagtagctgggattacaggcgcctgccaacacgctcagctaattttttgtattttaagtagagatggggtttcaccatgttggccaggctggtctcgaactcctgacctcaggtgatctgcccgccttcgcctcccaaaatgctgggattacaggcatgagctaccgcgcccagccgaacaaatgattcttatatgtagattctttagggagcagctaagccagcccccattgactgggggagatgatggtagctttgagacactcctagcagctgcagttttgttatcctgcaccctgttcactttccagggccatgcacctccacggaaataccttatctataagccttgtgtctctacttcagtttaggtctcctagactgtaacggagaacaaaaaaaaaaaatagaccaagttttaggcattgcaggaaaaaaaagtgtgttcattctctgagcctccgaagtaatgcagctatatttataagtggatcagtaaaaggagaaacttctttaggtttttagacctgggattcagcattgagattttctgtgctctgaaggactatccagtaactgtccttccaataactttccttagtttcttgttacaatcgcgattccggtggttatcaaacttcttcctagtggattgcttttccactcttcattgacattacttgttcccaagtttttttttgctgttgcaaagtgttgaaataaacatctttgtacttaaatgatatatgtgtaacagtaaatttttaacattaaaccactgacttaattcatttattgaattttgttgtagtatatcacacatacagtataccaatcatttatcaataactgatgtgttcacaaaatgaacacatgctcataatcactactgatatcaagacagaaaattaccagcaccctggaagcctctctcagcttctctctctcaatcactaccacctccttcctacccagggcaaacagtatcctgatttctaagatcattgatttgttttacctacttagtagctttaaattttttaaatgaagatgtagtatattattctttggaatctggctccccacctcctcatcattatgttgagattcatctgtgttgttgctaatgtagcagagttcatttttttgttactgtatagtgtatcattatatgcgtagatcacgttttttaatttattctttctcattgcactgttctgcaatgccaccttgccgtaaaccaggcatctgcatctgaggggctgtttctggacctgtcattctgtttcatcgatatatttatctatccttgtgccaaaaccctactgtcttacttatggctatatcattaacttagctaatgtttagagctatgtaatgtagataattgtagctgtataatagtaatgtatcgatatctggtagaataagttcttctactttgttattcttttaaaactaccttgactattcttggccctgtgtatttccatataacttttacaatcaagttgaaattactccctcccctccaaaaaaaaaaaaaaagcatgctagaattttgattgggaattctttgaggagaatggctatctttattatattaaatcttcctgtccctgaaagtggtatgtctgtttatgtgggtctttaatttctctcaatagtgttttatagttttctgtgttaaggttttatatatcttttattgatttactcttacatattcagtgggcttttaaatgtaataaatggtatttatcacaaatttatcataaagattcctaattattgcatgtattagaaacatttttatatattaaagcataggtttttaattataagattttatgagatttacggtttatatcattttaagaatcacttaatattcaaattcaaatcaccatgagaattctgggtaaattgagaaaagtaaagttggattaaatccagggttgtatccttggagaattcaaaaggaaccaggaagagcttgttcctaaactgcgtgagttctgtgttggttgcttgagagagattgcctagggcttgcttcctctctcagctaaagtgattgggatttggcagtcagggtgcttttgtttttagggtaccctgagccctctcctagccagcccacatttgtgagcactcggtaaacacagagcaggagggaattacagtgaatggggatttccctcagtgctgcccactggctgctcttgaactgacaggcttctttctcattctaaactcaccagcagtggagcagtaaacccggccacggtcaggcatggcacatgtcctgcaatgatggggactggacctgttgccttaaactcacgcctgctttgtttttccaggtctataagggagaattccaactacctgactttcttaaagaaaaaccacaggtactgtgtctgctttttcctcctgatgtatactagattggctcttgcattgaagtaatatttttaaagagataatgaaattaaaaagacagaaacaagaaaaccaaaaagaaaagaagaaaagggatagtgatatgtgctggggaagaaagatcagcgtctgggacttgttgattttaacaataatttaacacagtcttaatttcagagagctcagtgtctcccaaaaccagggaaatactttattgataaccaaattctgattgcttgaggtcctgcacaagccgcccagtgggtaaagctgctccagcgttccagtgcctaatttgaaataaaaatgttcagcgaccctctctgttcctactctgtgtactgtacatccttgcccctttgacttttctcatttggagcccagatgacttatatatacacatagtcactggcccctgggaaggacagtgagagtttgaaggattaaagccagcatggtggctcatgcctgtaatcccagcaatttgtgagaccgaggttggcagatcacttgaagtcgggagttcaagaccagcatggccaacatggtgaaacctcatctctactgaaaatataaaaattagccgagtattgcagaatttgcctgtaatcccagctacttgggaggctgagggagaatcacatgaaccgggaggtggaggttgctgagccaagattacaccactgcactacagcctgtgtgacagaacaagactgcctcaaaaaaagaaaaaattagctaggcatggtggcgaggcctctggtcccagctacttgggaggctgaggcaggaggatcgcttgagcccatgaggtggaggttgccatgagtttagattgtgccactgcactccagcctgggtgacagagtgagaccctgtctcaaaaataaaaaaaattaagcagattcagagttttccctgtaacgtcttctctcactgacttgcattccaatcctgtttcctgggttggaaagaaacagggagtctcacggctgacatgcctagaggagcccggcatcctgcctctgggcatcactgtcatgcccatatggaagtcagaaaaaatggacactcatggcctgagtgcagccgacttccctttccagcaaggcgatgatgcatgttgcctccaggctgctgctgtcagtgattagcttgtcaataggaagaggagactcagttttgaactcagtttctgaaagcgttccagatagaggttggtgaagcaacagcacctcagagacttgtgtgaagtccagttgcctgatgcaagcctggagtaaatgggctgccctctctgagggaagccatgtctcacaccagagttgaagcctcttccttcctgacccttttctgaaaacacttagccgccagtaattgatacatatgacttgagtgtttcaaagtactttcaaggcatattcttattcacatatatttactattcatccattcattcacttattcaccaattgtttacccagtgtctactatggtgaggaattagagtaagtcctcaggagtcacgggggaaagaaagacctcaaggagctcctgatttatccagaagaatccgaccacctcgtgcagacaaggggacacagagctctgggcccaggctgggcatgatgtcccagaaacctgggcagattcatgaacagactgacaccggctgtggaaattggagccagagaatattccaagaggctgtcttgaaggaatataaaatccaaaagcgcccaggtgcggtggttcacgcctgtaatcccagcactttgggaggcccaggtgggtggattgcctgaggtcaggagttcaagatctgtttagccaacacagtgacaccccgtctctactaaaaatataaaataattagcaagacttggtggtgtgcgcctgtaatcccagcctgggtgacagagcgagagtctgtctcaaaaaaaaaaaaaaaaaaaaaaaaaaattccaaaagccggtttgcataacaaatctgaagaagtcaagaaaaggtatttgagactaaaactaaagggacactcctgcttcacaacatacctaaaaatatttccaaatggattgcacacctaaatgtgaaaggcaaaataatgaaagttgttagaggatatagaagagccaggcatgaggctcacgcttgtaatcccagcactttgggaggcaggcagattgcttgagtccaggcattcaaaaccagcctgggaaacatagccaaacctcatctctactaaaaatacaaaaaattagctgggtgtggtgcatgcctgtagtcccagctacttgggaggctgaggtgggaggatcacctgagccccagaggttgaagctgcaatgagccgagatcacaccactgcactgcagcctgggcagtcaatcctgtctcataaaaacgaagaagataatagaggaaccatctttatgaccataagaggacaggatttcttaagccctaaaaagtactgattattaatttaaaggtagataatatgaactacattataattgaggatgtttatgtaataaaaatcatgagagtaaaatagtgagcctaagtaggagaatatatttgaaacaaaggacttatctggagccgagtgcagtgactcacacctgtaatcccagcactttgggaggccaaggcggctggatcacgagggcaggagttttagaccagcctggccaacatagtgaaaccccatctctactaaaaatacaaaaaaaaaaattagctgggcgtgttgggcacctgtaatcccagctacttgggagggtgaggcaggacaatcgcttgaactcaggaggcagaggttgaagtgagctgagaacgtgccactgcactccagcctgggaaagattgcgagactccctctcaaaaaaaaaaacaaaaaacaaacaaacaaaaaactcatctgtggaatatagatcatcatcgtaagggaatttttttttaaattgggcaaaaagcctggacaacatagcaagaccctatctctatcaaaaaattagctgggcagggccaggcgtggtggctcccacctgtaatcccagcactttgggaggctgaggcgggcagatcacttgagattaggagttcaagaccagcctggcaaacatggcaaaactccatctctaaaaacaagtaccaaaaaaaattagctgggtgtggtggcacacacctataatcccagctgctcctgaggctgaggcaggagaattgcttgaactcaggaggcagaggttgcagtgaaccgagattgcgccactgcattccaacctgggtgacagagcaagactccatcaaaaaaaaaaaaaaaaaaaaaaaggctgagcgtggtggcatacttgggaagctgaggcaggatgatctgttaagcccagacagctgtgattgtgccactgcactacagcctgggttacagagggaaaccttgtctattaaaaaaagaaacaatcatgcagaagtgtgcacacagagacacacacacgtagaaaagggcccataaggtcttcagtttaacttctaatgaaaatcagcagaaactcatagaaccttcagattgaataattagctagaatggttcataaaactcggtaaagtgtagtacttaacaatgacagttttataaaggatgcagatcaggaccagccataagatagaagtgggcccaggagggtcctgaatgcagagcttctgtgcctcctccctatgaaagcagggcacgtcaccctcccggcacacccatgtgttcaccaaccgggaagtgccactgaacttccacacccagcatttttattggggtttatttatgcaggcaagattgatcaaatcgttggtcatgtgttagaactcaatctccagccaacctcccctccccagagttgacgtgggctccaagccccagcccctgatcccatggttggtctttgtggtgagcagccccatcctgaatcatctcataacataaatccagatgtgatccaagggcatcagaaataacaaagacactcttgttacccaggaaattccaaggattcggcatttccctcccaggaaccagggggaaaggccagtcagattcttgagcataccacagtagtgcactgagttcatctgaaagtgaacagagcctgcgggccacccctcatgtttcagtggggacggtcacttctcatgctgaccaacttcaaggacattaaaacatcttttctttccttcaacagactgagcaagtggagtagcagaaccaggagcctcttccatacatgaggtgagggttgggggacattgccaggtctttctgtttcccactcgggctcttgcagggggctgggtggccaaggtggagagcacagctctggagtccgtctgccagggttggaatcctgcctcttcactttctgtgtggaagcaagcacattacttcacctctctgtgtcttcatttattcatctatgaaatgaggataatattaacaagagcatggtggtgagaattaatcatcatccaagagcctggctcataataagcgcacaatagtattgttattttcattatgaaccatgaaatatttcagctgaaagggacctggaggccatcaagcccaactccctgtttactgataaggaagctggtcccagagggagcaggtcgtttgtcaggaccatagtccataggcaaggaaacccagaactcaagagtggctgtttacttctggttacctgttcagccagggccccagccacccatccccacctccagtggctttcttcgtgtgctggacttgcagatgtttttgccctactgcaatttttgtttgtttgtttgtttcttggttggtttttcaagtttgcccttgcttgttttaatgtattatggatggcttatgtgagtaacctatattgtctcattggactaagtgctacattgtagacaaggccagccttgccttctcagccctttttctatctgagtatgtggccctcatcaggcacatgtccagggacaccagctcatgagtggcaaagctggtttctcagcccagatctccaggtgcagctgctcagagttcatacccttgtcccagactttcagtctctgcttatccacccaaactttcttaagatcagttttgctccaaatgatgtggcaaagcctttgatcagttgtaacttgaacagccttttcaaaaaatctgatattggctgggcatggtggctcatgcctgtaatcccagcactttgggaggccaaggtgggcagatcacaaggtcaggagttcgagaccagcctggccaacatagtgaaacctcgtctctactaaaaatacaaaaattagctgggtgtggtggcagggacctgtaatcccagctacttgggaggctgaggcaggagaatcacttgaacccaagaggtggatgttacagtgagccgaaatcgtgccattgcactccagcctgggtgacaagagagagacttcgtctcaaaaaaaaaaaattggctgggcgtggtggtgggcacttatagtcccagctactcgggaggctgaaggaagagaattgcttgaagccaggaggcagagaggttgcagtgagccgagattgcagcactgcactctagcctgggtgacagagcgagacttcgtctcaaaaataaataaataaataaataaaaataaaatctgatattgatagtgattttttctcatagtttacttgctgacctttgttttttttttttatataatgtttttatttttactttatataatgatgtattgtgcatactccataccaggcataaaataccaaggattttatttgcatatatataagatgatatatatataacagatacgctaaattatatatacatctatatataaaattgtattcagttctcaaaccactctggcaagctggtagtattcctgttttgctagtgagaaaacaggttgaatgtgacttgcggtgcgttgatggattatagacataagaagcacatggacgctggtccgtcatgtcaaaatcccagatggcagcaagctgctaatattgacaggttctaggattcaggtttcctttttgctgaggagcaaatgctgaatgttagtcttatgccctgtgggtctgcatatttaacagcagttatcaggccttggctaattttgtttatacaaaatgctttcaaacttcataggtaatctccctgcccgccccaccaaacacacacaaggcctcatttctttaccagcgtgttgtaggatggaccgcatcagcagttgcctctgcagcatttcaccctggcttgtgtgtggaggttgggaggggccaacctgtgctgaggaggactcaggagaactggggacacagcaaagcccttaggatggatactatctttcttatcttttgggtccctttggcatttcaataacagtatctgtgttctctggagcttcctttaaagaaccttaggatccatttcttcacgtgaggaggaatcagggtgctgacccctggacacttaaagaaccttaggacccatttcttcacatgaggaggaatcagggtgctgacccctgggacacttaaagaaccttaggacccatttcttcacatgaggaggaatcagggtcttgacccctggacacttaaccttaggacccatttcttcacatgaggaggaatcagggtgctgccccctggacacttaaagaaccttaggacccatttcttcacatgaggaatcagggtgctgccccctggacacttaaagaaccttaggacccatttcttcacatgaggaggaatcagggtgctgccccctggacacttgaagaaccttaggacccatttcttcacataaggaggaatcagggtcttgacccctggacactttaagaaccttaggacccatttcttcacacgaggaatcatggtgctgacccctggacatctggtgcccctgacagtgcccccacagtagcaacaatagcagatgacagtcagttatttagaaatgggcaggagcagccctggttttggccatctgcttgctttgcacccagcagctacttgcatgcatctgaaagcaccagagtgagggtgtgtgtgcctcccaggcagtcttcctgaggcagctgttctcaacatccatcctcctggcccctgatctgcaggaacctccccaaccgcctggcttgtctaggcctgtagctgggaaggaagagacgaagacacagggagaacacaccgggactccacacctgtaaccacattctgtttgttcgccctaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtagttacatgttttcattaatgtgatttcagagaagcacagaccttatcagatgctgatgtgataaaccaaagtttccttggttggctgtattgtagatactcccctggagccatcacctttttttggaggggggtggtgggtagaggcagggtctcgctacattccccagcctgggctcaaacgatccttctgcctcagcctcccaaagtactaaaattacaggtgtgagccacggtgcttggcctgcattatcattttgtagtgaagttttctttttatttcaagagagaacctattgccatccactttgagaatcctgttctatttcatgcttgcagactgtatttaaggacatggaagttactatttccacttgttttctagaagcctttgttatgaaacccaggatgtccagatagtagtaataattcccatattgagtgtgttcacatatgtgccagccatgaaaagggtgtataacatgttatcccatctctgccccaaaacttgtacctatccatttaggtcatatccatatcagtaattgcagtattttctactgtcacttgagccagaaactgaagagtcacacttgatttcacccttttcctccctctttccattcgcatccaagatctttgatcctaccttcaacgtattttttggatcacagcagaataagagtttttagaatgcacatctggacaggagcctccccgcctgaaacatttcagtggcttccatttcacttaaaagagtccagactcctgtcagggccggcagggtcctcctctccatctcatcgcaggcctctctcccaacctcaccgcttgtgctctagaagtatctttattttcagaacatagcaagttcttcctgtctctacatatctcctctctctggaatgttcttccctttggctatttaagatgaagttttgctctgtcacccagctggcctgcagtagcacaatctcggctcactgcaacctccgcctcccaggttcaagcaattttcctgcctcagcctcccgagtagctgaaattacaggcatgtgccaccacgcccggctaatttttgtatttttagtagagacagggtttcaccatgttcaccaggctggtcttaaactcccaatctcaaatgatcctccctcctcagcctcccaaagtgctgggattacaggcgtgagccaccacacccagccccctttgttctttgtctgataggctccttctcaattctgtggtctcggtaagcctcacttactcagagggattttccctggcctcttaaactaaaaggtaattctcccgctgcttgccttcttcatggtcacactttgcagtgtttcatctgtttgttgccttttttattatctgtctcctccaccagccaataagttcctggagttccaagactatgttttttcttgtctgttgtacttttggcacctagcaaactggcactttctagaaaccaagtaaggccggtcgcagtggctaatgcctgtaatcccagcactttgggaggccgaggtgggcggaccacaaggtcaggagatggagaccatcctggctaccacggtgaaaccctgtctctactaaaaatacaaaaaatcagctgggtgtggtggcgggtgcctgtagtcccagctacttgggaggctgaggcaggagaatggcatgaacctgggaggcggaggttgcagtgagccgagatcacaccactgcactccagcctgggtgatagagcgagactccgtctaaaaaaaagaaaagaaaagaaaagaaaccaagtaaaatacttggtgaattactaatcctccaaagagccttctgacatacatactgttttacagatcaggaaacaggctcaactaggtcaggtcacttacacaaggccccccacctagtgccacaggtgacttggcatgtagctgggcccaggcacaagcctgactctaatgtcctctgcagtccacttcc

SEQ ID NO: 16397 - DNA, 12125 bp, Human
gaatgacttatatttcctctaatcatttaaagtatgacttctattgtatactacatgctgtatatatttgtgcctatttctgaatcatctgttttgtttcactaacctattctttcagtacattgactcagatccttgatgtattcaatgcgttggcattctatattgtatacattagatgcctccttgaaaggttgtgtgtgaagcaaaaacaattaggtgcataatctcattggcatcgtttagttattgttgtgtgacataccacaccaaaactcagtggcttccaatgacagccagttaagcccatacattcatagggtatactaagctggattttgtaggggcaactgtgctctgcatggcatccattcccttcccagggcagcaggatcatctgcctcacggcgatgtagaaacacaggaaggagtgtgcaaagactaaggccccagaagacccaggctttcccgacccactgccacttctgcctcatcttagtggtcaaagctacacagctaaacccaaaatcaagggtgaggaaagttccctttgcccccatgaaacatggcaaaggtgtggatgcagagagggtgaagaactggggctacaatcccaatctcccacagctactggcacataatttaaatggggaagcttccatagaaaattccaggtgctcatctaatattaagctaaaaaggagctgctaacatatatttgaaacacactgaaaatttaattccccagaaaagtacagggtaacataacatccatgtgtctatctccaataattaacaaattaatattttaacatatttgcttctgatttttttctttttttagaaataaaatattttagagtttatgtactctgtatatccttccacggttttatttctctcactatccagaagtaattagtaccttaaaggtagtctgtgcatatttttattatacatacagcattcattaagattaatatacttgttttcagattttacatattataaatagtatgatactatatatataattctaaaaatagctttttaattcaacagtatatctagagatctagctgtgttaatacatgtagattgtcttcatttaaattgttatattttactctgttgtatgactgtattattctgttcttgcattgctataaagaaatacctgagattgggtaatttataaagaaaagaggtacagaaagcatggtagcttcttgggacgtctcaggaaactgaaaatcatggcggaaggcaaagggcaagcaggcatgtcttacacggctgaagcaggaggaagtgagaacaggggaggtgctacacacttttaaacaaccggatctcaccataactcactcactcactatcaggacaacagcactaaggggatgatgccaacccattcatgagcactctagccccataattcaatcacctctcaccaggccccacctccaacactggggattacaattgaacatgagatttgggtggggacacagatccaaaccatatcaatgactatattataattaatcttttttcctttattgatggatgcttttaatggtgttaacttaccattatcataaacaagaaaacatttaaaaatcacatatttaaggtgaatacatgcaattttattaaaatattaaagttatttgcaaatattacacaggtgaaatataattaaactgagaattcaaaaacacctaagggatatattaaggaatatgttatgaagggctacacattattaatgaccaattttcttctgaaatatgtgctatcaaggaaataaaagaaagatctaccagcaggcagcactaaatattccatcattcgcacgaacattctcctacaagccacagcccagaagactgtcgatatgcacctagccttatcattttctgttaatatttagtcagtatttccaatataattggcttcttcttcagatcaaaggcttttacataggccctacctgcaaatcaaatagctatccatggaatattagaacttgacttgctccatcctcttaaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccggtaagtcgaaagtgcaattttagaatattgattaacttttaaaaactgatttcaggggaagactaaaaagattaaaaagtcattaatagcatgatcacaacaaagacttgtgtatttggctattaaaaatgaaataggaatgacacatggtcctgaggatgttttaagtaatttaaatggaatgttccggttctttaatgagggaaacataatagtgggttgagaagacattacaaagcctttcagtctgagtctgggtctgggacttaactagaacaaaactagataataaaaagttgatataaatatttgattctgattttgatcaaaatcaaattctgatacagatactaatacagagactggtgtggattaagacaaagggatggctcccttaatactcaccgaaggaggaaaaagtgaataaattactacactgtctgatatttgcctcaattcccaaggataaatattagttgccaaagtgatgggattatatcttgatcaaggtgttgatttggagcttggctccaaggcataaaacttttgaaacccaccttttaaaagtattttaaagaagaggcttaatggccatattctgtaggttctcttcacaggataggtattaatgaagagtaaaatgtctttaaataaaatcaatagtcaaattaccaggctctcgcttttgcttgtttgtttcaaagtgcaaggttgagtgtgctcactgtatctctctgtgaatgttaacactggaaatccaggacatttaattccattgaacatttattaagtgcttactatagtaaagaaacaaattgtgcctgaaacaaagtttgcaccaagtctgctgagaaagcagcccctcctccacgtttcataatttttcatataattggttctactccttctcctaccttcacccctaatctcagtctaggctaaattggtttgacatttcagattatttttaagaatctccctcttccatgttggcaactatgagagatttatctagtgttaaacaaacttggctagtacagagttcgtttctcctttaattcaaacatttgcttggatttgattagtggaactaaccatttcaaaattacaatttctaaaattattttctgagccatgctattttattatttttgcttaatctaaaaataatgatccccatggcagataatgagcaaagaaaaatagaaaagcacaacttataccatttactaatggatctgaagcaaagtataatgatggaggccaatgcttataaagaaacacattcagctgggcgcagtggctcacgcctgtaatccctgcactttgggaggctgaggcaggcagatcacgaggtcaagagatcaagaccgtcctgaccaacatggtgaaactccgtctctactaaaaatacaaaaattagctgggtgtggtggtgcgcacctgtagtcccagctactcaggcggctggggaaggagaatcacttgaacccaggagatggaggttgaagtcagctgagatcacgccactgtgctccagcttggcaacagagtgagactccgatccaaaaaaaaaaaaaattgtattcactgatactctaacgtcacaaagcagaattctgtggccagggaaaaagccaattttacatctgaatcaggaaataaaattctggaaggacgatcttcccataaatacataaagtccagggaaaactacagtgaaaacagaattgtcaggatcaactgtgtgactgataaggcaaatggggataggaaatgtctgaggccaggagctctgctctcacttttctcctttttagcactggcagggccatgggctaatatatgtgctggcaagtcttccaatgagatccggacgtgtgaccgccatggctgtggacagtactctgctcaaaggtatgaagttgcacaaccacccacccaaccctttggtccctaacctcttttcttagtgtccttgcccaacgttggttgcctcaagggctcacagttctgacagcatgaaaaaccagagatgtaaccagttacatcactgtctttggagcagcttccaagaactctgcttcaagtatgagctataaattgggatcagaatgtggaagaaggaaaagatcagggagcaaacacaatgttttccttctgaatgtcttcacacattcacttatctcaactgtttttttccaaagggttattaaacacaactatcccattttatagaagagaaactttaactgaggtaccaaagggttaagggacctgccaagcacagttggagatggtgaagcctggacctgaattcaggcttttggttcctcttcccaccaaaccacgcggttactggctcaggctctggatgttgaatattagaggctggccctaagcaggagagaaagcaccactatctcttccagaaaatgagggtcacacttgtgaattttcagttatacccaacatcaccttggggtgccactttctaatgaaatagccatgtgtccagtcatatcactgatctccatcctaactagaggggaactctcacatatacagatactacttacaaagcaacctcaaatactgaaacaggactaagagaagggaaatatgggaaacgtcccttgaattgccaaaattcagactcagcttatactgcaaagtttatgcacttgattgatacagtaaattcttggctcttgagcttgctcagtgttgctttgtacataattgcagcaatcctggtgaacctgatcgttcaggtgacagcctattagaaggtaggggaggctggtgagagcaggcatagtgacagcagcgggaagcaagagctgaggggttgctaagacgaactcaaggcacgtcacaatctagaatagtttgatttgggctccatgcactttaataaacccaggaggtatcactcattgtattaaaataccatatacagtaagtgacgtttacaatcacttttctagatcactgcaagaaaaataagactagggtaacatgtgatacttttatgataggttcccataaaaagacagctgttttcaaagtgggcttgaagatgtcaagatctaggtatctagaaaatgcacttacatggactgcctcattcccccaacatgccataaaataatagtagctaatatttgcttaaggcttattatgtaccaagtaccattttaaatgctttcatctttatgatatggttattagcacctgcggggagggaggttaaaattgggctaaacagagtgaggcatcctgggacatcccaacatgttctggcagcttcaagctttggtacctcgtctgcaaacagtgggctaacaccatgttcccaggcagtaaagctcccctaaggcagttcctcagtctgttcgttcttatttacatcctagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtaagagaggtggagtctacacctggggtgcctcctggagatgttgatgctcatttatttaatgcaggttccatacgtagagattttgtacttctttcaaaatgataaaacctggaacagaaagaatatagagtgtacccaaactagctgatgcattttttaaaaaacttttattttaggttcaggggtacatgtgcacatttgttatataggtaaaccacatgtcacagacatttggtgtacagattattttgtcacccaggtaataagcatagtacccgatagatatttttttctgatcctctcccagctgaggcactttcaaggacgtttcaccattttctctgaaaacttctgcttcatgcacacacttcacgaaaccccacagctgattggaggcattccttcctgtggcccatgtggttttgcttaacaatctataaacaaagccactttcagcaatgctaaccataatggatagatacttgcatttactcaaatcccacaaatcataaatgctggcacttctgcaagagttgaatgtgaaatatttttgaaagcttctaagttttaggtaaagctagatctcctggtactccaggtattggttttgttgtttggttactccatcaaggtataaatacacacataaaagtgcacaacacatccatgtatagctccgtgaatttcaaaaagtgaacacacctgtgtaatcagcacccaaatcaagaaaaagaacatcacccacatcccagagatcccttgtgctaccacttagtcattattcccagcaagataatcactatctcaagttctaacaccatgtattagttcttcctgtttctaaaaatggtataaatagaattaaacagcatgcactctttgggtcttctttcattccacatcgtgattatgcagtttatgtttttgtatccacgttctttctgatgcatgatattccattatatgcgtatactttcatctatttatctattcttcctcagatggacttttgggcagtttccagtttaagatgattataaaattgctgctacgaacttccttataccttttaatgaacatatatatgcattcctattgggagtgagtccagaggagaccctcctcaccaagcctgtgagaggcatcttttgagcgaacccacatccttgaggagctacatagtggttgtcctctgtaggccaatgtcacaagggaaacttctgccattgaactgtgtcctctgtagtggcacttaacagttaatgccaaggtcagtgagagcagaagcagtaatcagattcgtctaaatctcagagatttgtgacactggctagtaatcatggtgactcaggaactgaatagatgagcagccaactaaagccttattggacttgtatgaatggaaatgctccaggtctgatgaacaaaatgctgacttcagtcatcacaataatgggtcccaattcccaataaattcccaggcttgaattggttcacagtcccagagcctcttgaacaaaagggaggctcagtccttttgcgtaagggtcctgctacgcagccaaacatttatactgtaaaccttacttctagctgtccccaaagggacctgcaacggtttagcaggatgacagcacattagggaagaaataattaggctcttcagagattactggacacttgctcaaaactgacactaattcctggagatctaaaaggccactgtggttcaccagtcagactaggggcttagagtcaggtggtaaatatagcttttcactagggtccatcttacagtgagcccagtgcatcctccaatctaccaagaggttatttccccagttccagaatgcataattggaattgactttcttcttctttcagactgccttggcaattcttggttatttgcatttccaaataaattacagaatctgtttgctaatttccaccaaaaatcctgctggggctttgactgaatctgcagtaaatatacagatcaaattgagaactaatatttttaaagtagtgagtcctccaatcaatgaacatattatgtcctccacttacttaggtcttccttcactgttatattaatggttgttgtagttttcagtgtagaggtcttgcacatcttttgtttaatatttattcgtaaaacctacctgatggagttttagctcttctacagcagaactatccaatagaaatataacagaagtcatatatataattttaaattttcggctgggcacggtggctcgtgcctgtaatcccagcactttgggaggccgaggtggatggatcacgaggtcaggagatcgagaccatcctggctaacacggtgaaaccccgtctctactaaaaaatacaaaaaattagccagatgtggtggcgggcgcctgtagtccctgctactcaggaggctgaggcaggagaatggcgtgaacccgggaggcggagcctgcagtgagccgagatcgcgccactgcactccagcctgggtgacacagcaagactccgtctcaaaaaaataataataataattattattattattattttaaattttctagtagccatgttgaagtaaaaaaacatggtattttagtattttatttaactcaatattttcaaagtattatatcaatatgtaatacaaaaattattgagatattttacatttttaaatactaagtcttcaaaatccactgtgtattttaccattaaagcacatctcaattcatattaactacctttcaagtgctgcataaccacatgtggctagtggctaccatattggacagcataattttacagccttatttttatgctcacttgaccggtttgcagtgccactagtgtatcaaagtctcctattattggtgggtttctatctatgtttcctggcatctcttgtagtgtctgctttatatagatgacttgtgctatttagtgcatggatagttgtaactgttatatcttcattgtgacttgtggcatttaccctcttacattatcttcgtcttgtttcaatgccttttggcctgatttccactcttctggtaacaggacaatagcccttgctttcttattgcttggcaaatctttgtccatgtgcttggcaaatctttgtccagctcttcactttcagccttttcaatcgctgtgttttattccatacagcattcaattggggtttgcttttcaacccaatgggacatcttttaataggcaagataaggccattcacatttatagacatgactcctgtatttgtacccaacaccattttattgtataattattatattgtactctatttctctacttgggtctttgcctttttaattcttttgatatttagcaaagtttgtatttttgttccagttatttctatttttctttatctctaaagtccaatcattctatcagaatatgttttggagttgacattgttcagggctcaccttttctaactagctagtattttcctgctattattcttcaatgcctttattagcgtttcatttgaatctattcttcctttggcatcttgtaatttagtcttcctttttaatatcattttgtcattttcatctattcctctcctgagttcattcaacattcttttttttattttttgtccatttgttatttttttaatttcagattcaagattactgaagcccagataaataattatacttattttcttttaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctcataaacaaatacacctatgtacccacaaaaattttttaattaaaaaaaggaaatttgagtttaaatagaaacatgataaatgcaagaaagaaaacattttgattttaactcattgtcactctgatgttcatgtgaactggttgcttcgggctctttgatctgtcacctatggaatctgagtggttttattttttagatttctcagtcccgaagatctaagataaataaacaagagaacttacgctgggccaggctgcatttttgacacctctaaaactagcaacctttctgcttgaaaataagaaaaagcctgaaagtgtttctatggtacaagaacagtgagtggtttataatgctagatttagtatacatttaatacatattcaatgaataagttgagtttaggtagtagactctcagcaatatccttaggtttatcatattggttggagagagagctgctttcatggataataaaggatttgctggtatttccatccactcacccacatgattatgaatgatggcagtccaagaaaacatatcccaagaaaacagtgaggctgcactacaggaaggactagagtgagaatgaggcctacctttatctgaagtgtctcatggaattgggcctgtcaacttcatctagccatatgcatattacagctacttatttctacacatcattgtattatatctatgttattctgtcttagttatattgacaacaggtactatgaggaaacaagaccatacaaatgtccaaaggaccagaaataattctggctccttagagtttagccagttggtaagaaatgaatacattgaactaatcattctggaaacttcatgaatttctgcttaaatttgttcggaatgcagaaaatgccagcagaatgattatattcttatgtgtagattgttagaggaaaacataattaactgaagtttattgttagagaaatggctgcatttgtgtatcagggcatatgtatgagaatgttcatgatatcactatttttcatagcaaaaccttcagtgacctaaatgcccatcaacagtgaaatccaataaataatctcaaagttatagaatgtaatagtcaacagcagtcacaataaatgaacttcagctaaacataatgacctgaatgaatcatggcaatataattttaagttttaaaaagtccagaagattacataatggatgataattctttttataacattaaaacagttaaaatacaatttcctttttatataacaaaatcatatacgaaggcgagcaagaaaataatgaactctagttaactcataactagatagagaggaccacacagaaagatataagttactatcagtgctgtagttttgcagttgggaggtgatttcatgggtatttattattatgaataacatgtcacagaagcaacaggacttgcagtgggtggccaggaagaaagagttatcatgatgactctcaggtaattgagaatctatgtcacacatttagcaccttcttatatctattaggttggtgcaaaagtaatcacggtttttgctattactttcaatggcaaactatatctagcactgtctgatttgaatatgcatctccttggtaccaaataactttaggttgtttccagaaatttggctttcaaaaaataaatgctgtacaccactgaggacacacaaaaaggaaatagcacatcagctcttaaaggcaattttaaaagaaactctgaaatatttgcacaataaaatataagcttagttttccaaataatcatccttctgattatttaggaggcaaaacacaggtggatatggatattgttttaaaaaccagactcatgacctggaatggagaaattcctcaaggtagagcagggacattgccttcccctcagccttctcacatctgctcaatggaaatgcaaactttggaccaaaggacttatttctcaggaagaactggaatacagcgccctctagtgcaacaacaaatccgtgttattttcccccttgtcttttaggtttggatgtcaaaacgtttgacttaagcataaaaatgttacaaaggtttgaatggcaaaggggtaacagtatggagaaacttacttttcattagtaaccatgatgataatatacacttcaaaaattgtgatattattctgtcaggtttgatagctacacattaataatgtgaataaaaccaatatttactttgaaaatgttt

SEQ ID NO: 16398 - DNA, 23606 bp, Human
aaagcaatgggcatgggcccccaatgctattgacttcatctctagtaacccctcagttgcatttgccattgcagatattggcttttttttagcaaggtttctgataatgtcgagtttaagagaagcattgcagtgcgaagccttgaacaagaatttagatttttctttagattttctagcagagcagaggtgtcccacaatgcatcagtcagagtactacccccaaaacttctgtggacatccttttatactatgacattttcttctcttttgatgatatttgaaagatctcttatacctctttgttataaaagattcacttgctatccaagtgtatagattttattaagttattcagaaagtctctgttaaaaactttctaaataataataaccaagtctcctgattcccatacttcctaacatagctggcataattggccatatttattgtccaataaatatgtggatccttctggacagcaatctagggtctagaagtaattaccttgtgaccagataaatcaggttcaatgagatttttcaaaaacacagaggactatccaagtagaacaaaacacaactttaatgttccaaagccctccaaatgtacatgtcttttgatccagcatttatatttctgataacttagcccaagaaagttattaaggacatgtaaaaggatgcatgcacttagctgttcactgtgcattgggaagatagttagaagagttttagaaaatagttagaatactaaggatttatgtttaagatgctgagtatcacgctattgaaattacaagcattatcttgctcatttctcggaacaatcctatgtggtatttactataattactcctatttatagataaagaaatggaaggtaaagagactcagtaacttaatcaaggatgttcagctagtgaaggtcagctccaggaatcaaaagcaggactgatttttaaaactttgttcttgtccaccacactttactagaagatttgtggttatgcaattgttaaagaaataatatacttttacacctgaataaataaatcatatagttttacacctgaatgctatgcacatattaaataatacattatcaaaatctatattttgacatgaaaagatatatataacatagtgttagcttaatcttgagcagatagattgcaaaacaatatgtacaatatgttcccattgttctttgtgaaccagtgtttttctgtctatctatctatctatccatctatctttctatctacctactcatctcgaaaggatacaccctgaggtgctagcaatgactataactaaatgtacaaggttataaatggttttgttttctcaattttccttgttaatattttccagccatttttttgtcatgagcacagtagttttcatagtagggaaaataaaagcaaattttcaaatttaacacgaaattaaaaactccttgacaataggacttgagtattgttcaccccagcccactgctgtatccagcagagtgccatgttcaagaaacactgaagagccaccatgaggtctggaaggtgagcaggtggtgccagagaggagtccatgataaaggggaatgagcagagctccagcaaatggagcaaatggaacagcaagaacctgctcattcatattagtgtcttcaactggatttcttaacatttttaacttgacataatttcagacttgcagaaatgttgtaaggaaagtacaaataacttccagctaccttttacccagattcaatgtttgttaaaattttactacatttctcttcccactgtatttcaaggagatttagacacagaggaagggtgaatctgtgttgaggtattttgttttccaaattgtccttaaaatgttcctctgcattagaactctcctggcaggaagtctgctcttgccaccactagggctagagagtctcttcccttctttgccccgcctgctccctttgccaagaaccccactgaacaggaagaggtatttcttggggatgctaccaaggcagagactgtgaagaaggaagaacgttgcttgggcaaaaggagcatattctcaggagacggggcccctgcctgccacaccaagcattaggccaccaggaagacccccatctgcaagcaagcctagccttccagggagaaagaggtgagtctgtctgtctgtcttggctgcatggactgttgaccaatgccaagaccttcagggatgcctgtcctgtctgtcacctacccctggtatttggaagactgaggcttctgacaacttaagtcagtatggtgaaggctacagactaaggtccttgggaacaagggtcatttcaaggataagggttctcaaaatacaggagagggtttaattattagacagaatttaggaggccacaaatagggcaaggctgaggcctggagtagggaatgagtgaaggagaggcagtatgccaagttccaaggctccaatcaatacatgattctttctgtgttcgcggcccacgctgggtcacctcctggtacctgtcaatgtcatgcctgtcttccaagcctgccttgctttgggtactctgagcgagaggctgggatatgtcctagtgaaaagcagccttgtacccgaattctgatgctgctgtgctctaatcttcacaggcccctgcagctccttcatcatgaactggcacatgatcatctctgggcttattgtggtagtgcttaaagttgttggaatgaccttatttctactttattgtgagtatttgagcaacctcttgccccagacttcatgttgtcttgctcattgactcttctctcagaatgcatggttgtgtgtaaaggttacatatccaagtctttccacctgagactaactgacccaacctgaggtcaattggcaatgcctttctcactccccagcacacacagtggcccaggctccttggtctaccttggagatatagaacttaccagtttctgatggttagaacgccacgcaaagcttttgctagtagagtattatttgggtgatctcagctgaagtacttggcagcgcttgttattgttggcaaaatctaaaatacagctccagttcaacccaatgacaaggccatggtaagagctgaagtataatgtaacaggatttaactgagaaagaaatttctctttgtatacatataaattaattcatccaaatgcctagttaaagaagcctcctatgaaaggattttactgcaatcagaaactagaatcttctctagccccagaagccagtagggaaaataaatgaggaaggaaacgtgagtgggaggcagtagttagctaagaggtgtcttcctcatgatgcaatctgaaggtgcaattcctatcatgtcagacagcaggacagaaatatgaataagggaacgtattcacaaaaccacatttatgcatcttcactgagtcagagagttcagtatttcccactaatagtcacagtaccctagcagcccctgtgctgatacttgtttgtcatattcatcatgcagtcacatttggggctgagccaacagctgattttcttttcagtcccacagatttttaacaaaagtaacgatggtttcaccaccaccaggagctatggaacaggtaatctgcatggtggtaaatcttctccccatcctcctgctacttctatgctgaattcctagagaccttccacacagcctcctttcccaagaaattcttttgtacaaagggtccataaagatcttctaattaattccctttcttttacatatgagaaaaccaagagcagactgagggaaatttctgatccttagtttttctcctggatatggggatgatttatatctaatcattgtaatagaatgtgaaagtgcttaatagccagtagctatgggagatagagagatgagtggggcatggttctcctctcccgattaaaccagcttccttctgaagcctttcccaacaacatcctctcacttcctcttaagacacctattactactgacatcgttaggagaaagaccgtttctcatttatcttagtatcaacagaggcaacccaatacagtgagctgtatggagaaaatactcataaaatatgtattgagtccttaagttataatctcaaagtagtttctgatgaaaaccaggctattacatcttagagtctataaacggggtactgaaataaaaagtgaatgccaatttgtttcattaagataaatgtaagtaactaatttgatgtcagagtaaagtggtcttcaaccacaatggacaaataactggcagcccaattagatgtttgaccagcctctgaagccactgcggctgcctgctcagacagccagtgttcccagggaaatgaggcccctatatggatttctagaaatgaatggacccttccctgcttatagaaaatctccctaaagttcacctgcttccttgtctgataatatccccttggccctgaaattttgttccaattagcttcaatccttagagctaatacagtgctgatgagaaaagagtcccagagttgcccaggattatgaattttcatactgaatctgggacaccagaagtagaaagaacagcaaagatgctgtgtggagcctgggcgagaagtactccaaacagtcctttggagaaaacactgtcaaaggtttatatacgataggagtgtgagagtttctctctgatactaaattcctccattacttttcctttcttctgttctttttctcaggatttgatgcctatggctacatcaaaaaaaggagacatgaaataggatttgggtgtcaagttgacaaataatgatagtagttagatggaaggctcaaagaaagaaattatttgaaatgttctagctcagagtggccaagagcttcttgtcatctccatgattcagagtcacacagcccatactctgatgtttctgtttctgtgttgtattcatcataccataacctttaggtttacttttcactttagtctcacagatttttgggagcagttccccaagtcccaacggcttcattaccacaaggagctatggaacaggtaaagtgcatgattacaacctactccccatcccctaggttctcatgcactgaattcttagagatttctcccattgtctttattcttatggaatttttttgctcaaagggaccataacgaccttccagttcattctctttgtacatattattttggcttttattttttaattttctcagtacatagtaggtatatatattcatgagttacatgatatatattgataaaggcatgcaatatgtaataattatatcagggtaaatggagtatccatcacctcaagcatttatcttttgtattacaaacaatccaattatactgttagttatgtttaaatctgcaattaaattatgtttgactatagtcaccctgttgtgccagcaaatactagatcttatttattctttctattttttagtacccattaacaagccccacttctcccccatacctccccaccaactaccctttccagcccctggtaaccatccttctatgctctatctccatgagttcaattgtttcaaattttagctcctgcaagtaagtgaaaacatgtgaagtttgtctttctctgcctggcttatttcatgtaacataatgacctccagttccattcatgttgttgcaaatgacaggatctgatttttttatggttgaacagtactccattgtgtatatgtaccacacttctttatccattcatctgttgatggacacttaggttgtttccaaatcttggctattgtgaatagtgttgcgataaaaacgggagtgcagatgtctcttcaatatactgatttcctttcttttgggcctatacttaagagtgtaattgctgggccatgtggtagttctatttacagttttttgaggaacttccaaactcttctccatagctgtactagtttacattcccaccaacaatgtatgagggttctcttttctccaaatcctttccagcattggtattgcctgccttttggataaaagccattttaactgggttgagatgatatctcacggtagttttgatttgaaattctataatgaggaatggtgttgagcacctttttatatttctatttgccatttgtacaacttctttggagaaatgtctattcagatcttttgcccatttttaactagattattagattttttttcctatacagttgtttgggctccttatatattctggttattaataccttgtcaaatgggtggttttcaaacatttttttccattctgtggattgtctcttcactttgttgattgtttcctttgctgggcagaagcttttttaagttgatatgatctcatttatctatttttcctttggttgcctgtgcttgtgggatattactcaagaaatctttgctcacttcaatgtcctacagagtttccccgaagttttcttgtattttcatagcttgagattttagatttcagtctttaatccattttgatttggtttttgtatatgtcaagagataagggtctcctttcattcttatgcatatgaatatccagtgtcccagaaccatttattgaagacactgtcccttcctcaatgcatgtttgtggtaccattgtcaacaatgagttcactatagacgtagggaattatttatgggttctctcttctgttctggtctatatgtctgttgttatgacagtaccatggcattttggtaactaaagctctgtagtataatttgaaatcaggtaatgtgattcctccagttttgttatttttttgcttaggatagctttggacagtctgggtcttctgtggttccatgtacattttacgataattttttctgtttctgtgaataatgtcattgggttattgacaaagattgcattaaatctgtagattgctttgagtagagtggacattttaacaatattgattcttccaatccacaaacatggaatatttttctattttttggtgtccttgtcaatttcttttgtccatgttttatagttttcattgtatagatctttcacttctttggctaaattaattcctagatattttattttatttgtagctattataaatgggattagtctcttaatttcttttcagagtgttcactgttggcatatagaaatgctactaatttttgtctgttgattttgtatcctggagctttactgaatttgtttatcagttctaatagttttttggtggaatctttaggtttttacaaatataaggtcatatcatctgaaaacaaggataaattgacttcatcctttccaatttggatgccctttatttctttctcttgtctgactgctctagctaagcctcccagcactatgttgaaaaacagtgatgaaagcgagtgcggccttgccatattccagatcttacaggaaaggctttcattttttccccattcaatatatgctggctgtaggtctgtcatatatggcttttattttgttgagggatgttccttcaataccctgttttttgagagttttaatcatgaagcgatgttgacttttatcaaataatttatcagcatcaattgaaatgatcgtatggtttttgttcttcattctgttgatataatgtattacattgattaagttgcatatgttgaaccatccttgcattcctgggataaatctcacttggtcgtgatgaatggtctttttaatatgttgttgaattcagcttgctagtattttgttgaggtgttttgcatcaatattgattggtatatttgcgtgtagtttcattttttgatgtgtcttagtctggttttggtatcagggtaatgtaggcttcatagaataaatttcgaagtattccctctttctctatttttcagaacagtttgagtaggattggtattagttcttctttaaatacttggcagaattcagcagtgaaatcattggatcctgggcttttctttattgggagagtttttatcatggttttcatctcattacttgttattgatctgttcaggttttggatttctttgtggtttaatcttggtaggttgtatgtgtctaggaatttgcccatttcttctagattttccaatttattggcatatagttgctcatagcagtcactaatgattctttgaatttctgtgccatccattgtaatgtctcctatttcatctctgattttattaatttgggtcatctctttctctttttttttttggtctggctaaaggtttattgattttgtttatcttttcaaaaagccgacttttgttgcattgatgttttgtattgttttcttcatttcaatttatttctgctttgatctttattatttcttttgttctactaattttgggtttaatttgtgcttgcttttttagttctttaagatttgtcatcaggtttttggtttgaagtttttattttttcttgtttttttttgatgcaggcacttataggtataaacttccgtcttaatatcctacaggtttcagtatgttgtgttttcattatcatttgttaaaagaagtttttcaattcctttcttaatttctttattgactgattggtcatccaggagcatattgtttaatttccatgtatttgtgcagtttccaaacttcctcttgttactgacttctatttaattccattgtggtcagagaagatgtttaatattatttcaattttttgaatgttttaaggcttgttttgttacctaaaatatggtctatccttgagaatgatccatatgctgaagaaaagaatgtgtattctgtagctgatgaatagaatgttctataaatatctattatgttcatttggtctatagtatagattaagtccaatgttactttgttgattttccaactgaaagatcggtccaatgctgaaagcagagtgttaaactctccagctattattatattggagactatctatttctttagctctaataatattttccttacatatctgggtgtgccagtattggatgcatatatatttatattgttatattctcttgctgaattgacccctttatcattatacagtgaccttctttgtgtcttcttacagtttttgtctcaagatctattttgtctgaaataaatatagctactgttgctccttttcggtttccattgggatggaatatctctttttatcccttcatttttagtctgcatgtgtctttataggtggagtgtgtttcttgtgggaaatagatcgttaggtcttgttttttcatccattcagccactctatgtactttgattggaaagtttaatccatttacattcaatattattattaataagtaagcacttacttctgccattttgttatttgttttctggttgttttttgatcttctcttccttctttctttccttcctgtcttccttttagtgaaggtgattttctctggtggtatgatttaatttcctgctttttgtttttcatatatctactgtatattttttgattcaaggttactatgaggcttgcaaatactatcttatagcccattattgtaagctgataacaacttaactctgcttgcattaacaaacaagtaagcaaaaaaagaaaactaataaaaactctacattttaactttgtctcccactttttaactttttattgtttctatttataactttgtttttactgtctatgtcttgaaaagttgttgtagttatcatttttattggttcatcttttagtctttctacttaagataagagtactttacataccacagttgcactgttgtgatattgtgtttttccatgtacctactataatcagtgaattttgtatattcagatgatttcttattgctcattaatgtcctttactttcagattaaagagctgtttttagcacttcttataggactgatgtgctgttgattaaatccctcagcttttatttgtctgggaaagtctttatttccccttcatgtttgaaggatattttcatcagatacgctattctaaggtaaagggttttttgcttcagcaacttaaatatgccatgccactctctcctggcctataagatttccacttggggaacatcccaagcccagtaacgctgtgggtctgctaccagacatattggagctccactgtatattatttgcttcttttctcttgctgcttttaggatcctttcattatccttgaactttgggggtttgattattaagtgccttaaggtagtcttctttggcttaaatctacttggtgttctataaccttcttgtacttggatattgatatctttccctaggtttgggaagttctctgttattatcccttggaataaactttctacccctatctatttctctacttcctctttaaggccagtaactcttacatttgcccttttgaggctattttttagaccttacaagtgtgcttcattgtttcttattcttttttcttttgtatcctctgacttctgtgacccctctgattctgttattaatatactctgatgcattcctcagtatgtgaatttcattttttaactccagaatttctgcttgatccttcttaattatttctatctcttagtttatctgatagaattctgaatttcttttctgtgttatcttgaatttctttgagtttcctcaacacaggtattttggattctctgtctaaaaggtcacatatttctgtttctccaggattggtccctggtgccttatttacctcaactggtgaggtcatgttttcctgaatggtcttgatacttgtggatgttcatcagtgtctgggcatagaagatttaggtatttattgtagtcttcatggtctgggtttatacccatccttcttgggaaggctttccaggtattcaaaaggacttgggtgctgtgacctaagctctatctgcatgggggacatcccaagcccagtaatgctgtgggtcttgcagactcgtagaggtacccacctggttggtcttggataagatctgaaagatttatctggattaccagacagagactcttattctttttccttactttctcccaaacagaatctctttctctatgctgaccttcccagacctgggagtggggtgacacaagcatccctgtgaccaccaccactgggactgcattgggtcagacctgaagccagcatagcactgagtctcactcaaggcccactgtaaccactacatggctactgcttatgttttgtcaatgtcctggggctctataatcagcatatggtgaagccagccaagcctgtgacctccccttcagggcagtgagttccaccaggccctaaataggtctggagatgctatcttagaaccagggactggagtcaaaaaccttataaatctacctggtgttctgtcctcctgtggctgagctgaaactcgattcatgagacatagttctttccactcttccctcccctttctgcaggcagaggagcttcaccctatgaccactaccatcacaggcccacagggtcactgccagactaccactgatttttgtttaaggcacaggggctgtttggtcagcttgtcacgaatgctgccaggcctagaacctaccctttatgtctgtgggctcctatctggctcagggcaggtccagaaatgctatccaagagtcaaggcctagaatcttggaccccaagagctgacctttacttctctgtggccagtctgttacataaggtgcaagacaaagccccctttacttttctctcttcttttctcaagcagaagaatgtgctgggtttcatctgaagcccaagacatctcagtctcacccaaggcccataacatactacctaggtattgctgcttgttattcagggcccaagaattctttcatcagcaggtaagggatcctgtcaggactgtgtacttatcttcaagacagaggattcacttttggcccagggtatgtctaggtgtctctacaaatgtctttcaggaactagggtttggaatggggacctcacgactctgactagtgccctattctactgtggcttgcatccaagatgcaagacaaagtactctttactcttccctctcctctcctcaagcagaaagaaagggtctcttttggagctgcaagttgtgctgcttggggttgggagagcaatggcacaagcattcccttggccaccctggctggtatctcagtaggtgccccctaattccactggctcaaagcccagctcagcacaaggacttgcctaggagttgcagtccttgtggcctagactacctttcaagtttatttagggccccaaagcaattcagctcacagtggcgaggcttgccagaactcaggtttcaaccactgggatgggttattcccctccggctagcgctcatctaaatgcttcctccatgggtgggtatcagctgagtttggtccgttttgccctccactgtgacagggcagcactgagtccaatgtaaagtctcacaatccctgcacactccctctcccatgcacatagactttaccatgccatgctgtcactgcagcagggatagggtgggggtggtgtcagcaattcaagactatctttcctaccctctgcagtgcctctttcagctatccaggtactgagtgttcatctgattttttgttctcatgtatgtatatgtgcttttttgtgtgtagatagttgtcaaatttggtgttcctgtagggggatgactaatggaaactttattcagccactgcgctcttctccttattctccttatattattgtcaaggaaccagactagactgggtggaatttcttcctggatggagaataatttttaccaatataattgttaaaacaaagcaaaaatatgtatcactgtttcatgacttagttgcaggattcataacccaaaccagtaaactcgtactctcctttcttggacctcttcagtctgccccaaagactgggaattttatcaagcaagatgttttttcttatccacttctgaatcatcttggaatgaaagcagggacttttgcaaaggaaaaggatccacattggcaattgtcaacacgccagagaaactggtgagaacactggaatggtacagtaaagccacacactccacacagcctcagtgggtgggatggggtagaaacttgtggggagtggggatgggatggagtgaggaatggagaggtggctggctgaaaaactgaagctatttgttctggactggaggttaggagattcttcttagtagcagtgaagcagcatgattttccagtttcatttaaccacagaaattcgcaccttgtggtcttttctatagcgcactgtaattagctgatatcctggggatgggccaagacatttaaagtgaagcaaatgaccaaatgagatgatgtgtataaaagttgtttaacaacaaaaagaataccttatagatgtgatgtcaatgtaccatcccagtctgcatagtaaacaaggaagacgtgaactgacaaaattagtagtgtgaaaaagtaagaatcaggtcatactgaatttgcagttgatgatcatgataataataatgaggatgtattattatccacattttataaatggcaactagggcacagaaaagtaatttgcccaaggtcaaataacagaacgtggaattgaattcagaactctctgactccaaaacccatactctaatctgtgctacatacactatactcttgcttctctcgcttctatccctttattcctcctctagaaagtcctcctgtgatttagaagaatttgtaagaacatctcctttctgaatcttggtaatagatgaccaagggatctggatgctacaaaccctctagggctaagtacccaggtagcaagggaaaatgtcttaagatagaaaaacaggagcaagacaggggaatgaaaagaggaaaggagggaaggcaacgggaagaagcaagtgtgacaagtctgccacacccattaagttttgtggatcccaatttgcttgaccaaaacacatccatgtaccttttccttggtgatgaaaaaggtcatcactactaacctggccaacatggtgaaaccatgtctctactaacaattagccaggtgaggtggtgcatgcctgaaatcccagctacttaagtggctgaggcacaagaattgcttgaatccaggaggcggaggctgcagtgagccatgactgtgccactacactccagcctgggcaacagagcaaggctctgtctcaaaaaaaaaaaaaaaaaaaaaaaaaaaaaacgttaaagaaaaagacaaaggtcatcatggcaatggtttgctgctgactcgcaagtctgtatctccagctcatccttctcctcccaacaagtataccaaattccacttcgatgtttcaagaggcccacaaactcactatgttcaaaactgagtcaattatatttgacccccccactcttcctgttgcattccaaatactggtgagtactcatgtcacccaagattgaaggcttaagagttttctgggactttaccttctcttttcttcctcaattatttgttaaacaagtccttttctctctatgccaacaacaaatagttcagttctcacctggatttcttcagaattcttctaatccatctccttgcctccagttttgcactctttctagctatcctcctcagaactgacattataatacctctaaggctctaaactgtaccattttccaaattaaagtgggttaaacgccagttctcctagcatggcatatgtcaggttcatgaccatgccaaatgtcacactcagggtcaggttccagcccatgctaaggtcctaggggagtgggtgggtggcagatagctgaaagaacactcagggggccatacacaggtgaaatgtagttttattcagcagctctttcatcagcagctttctcatactctctgtctgtctgtctcagctgcttgctccagccgctcccattcacagctgcgcagccggctctcccttagcgttcagggtcagcagcttaactctttctccctctgggcatgaatgcatgctgagccatgtcctggctgccctctatcagtctgcaagatggacagccttggttctctctctctttctctgggcaccagagcctgtaccatgtcaaggcacgttgagccaagccaagttgcgtgcacagcatcggcaggtcaattatacctttttcaaacaatagtggctctgagctaagcatgagcttacacaaataggttatataacaagtatatatatatatatatatgcctgctccctaaactcgctgagtcactttggcctggatgtccacctcagcctattccttgaccaaagcacatccatgtaccttacatcatatcaggccttgcacagtgccgcctctgcctttgctccagccttgtctctcaaaccacctccctgccacctctgcactaactacgctgagcatctcgtagttcctcaagagctccaggctgcttccccacctgcctataatccatgctctcttccaggaagtccatactctccctgacagtttgtctgacaaacttagctatctcctaaaattcatctcaggtatcacctcatctatcattctagaaaaacttcagatctatgtagaatgatcgcttcctcctttctgcctcttccagatccagtatataatttcctagtactacacctgagatacctccttatgctagttaagttggttgtcttccctcattaaacctgtggttcttcaaacatgatgggaccactgacttttttaaaatggtgataaaatctatgtaccccttcccagaaacattacataagcaaaatatttttcataacattccagtggtttcatagttttcctgggaaaccatccatggcttccagcatgagagttcagcattaaggattctggttttagaccatgggtcagaaaacttttttaaaaaagggtcagataacatacattttaagcttttcagggcattggtctctgctgttgtaacttgaaagcagccgtagataatgtgtaaacaatgggcatgggtgcattccaataaaacatttaccaaaacaggatgaagtctggatttggcccactggttgtagtttgccaaccctcttgatcataatttctttgaggagaaatatatttgtttccacatcctcagcctaacacaatgcatggcatataatagacactcgagagatgtttggtgaatgagaacattcagtaattaattaaaaagtaatgaaataagatatttcagaaaaggagaacattgaaaagcgagaaactaaggaaatagccatggggatggaaagaataagacttggatacccactgattatgggacgtatgtgacaagtataggaaacacttctggctgaaatgatttgtaactcaccaattaattacagaacaaagatgtctaggactagtgtcaaatcagcaaatatttgacaagcacttgcttatttcttcttggattacacttttaaaagcaatacacttttaaatctcaccgttttcctttcctaagtactcaatatatagaaacacattttattagcacttggttcagcctcacttagcatacaaaatttctggcaacaaaaacaatcctatggatagaagcatgacatatttttttaaatgaccctgttttagattgtacagtaccccttccccttcattctcacagtgtggtccctggacagaaacatcagtatcacctgggcattttgtagaaaagtaaattattggttcccttcactagacctacttaaccaggagcccagcagtctgtgttttaacaagacctcaggctttccaaattccctctgaatcttgacaatgacttctttagggttagttgtgagtcccagctatagctggtcccagagttctctaccggccttccttattcccaggatcagatataatcatgggcacattggctcaagagaggcatcattaaaagactcactggtaaaattttttttttatttccagaagtttcttcaggacataactgatgctgagaagtattttattggcttaatttaccatcgtgaagagaaaaggtggcgttggatcaacaactctgtgttcaatggcaagtacgtgaacatgccacagtttcctggggatcttggtttgcttcaaaagaccaaacctgagattgctgggttcaccctggaatagctcaaacgctgacacttgactctgttctgctcttctcctttcttccaacccatctattccctgagacacattttaataaatgttttcttatgaaagagatcaaactttcataaggagaaagaagagtattcatatagcaaattattttattcatatcaagatccaaacaaatccacctacatagcattcatttgatgtatcttgtagctctctatagatgctagtttccatagcactgagcatttctgactgatcaaaaaagctcagtctcttgacttcaaacagactagatatgagtctagactggatgctagccatctctaggagacagggtcagttttatggaggcaacccagttggtatagagatgagatctatttctataacactagtgtttctgactgatcaaaagggcttcgtcttttaacccacagatcacattttattacaaagtacatacaagtttccccagatatgccttctttatctaagaaaggttattataagcaacttgtctatgtcttaaagctatgaacttctgacccccaagagctgtctcctgtgaattgttccatggagatgaggattggtgagaacaccaataatcttcccagtgtttatacaaaaatagtgattcagacagaggtcaagtcagtcccccagcctgtaactgggcttccctacagagaggaggaaattgacatttattcagtgtctgctaatgccagcactatgctaaacactttgcatatgttgtttcctgaaatattccccatgatgctacatgaaaagcttttatcgctccccatttcacagacagttgaactgaggacaagtaaagcttagaaatgtgttaaatatcataaagctagtcccaaacacatgacatttctccgaaaccagagccttttcagtcagactgaaacagactgaatgacagaaaaagaggtgggagagccaacaaatacctccaccaagtttttctgaggccactatggtctggaaagggatgcacaacctctctccttttccttcctgtcctcttgctgtgaacatgcatgctatcctaaacagtacttttggaagaagagacagcccatgagatgcttctaaccaaatgccagagtgagttagttagtccaagactgtgaatccatacacgctcacaggagagctgacaggaaagggtgggtttagagctgcatttgcggagctggattaggaaaaggatctgagctaaaaaggaggctacgcagatggagacgtgtgtgggcccggtagtctgctgcccttccaggcaaaactcctgcaagactctcactctggaatcaggaagaggctgggctaaaatgatgggccatcaccatgctttgttttttgtttgtttgttttgttttgttttgttttctcatttagtgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccatacaggtcgtctggccaatgattcttttacttacctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccaggcacagcctactgaccccaaggagcctggcactgattggcatcacattgatctagaactggtccagccgacgaagagtaggaaaagagaagggctgctcagggaaacattggctgggggcacggaataagcacatagtaaaaagggaacatcagggtcaaatggaaatcacctgagacaggaaacagggagttcatttggccacactggaagaaaggcaagaaagaggaagacaagtcttggagtaccctggctgttctccacactcacaagacatcagctatatactctgcttggtgcataagaaagagaaaagagatgccttttgtgttttgagtaagaataattaaaccataaggaagaccatgtataaaactgatggaaataatagtcaccaaagtacagcacataccattttgtgtctaataacaatgtagcacagtaatgactgtacatgtcattgtatgtataccaaacaagattgttgtaaatcatattttttattacaacactaagttctgcttctgcattcctaggtttcatcatttttggctccttagcatggccacttacaattttttaacatgagataacacatcaggtgtcagaacttgcttgaagggaattaccagaagtaatttgtgtttgagatggggtggaaattggaattatattagtagccggtggagatacaagttctctgactgtgttgggaaaggataagtgctaccgttgagaagggaagaaaggctgagtctaggtggagaaaaatatcaacagaactctagccaaaggcaagccccagaactcagacaacagaaaggaaatcctaatccttctgttttgagaagagagaactgtagttgcttcacttcctatttcatgacagaataactgcaaacttttaagatcaggaaatgtagacatctagtgatttctttagtagacagtttaatttcccccaagattaggagacacttctgtgcaggttctaaaaggagcccaatggcctggggtgggagtggggagtagatagggaatatgtgggatttggtttaagttcatcattgggagagttcctggatccttgcaagcttagataaatgtgatctttattagatagcagtggcatgctttaaaaaaaaaaaaggcaatgaaaatttagcaagccactgaatttgagttttcactttgtttctaatatgctgtgtgaatcagtacagttttcttaccctttcttggtcttaatttccttactgataaaatggggtagtaatacctatctcaaaaaattattgcacatattaaataacattcctctatgtatctcaatggcattagacattaggagaagcattttgtggaggatttgaagttgagatcttcatccaagaagtagcttttcaatttgctagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtataccactggagttttctggttatctctcgtatagcaaaatctaactgatgcaatctccatctggccttcatccttctccctttattgtcctttcgtgtattgttcatccagcaaccaggatgatcttgttaaaacattaaacagattctgtcactcttcttcagccccctgtgatggttttccaatgtgcttctggaaagagcaaacatccttaaaaggctcagtgtggcgattcctcaaggatctagaactagaaataccatttgacccagtgatcccattactgggtatatacccaaaggattataaatcacgctactataaagacacatgcacacgtatgtttattgtggcactattcacaatagcaaagacttggaaccaacccaaatgtccatcagtgatagactggattaagaaaatgtggcacatatacaccatggaatactatgcagccacaaaaaaggatgagagttcatgtcctttgtagggacatggatgaagctggaaaccatcattctgagcaagctatcgcaaagacagaaaaccaaacaccacatgttctcactcataggtgggaattgaataatgagagcacttggacaccaggcagggaacatcacacaccagggcctgtcgtggggtgtgaggagaggggagggacagcattaggagaaatacctaatataaatgataagttagtgggtgcagcacaccaacatggcacatgtatacatatgtaacaaacctgcacattgtgcacatgtaccctaggacttaaagtataattttaaaaaaaagagagggaggagccaagatgcccgaataggaacagctccggtctacagctcccagcgtgagcgacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccaccattgcccaggcttgcttaggtaaacaaagcagccgggaagctcgaactggggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaattatggg

SEQ ID NO: 16399 - DNA, 35263 bp, Human
gttctggaatacagtattcagagggagggaagcaacagtcccatgctagtctttaggggtggagcacacctggagcattgtgtgcaagctggaaaaaaaaaagaggattactcacacacctgacactcattgtgatgtgagtacccagcatggtgagctgtgtctgtaggaaaaactcttaaaaagctgagactatttaggctccacaaagagaaagctgagggaggctgagtagctagtatttgaaatgtcatcatgtggtggaacattagacacgattggtgtagttccagaaggaaaaactaggctgcacatataggaaaatcagaggtagatttggctccacacagaaaggaaggtctggctgttatttggagctttttagaaatgaaatggacttccttgtaagacagtgaattccttttcactaatgaagaaactgaatgatcactaatcctgagcgttaaagacttaacgtatgtcaggtgtggcttcttaacgcttaatgggtattagaatcacctgggggaacttgataactactgattgccaggccttaccttgagaagagttgcttcagcagatctgaaataaggtccaagaatctgaatttttaaatttatttttattttttttttttgagacggagtcttgctctgtcacccagtctggagtgcagtggtgtgatcttggctcactgcatcctccacctcctgggttcaagtgattgtcctgcctcagcctcctgagtagctgggactacaggtacatgccaccatgcctggataatttttgtatttttagtagagactgggtttcaccatgttggccaggctgatctcgaactcctgacctcaggtgatccacctgcctcggccttccaaagtgttgggattataggcatgagccaccgcgcctggccaagaatctgaatttttaacaagaaacacagtgagtccagatcacatggtcactgacccgccctttgagaactggtgaggttagataaactcagatctcttccacttatcctacaaataaacactttagtaaaaaatgtgtagtcaacataatgactgctcaaagttgtcttaacaaattttgtaagaaatctaaggcaaaattccttaatatgttgtcagctaagttagagatgacatcattggaatgtacgatattaggatatggaaggagaacacttgattctcactctgtgttataaaagataagattataatagcaaaatagaaaatatagatccagtttgaaaattttaaacacttcaaatagagaacccactccacttatgccaaggagcaatcggatggagaccagattggcatatgaaaaagctgtatgatcatttcaataggcagcacctgtgtaaggtgaaacatccatcagcctttagggcccaggcttatataaacttcagcctcgaactcacgaacaggtgtgggtgagagttggaaacataagggatagtgcggttggtcttctaagtctcgcccacttttcttaggggctaaagagcttttgttggcaagtataatgtgtttgattattcctaaagcatgcaacttggagccacattttggaattactctctcctgaaatattttgctctttgttaatatatctttaaaaagtgatgcttgaggtaattactgtcccatatcaggatcttttttaagttgtagtgatgtttcatttattacttaagtgctttaaaattttaaaaagacttttttttttcctttgaaaacctttaaaactgggctatttgaggaattgctgttcttggctgttatgttgattgatagtgttcatgtacttacctagtttactaaggacttctttctagcagattttctcagttttaactttaaggtatgtaaaatttccaaatggcagttaaatattgataataagttaaaccatttctttctatttcttcttgcttccttttaatgattcagacctccttatctatttttcttgaatcatgagagatgaaattgcaacaacagttttctttgtcacaagattggtgaaaaaacatgataaactaagtaaacagcaaatagaagactttgcagaaaagctgatgacgatcttgtttgaaacatacagaagtcactggcactctgattgcccttctaaagggcaagccttcaggtgagagctagtatgtgggatggcaaagggaagcaatcaccaagcaaccagccagctcctaggaaaatggagtgatcttgttttctgcatataagtaacaaaagttttatgggctcgagtttatttgtttgaacgtggaattgaaaggaggagacatagtagatgacactgtggctggaaacaacagagcaaagccccttatgtgaggtagattaaacaatttctaacttgtctttgccatgaaagataactaattttgtgacttagtgatgcaacatacattctgagccactgtatcaaaagttgatgatgtcttacttgtaagagtggagggtggaggaggctgaggggaaggaggctgaggggatgaggtgggagctatgtgtattggaacagtatgtgcataatgtgattctcctgctaaagtgtctgtcatcatgtcttcgtttcccttcgctttttaaaaaggtgcatcaggataaacaacaatcagaataaagatcccattctagaaagggcatgtgtggaaagtaatgtagatttttctcacctgggacttccgaaggagatgaccatatgggtagatccctttgaagtatgctgtaggtgagtaatctcatagtttgtgtgctgtgtgatacctggaaaccttaagttagacaactttacataccttcatgaaagatgatgccccaaagccttgagttggcagcagggatacttcttggttaagattttagatgcaaacttctgttagacaatgcagacttctattcaaagtgggtgaggtggaaagcacaatgattttgcaaaatatttgaaatgtggctttaatcactgcaccttattacaaactatagattggtaacagtatctattacaaactgtaggttgataacagataagtgttataggcaacatcagaaaggaaggagagttatctaccatgggacaattcagttcattaactgaatcaaaagaaactagtctttgtttttttctgaacaattaaccaaaatagctcttatagaatatcctaatttataacagtgtagtaggtgaaggtcataatgtccttcaattttttaaggcaatttcttttaaaataagttagcatattgtctccaggaaagattggagatcttgtagaaagttgaatcgctaattagcacttaaatttcttttcctacttaggtatggtgagaaaaaccatccatttacagttgcttcttttaaaggcagatgggaggaatgggaactatatcaacaaatcagttatgcagttagtagagcctcatcagacgtttcctctggcacttcctgcgatgaagaaagttgtagcaaggaacctcgtgtcattcctaaagtcagcaatccgaagagtatttatcaggtcaagagtgttccagttcttttctatactttttttctatctaattctaaaaagaatgcactcattatgaaaacaaagaagcaaaaaaacatggaaagaacaaaactgtagatttttaaaagccagactcttaatattttggcaaaactttttctgtctccttcactgcacaatgtattccctacacttggctgagcttttaggatccacataatcttttattgtcctatttcttcatacagtatttgaagatacacaggtttccttccacttaaattcctacagaatcaaagattaagattagtgggatttttttttttctgtcaattgaaaataccacggcatttatagaaaatttggatataggaaaggtcaaaggcctataaattctgccactagagcagtttttctcagctatttttttcttctttttaaaccataacccattcaaaatatgtatatttacatttaaaaagtttcatgaaacagtgcttatctttactaggagcaatgctcccaatgctcccaatacttccaattaaattcatttgatttcaagtatctaaattgatttcatgacccacaatttgaaaaacactgatctagagagaatttgttaacactatatgtatatatttgtttgtatgttctcttaatcacctatgtattaaatgttaaagcaattaaaattttaatattcatttgcctcctttgtaacttattattggcagatattctaggctgtttccacatggttgtaatatttttttaaaagctggtaactcgtatagtgatgcctgaattttaggttgtttcttgagatttgattctcaagcacagaactactgggtcgcagagtatgaacattttactggtttttaatatgcagccgaaacaccatgtagaaagttgtatttatttgtagtctcaccagctgtatgtaaaagtgccaactttgccatttttttctagaattggctattctcatttaaaaaacagataatttgattaacatgatatgcatatataatacagtattagtgaaattaaacattaaaactttccatgtgcccaaatgttttagcacctactgccctacaaattttctcttattcagccattcattatttgaagttctaatgtattattgtaggttctttatatgccagaacgattttaaccccttgacatatttctggcaaatgttttgtccctagttttttaaactatgtgtgtcattgatagtttcttggaaacagtgactttaagtaaaatgatgtatgacaaagccatttttttcctcagtcttataaccaaactatgttattcaaagacctgctatatgtcatttagcttaaaattagtttccaataacctatcgaggttgttgagtgaggatttacagtatttgcccttaattctatttttatttttagaaaggtcttcttccatttggggatcagacctgtaatcagctatattcttttacagcaatgtcttttcaaagtgtgatctgtaaaacatctgtatccatcatcttaggtgtttaaaatgaagatttctaggctgtggccccagagatcatgaacatgcagttttggattgggttggcagtggtgaggtagggatggaagagggacaattcaagaataaacataaacttgaataagcatattaaaaagtttttagttgaattaattaactttttaaaaaggtacagtataaagtgatttatgttcccgccaagtgctagaaatttttttcaaagatggttatgcactttcaattctattcatttgtgctccctatgcttttgaagtgcctgacttttgaattatgggttcatatttagtccttacagctagcttattagagatctttatactttttttttccaggttgaaaacttgaaacagccctttcaatcttggttacaaatcccccgcaaaaagaatgtggtggacggccgtgttggcctcctgggaaacacttaccatggctcgcagaagcatcctaagtgttacaggcctgctatgcaccggctggacaggtaccactgggtcaacacacaccgatgacgcagcgactgggcacgtggtgggcaagagctcagaggagtgcctttattctctctaaaataaaaatgaatttaaggttgagaggcccatgaaacaaaaaatgaccatattagggactagggtacacaatggtaaatcctctcatacagatcatcactgttcttagctgtacttttaattcttatttaattttacatgaagttttatgtaacatcagtgaatgtacccagtaaggtaacagaatgaagatgttgacctctaataagactcaatgaattatgaaaagtaatggtttaaataaacgtacagtgtttttaatacttcttagttcagtttgttgcaagaaacaaacttttaaaagtttattttttgtaaagaaggggtctccctatctttgtaaaggctggtcacaaactcctgagctcaagcaatcctcctgtctcggcctcccaaagtgttgggattcaggcgtgagccaccgtgcccggccaccattcattctttctcccctcaccctctaccacttgctagagggaaagttgatgactctgcagtccatgtctctacaaatttgatagcagtgagaattgttttggctgctacttttcaatgtttatggtatgaggaaatgcccattaggctgctgctggtgaattttatctttgttagattttatagattttaaaattaggaagggagattctacaatccagcttcactttattagccaaaaatagtttgactcttctaaattctgtgtctctagttgttagaaaattcccacaaccttgttgactggacccattcctactcatgctgtttgttctcagccaggtccttgctgttgtttggcagatcctgttaatctccacttaagccatttagtagctgtcttctcaatctctttttactccaccctcctgtgctctcagcaggggacttgttctttttgttttctcctacttcaaaactttatccctcccttctcctctctcatctccattttaaggctttgctcttctccagccgcttgtatcttctccctacatcttggttttcttgctgagtttctgctgttaggtgattctggatccaggaagctggtagcattggagcagtcacagcttggttctcttgtgagtagacttgtgctttgggccagtggctctgagtggatacaaaaagttgtgaccttgagtcccaacttgggtacgacatgccagcagtcatgctagtgctgatgaagggggagggagcttgattctagcctcattactttgggtgcagctcttagtaatcattttttcttttttttctagaaacgatggttcattagggcacatagcagcattattttgtgggacaaactcacctacccttaatggcatatgaggtcaagtttctctgctgaaaagtgagtttgtcctgtcttgaagagctttctactatagtgtgggagttgttgtgaacctccctagatttctctcaaggcaaccacaacactagtttactggcccctcagcaaaccatctcctggaggtggttgtgatgtttgccagcctccatacgtgtgtgggtgaattctggtctccagataatggggcagaaacaagactaccagcaatgggtgtaagtattaggctttaggatgctggcatgtatgtgaatgtactttagtttaatccttaaccatcaagttagaatttctggtaacatttcattttctctgcctccctaccttctgcccttgtgcaggcaattgtcattagttacctgattattgcaacagtctactaacaacagtaactgtttctcatcttgttccctatcctaaggtaatctttactctccagtttaaaatgtttcaatcaggaaattattcaaattctagaatatgacttctggtcttaatgacttgagttcttgcatatcttttcagcctaacctcgactcttttggactctgtttgtttgtttgtttgtttcctttgagacagagtctcactttgttgcccaggctggagtgcagtggcgagatcttggctcactgcaacctccgcctcccaggttcaagtgattctcgtgcctcagcctccagagtagctgggactacaagcgtgcgcccccatgcccgggtaatttttgtatttttagtacagacggcatttcaccatgttggccacgctggtctcaaactcctggcctcaagtaatctgcccaccttggcctcccaaagtgctgggattaccggggactctggtatttgagacttcttgattgggatacttctcaccttgcctcattgttctcccttccctcttgatctttgggtatcacttgagatgctacctcttccaggaagacttcctgatccccaagtccagtttacagtcatatgttaggggttccttacagcattctgtctgcccctagaagagcacttatctattataattgtttcatagttatcagtatcctcccaatagactgagttttcagagtacagatacctcatattcccatttaatgttggcatatagcagtgttcagatttatagactgaatgactttattggtgattaaatgcttgcctaatatataatctgatacacggcattaaataatgcttgttggttgatcattctctcagcagagtaagaagtattgtgttctaggctgggcatggagaactaatcgctgtaaaaatctgaagctgtttggtctttacatgtacaatttagtggactaaaaaaagaaaaatcaaccatatataatagttgctagataaaaaatgcaacataatatttggatatgacagaagactgagtgatttttcaagaacctttacacagagggttttattaatagtgtcccttgcagtttgcaaggttggtttaaaaacatttcttccagccagcagaggtgacactgtacccctgaaccccatgctgctgatggacactgctagtcaatcacagtgttctgatttgggttcagagattgcctcataattcttgtagcacagtacttgagatgaccattataattaattgttccaaattggtactcaggaagaaaccaattccacaatgtgctagggtttggctcagaggcagccatccatgagcatatgatccctgtgtaatcctttagagcctctcaggaggctctgagcaaatgtgtaggggaaaaaatataatcaactatatatttttattgtgataaaaagtagtcaatatacttgaaaagcccctaaatatattaatgtcatatctattagtctatttgtataataaccaaattagatcttcctaatctacattttgaaaattttctatgatgagtatgtaccacttatttttcttttcttttctttctttctttcttttttttttttttttgagatcaggtctcactctgtcacctaggttggagagcagtggtgcaatcatagctcactgcagccttgactccctggcttgagtcatcctcttgcctcagcctcctgagtagctgggactacaggcacctggctaatttttgatttttagtagagaacgaggtctcgctatgttgcccaggctggccttgaactcctgagctcaagggatcctcccgcttcggcttcccaaagtgcagggattacaggcatgagccaccatgcctggccttctctttttagaaaaatttttatcttgaggtaattataaattcacatgcagttgtaagaaataacatagattgcatgcattcttttacctagttttcccccttggtaacattttgcaaaactttagtacagtatcacaaccagatattgacattgctacagtcaagatacagaacacttccatcaccacaagaattcctcttgttgcccttctatagttgcacacacttcctccgactcccatccctttcttaaccccttggcaaccactaatcttccccctgttcttttaattttgtcatctcaaaaatgttataaattaatcatactgtaggtaaccttttggaattggctcttttcactaagcatagttctttggagattcatccaggttgctgcatgtattggtagtttattccttattgttgctgagcagtattccgtggtatggatacatcacagtttagccatttacctgtcaaagaacaaccgattgtttctggttattaggaataaaactgctacaaacatttgtgtagacaatgtgtgaacataggcatttattccagagaaataaaaacatatgagtgcaattaatgggtcatatagtagttgcatgcttagtttttaaagaaactgccattttatgttcccatcagcaatgtatgagtgattcagcttttccacacacttaccagtctttggtattgtcataattttttatttcagccattctgatgggtgtgtagggtatcttagtatggttttaatttacatgaccctcatggctagtgatgttgaacatcttgtgctcatttggcatctgaatatcttgtttgatgaaatatctgtgtaagtcttctggccattttctaattgagtgcgttgtttatttttccactgagttttgagaatatttgatatattctagacactggtgctttgtcagatgtgtggcctgaaactattttcttccagtttgtaccttgtattttaaaaagttctttatttttaattattatgggtacataatagttatatatgtggagtacatgtgatgttttgatagaggcacatgttgtgttataaatcatggtaattggggtattcatcacctcaagcgttgatcatttctttgtgttaggaacatctcaatttcactttcagttttttatttattttttttttatttttgagatggagttttgctctcgttgcccaggctggagtgcaatggcatgatctcagctccctgcaacctctaccttccagtatcaagcgattctcctgcctcagcctcccgagtagcacgtgcccgccaccacgcccagctaatttttttttttttttgtatttttagtagagatgggatttcaccatgttggccaggctggtctcaaactcctggcctcatgtgatccacccactttgacctcccaaagtgctgggattacaggcatgagccactgcacccggccactttcagttatttaaaaatgtacagtaacttatcgactatggtcatcctattgtattactaagtaccagatcttaattattctaactgtatttttgtacccactaacaatccccactcacccaacccctccctgctacccttcccggcttctggtaaccaaccattctactctatttccatgggttcaatttttttttttcactcccaagtgtgaatgagaacatataatatttgtctttctgtgcctggcttatttcacttaatgtcctctagttccatccatgttgttgcaaatgacaggattttattattttttatgaaggattttattcttcgtaaatgataggattttattcttttttatgaaggattttattctttttcatgattgaataatgttccattgtgtatatgtaccacattttctttatccattcatctgttgatggatacttaggttgattccatatgttagctgttgtcaatagggttgcaataaacatgggagtgcagatatctcttcgatatactgttttcctgtcttttggatatgtatctagcggtgggattgctggatcatatggtagttctatttgtagttttttgaggaacctccatactgttctccatagtggctgtaggagtttgcattcccaccaatggtgtatgagggttcccctttctacacatcctcaccagcaacagttattacttgtctttttgatgcaagccattttgatggggtgagatgatatctcattgtagttttaatttgtgtttctctgattagtgatgctgaatatttttttcacatacctgttggccatttgtcttttttttttttgagatggagtttcactcttgttgcccaggctggagtgcaatggcatgacctcagttcgccacaacgtctgcttctgggttcaagtgattctcctgcttcagcctcccgagtagctggaattacaggcatgcaccaccatgcctggctaattttgtatttttagtagagatggggtttttccgtgttggtcaagctggtcttgaactcccaacctcaggtgatctgcccacctcagcctcccaaagtgctgggattacagtcttgagccaccgtggccggccttgtttgttttcttttaagaaatctctattcagtaccttctgagccaaataaaaacaaagagaacaaaagaaatgcctgtttggattttttgtccaaaaaaattgaatttttttccctattgagttgtttgagcttcttatctattctagcagttaatacctgtcagatgggtagtttgtaaatatcttctcctattctgtgagttgtctcttcactttgttgattatttcctttgctgtgcaaagctttttagtgagatgtgatctcatttgtccatttttgtttcggttgcctgattttgaggtcttcccaagaaacctttgcccagaccaatgttctagaacatgttcccaatgttttcttctagtagtttcatagtttcagatcttatatttaagttcttaatccatctttactggatttctacatatggcaagagatagtggtctagtttcattctttcgtgtatggatatccagttttccccacactatttattgatgagactgtccctagtgtatattctttgcacctttgttgaaaatgagttgactataaatgcatggacttatttctgggttttctattctgttccgttggtcaatgtgtatgttcttatgccagtaccatgctgttttggttactatagctctgtagtataatttgaagtcaggttacataattccttcagttttgctcttttttgcttaggatggcattggctgttctgggtcatttgtgattccatatacattttagaatttttttttatttctgtgaagaatgtcattggtattttgatagggattgcattgaatctgtagactgctttgggtaccatggacattttaacactattgattcttccagtccatgaacatggaacgtctccattttttgtgtgctcttcaatttctttcattaatattttatagttttcattgtggacatcattcacttttttggttaagtttattcctaggtattttatttgtagctattgtaaatgggagtagcttcttggtttctttttcagattgtttactgttagcatatagaaatgatactgatttttgtatgttgatttttatatcctgcaactttactgaatttatttttcagtttcaatagatttttggtgtggagtctttaggtttttctaaatataagactatatcgtctgcaaggaatgataatttgacttctttctttccaatttggataccctttatttctttctctcatctagttgttctgggtagggcttccagcaccatgttgaataaaaatggtgaaagtgggcatcgttgtcttgttccagatcttagagaaaaggctttcagttttcccattcagtatgatcctagctgtgggtttgtcatatgtggctttatgattttgaggtatgttccttctatacccaatttgttgagtattttaaaaatgaagggatgttgaattttgagtgctttttcagcatcgatcaaaattatcatatgaccatttgacccaggaatttcattactgggtatatacccaaaggaatataaatcattctattataaagatacattcacgtgtatgtttattgcagcactattcacaatggcaaagacatggagccaacctaaatgcccatcaatgatagtctggataaagaaaatgtggtacatatgcaccatggaatactacacagccataaaaaggaaagatcatgttttttccagggacatggatagagctggaagccattatccttagcaaactaacacagaaacagaatgtcaagcactgcatgttctcactcataagttggagctgaacaatgagaacacgtggacacagggaggggaacaacatacactggggcctgtcagggaggaggcggggggagggagagcatcaggataaaatgctaatgcatggggggcttaatacctaggtaatgggttgataggtgcagcaaaccaccatggcacatgtttacctatataacaaacctgcacgtcctgcacatgtatcaccaaacttgaaataaaattaaatatttaaaaaaatcaattaaaagcatgtggttttgtctttgattctcttaatgtgatatatcacattattttttgcatatgtttaactatccttgcatccctgggatgaatcccacatgatcatgatcatgatgaatacttttttaatgtgctattgaattcagtttgctggtatttcactgaggatttttgcatctatattcatcagagatactggcctgtagttttcttttttctgttgtatctttgtctgggtttgatatccaagtaatactggcctcatagtatgggtttggaagtattaccttctgctcaattttttagcccaattttttagaatagtatgaatagtatgtatgtgtgtatttatttatttatttggagacagggtcttactctatcacctaggctggagtgcaggggtgtgatcttggtgtgatctgcaacctctgcctcccaggctcaagcaatcctcctgcctcagcttcctgggtgctatgactacaggtgcacaccaccgtgtctgattaatttttgagtttttgtagagatggggtttcaccatgttgcccaggctggttcttgaactcctgggctcaagtgatccacccaccttggccttccaaagtgctgggattacaggcatcatagttctttaaatgtttggtagaattcagcagtgaagcctttaggtcctgggcttttctttgatagaagcagtagtaaaaagctttctatctcattacttgttattggtctattcaggttttggatctcttcaggtttcaatcttgacaggttgtatgtctaagaatttatccatttcttctaggttttccaatttattgatgcatagttgtcctgtggtatcagttgtaatgcctcccttttcatctctggttttatttgtttggttcttctctcttttttcctttttagctactcctacaggaaagatcttttttcttaatctggctaaaggtttgtcaattttgtttatcttttcaaaaaaccaacttttcattttgttcttttgtatttttttaaagtctcaatttcattcacttctgctctgatctttcacttcttctactggtttttgagtttggtttgctcttgcttttctagttcttcaaggatgcattgttagattgtttatttgaagtttttcttattttttgacggaggcatttattgctataaactagcactcctagtactgcttttgctgtattccattggttttggaatgttgtatttcatttgtttcaatacatttttatattttcttaatttcttcattgacctcatggtcggttaggagcatattttaaaatttccatgtgtttgtacagtttccaaagtttcctttgttattgatttctagttttattccactgtggttggaaaaagtagttgatatgatttcattttttaaaaaatttttgagacttgttttgtggcctaacatatggtctgtccttgagaatgttccatatgctgaggagaagaatgggtattctgcagcagttggataaaatgttctgtaaatgtctgttaggtccttttggtgtgcagtacagattaagtccagtgtttctttgattttctattggggtcatctgtccaatactgaaagtggcgtgttgaaattcccagatattgtattgaggtccatctctctttggctccagtaatattttctttataaatccgggtgctccagtgttgggtacatatatatttataattgttatatgcttttgttgaattgacccccttatcattgtataatgacctcctttgtctcttttacagtttttgtcttgaaatctattttatctgataactgtagcttctcctgcttttttggtttccatttgcatagaatatctttttcagtctatgtgtgcctttataggtgatatgagtttcttgcaggcagcatgtagttgggtgttttaaaaactccattcagccactgtatgtcttttgattggagaattcagtccatttaaatttcagtgttgttattgataggtaagaacttactactgccattttgtttgttttctggttgttttgttggtcctctttccttcctgtctttctttgtgtaaaagtgattccctctgacagtatgtcttaatttcctttttttgtgtgtgtgtatctcttacaggtttttgctttgccattaccgtgaagcttgcaaatagcatttattaaccaatttaaaaatggtgacaatggtgacaactgtgattacaaagaaaagcaaagcaaagataaaattaaaacactacacttgaactccatctcctccctaccccctgctttcactttttgatctctttatttatctttttatactgtgtatctattaaaatgtagttgtaattatttttgatagatttgtcttttagtcttcctatgaaagatacaagtggtttatatgacactgttagtgcaactatactgttagagcaactacagtgttagtgtatttatttttctgtgtacttttacgagtaatttttatatcttcaaattacttctttttcattaacatccctttttttcagattgaatagctttctttagatttcttgtaaggtgggtctggtgttggtgaaatccctcagcttttgtttttctatgaaagtatttctccttcatgtttgaagaataattctgctagatatgatattctaggttagactttcttttttctttggcacttcgaatgtcattccactctcttggcctgtgagatttccatgaagatgtctgctgccagatataccagagatcctttctatgttatttgcttattttctcttactacttttaggattctttatccttgttctttaagggtttcattattgtataccttgagatagtcttatttaggttgaatctttttggtgtcctatgaccttcttgtacttggatattcatgtctccaggcttggaaatttctgtcatttctttgaatgaactttctaccctgatatttctctctgtctctctttgtctgtcctctttaagggtaataactcttagatttgctgttttgaggctattttctagatcttgtaggtgtgcttcttttttattcttttctcttctctgactgtctgttttcatgtagcctgactcaaactcactgattctttcttcagcttggtcaatttgctgttgattctgatgcatttttcagtttatcagttgaattttttagctccagaatttttgcttgatttaaaacaaattatttcaatctttttgttgaattttctgaaagaattctcaattccttctctgttatctttttatctatgttgctgagcttcctcaaggtggtgattctgattccctgtttgaaagatgatatcttcatcactgtgggattggtcactggtgtctaatttagtttatttagtgaagtcatgttttcttggatgttgttgatgcttgtggccactcatcaatgtttgggcattgaagaattaagtattccaatctttgtaatctggatttatttgtacctgcccttcttgagaaggctttccacatattaaaaggggattgagtgttgtgatctaagcttgtggtcactgcaggtgtatcagcactggggtgtaccctaagcacaggaatgctgcaatttctgctggctccttgaggaactgccttggtgggctgggttattttggttcttgcgaaggtgctttcttgcatgggtagttgttcaatttggtgttcctgtagggggatgcttgctagagggttctattaggccatcttgctcagacttctacgttgtgttttatcctcttaatgacgtctttcacagatcaaaatcttttaattttgatgaagtcgaattcattcatttttctcttatagatcatgatttggtgtcaagttttagagctttttgcctagctctagatcctgaagtttttttttttctaaagttttatgttttacatttagtttgccatctattttgagttaattttttgtatgagataccagacttagattaaagtgcttttttctcctctatgaatatccacttactccagcaccatttgttaaaatgaaaagactatctttcctccatcaaattgttcttgcatctttgtgaaaattcagttgagtatatcactgtgggtgtatttctgtgttctgtgttcttggcctgtgtgtttattcttctgccaacaccacacagttttgattactgtagctgtgtaaatcttgaaactggatagattcttcccactttattctttctaaaaattactttagctattccagtttctttccctttccatgtacattttggaatgatcttgtctatatctatgaaaaatcttgctgagattttgaaaggaattgtattcaccctatatatcaatctggagagaaaggatgtctctactatgttgagtatttcaatttatgaacacaatatgtttctccatttatttagatcaatttcttcgtgtgtgtgtgttatacaactcttgtacatgatttttagatttatatctaagaatttcattttttgatcaattataaatggtgttatatttttagtttcagtatccatatgttcattggtaatatatagaaatacaggtgatttttgtgtgttttccttttgtcctttctagatgttgctgaacttagttattccaggaattttttttatctctgtgtagattgcttgggattttctgtattgacaatcatgtcatctgcatagggatagttttatttatttctttcccaatatggatgcattttatttcttttttttgtgcttttcatgggtgtaacttttggctctatgttgaataggagtgctaagaacagatatccttgacttgttcctttttttgggagaaagcaatccttcaccattaagtagatactcatcaattttgtagatactaccttttaaaaaaatcaaattgaggaagttcccttctagtcccattttttgagggttttaatcataaatggatgttggattttgtgaaatgctttttctgcatccatttatataatcatataatttttcttctttagcctattgacatgtggattactatgatttttttaaaaaatatactgaaccagctttgcatccatgaaataaacccaacttgatcatggcatataattcattttatatattgctgaaatttatttgctaatatttcaagggtttttacatttatattcatgaaatatattggtctacagttctaattttttgtactatctttggttttgttatcagagtaatactataaatatatagtacaatatgtaatttattatatacatactgtaaacacttcataaagtagatcagaatgtaatgctcttctattttatagaagaaattgcatagagttgatgttaatcctatttttaaatgtttggtagaattatattatgaagctatctgggcctggagacttcttccttggaaatcaaaaaattataaattcaatttccttaatagttttaggattatttaaataatatgtgtcatattgggtgagttgtaatactttgtgtttcttaacaaattagcctattttatctctgaaatttatgcatgtggagttgtttatagtgtttccttattatccttttggtgtctgcaggtctgcagtggtatccctacattcattctttatattggtaatttgtgtcttcactttctttttaattgtcagagggtttaattctagagggttgtcaattttattgacctttccaaagaaatagctctttgctttactgtgtttttttctattgttttgtgtttagtttcatttatttttgctattacttcctttcttctgcttgctttgggtttattttactctttttctagatttttggggtagaagctaagattattgaattgacactttccctcttttctaatgtatatacttagtattataaatttgcctctcagcactgctttagctgtgtgttgtaaattttgatatgttgtattttctttgatattcatttcaatgtatcttttatttccctaagacttctttaaccattggattatttagaagtattttgtttagtttctaagtgtttggagatttaccggtttttgttatttatttctaatttggttctgttctggttggacaatacactctgcatgttttcaatttaaaaaaatttgttgaggtttgtttatgccccaggatatgatttttgatgcatatcctgtgggcacttgaaaagaatgtacatcctgttgttgttggggggaatgtcccataaatgttaattagataatgttgattgatggtgtcgagttcttttatatccttgctgattttctgtctagttctataaattgctgagaggaggtattgaagtctccaactataattgtgatttgtccgtttctctgtgtttcacatgtgttgcagttctgttgtgtatataagcatttaggactgctatgtattcttggtagattgaccctttcatcattatgtaatgttcctgtttctggtaatctactttgctgtgatgtcggctttatctgatattaatatagccattcctgctttcttttgattaatgtttgcatagtatctatttttgatctttttattttcaatatgcttattttattatattcgaggtgagtttcttgtagatggcatattgtgtcttatttttagttcactctaccaatttctgtctcttaactggtgtttctagactatttgcatttattgcaattataaatatgttaggcctcgagtttaccacttagtttttgttttctgttctttttcatttctcaattttctgttccttaccttcttgtgggttacttgaacactttttagaatttcattttggcatatctttagtgtttttgagcatatttctttgtatagcttttttagtggttgctctaggtattgcattatatgtatgtaacttgccacagtctaccagtgttattttataagttcaagtaaaatataaaaaccttacttccctttgtcttgttatcttcccccatttataatatacttgcattaaatatttcctctacatatatttagagctataatagaccatgttatagttttcacttcaactgttaaacataatttagaaactcaagagaaggaaagtctatcatatttatccataatttcacttcctgtgttcttccttcctgatgttacaagttctttcttttgtttcccttctatttagagaacttcatttagccattcttttaggtgagttatgcttgatatattcttagctcttttttaaaaatagagaacagggtctcactctgttgtccaggctcgtcttatactcctaggctcaaatgatcctcccaccttggcctccagaagtgttgggattacaggcatgagtcactgcacccggcttattcttagctttgattcatctgagaatgtattgtttctccttctcattcttaaagaatatttccctttgtatagaattttgggttgacagctcttttcattcagcattagaaaaatattgtgccacttcttcctggcttcctggtttctgatgagaaggttgctgtcattccagttgtttttcctctagtggtagggtgtcatttttctctggctgctttcaagattttttctttgctttttgttttcagaaatttaattatgatgtggtggtgtggatttctttgggttttcctgtttgggattcattcagctttttaaatctgtggggttatatctctttccaaatttggaagttttcagctattctctgagtattttttttcagcctacccctttcttttctctttctgagtctttgattacttgaatgctccatcttttgctatagtaccatatgcccctggtgctctatgcattcatttcctcagtctttttttctctttcattcagattaaataatttttgattgttctatctaaaaacattgatgatttttcctctatctcttccgttttactgttgagcctattcacgaagctttatattttagtttttacatttttcatttctaaaacgttcatttagttctgtcttcgatttttttgctgtgactttaccattcgttgctgagacttatctcatttgtttcaagcatgttcataatcgcttgttgaagcacttttctgatgctcctttaaaatctttgtcataattctaacatctttgtcatcttggtgttgtaatctgttgattaggttttctcctcactctttgtttatctttctggtttttagtgtgatgaatgatttttgccaaacctggatgcttttgataccatgagacttgggattttatttaaactttgtttcaactggtttcctttgaccctattccagtgggggagagaagggagtgctgctttgctacttcctagtggaagtaaaagtccgggtttccctcttggcctccattaatacccaagaaagggtctctcattactgctgggcaggtataggagttctagctccttatgtggcttccactaacactgaggccagggtggcctcattatcactggacaatggcataagccctaactctctacttgtcctcctctgattccactacagcagggaggtggtggtggtgatggcagctgcagggaggggagaggttattactgccaggtgtggggatgtctagactttctatgtggtttctactgataccatgaggtggaggagggtttgaactaccctgtggggatgaaaattcccagttctctgctcggtcgtctctgataccaacctagcaggaggctgggatgacttgatccatactggcaaagatggagctctagactccccattcaacttatgctggtgtgggtagggccagttttttcttgttgttttgttagtttataggatttattgttaaagttttcttttttgctgcgctgtccctttcctggtcctttcgctaaagagcaggcttttgtggtctcttttggttggttaccattggtatttatgggttgctggcttctttatttccaagtctggaatatacgatggggaaagaaaatctttagaactcacctccatatcttcccttggaatctgaggttccctagccagtctgccttcttctctacacctttcagagtcttatcttctttcttttatgtgtattgcccagggattttagttgttcttagtgggaggagtacagaaaaaacacctatcccatcttcctcaaagatagaattctatgtatcacttttgaaataataaatcttaagacaattgaatatatttttggaaaagggtcttttttgataatagttggtaaatatggcttctacatttattgaggttttcttatctgttttctagtcagtgggctgtgtgtgtgtgtacacaagcttgttccttacagataactagaatgtcgattttaaaaaagaacttgctattgatttgattcagcaataaaaacgcataatgcagcagtaaggagaacatgatccctgtcttgtaatctgtggcatttccattaaaaagcatgtgcttactaaaagcctgcagctgttagtgtattaatggaaataagacacagagcccaagaagtcagccaggaaattaataggatcatgtcctggtagatgccttgatcagccaagaatgaggaatatagaaaaaaggtctttaagttctgtactactttttctttgccacctctcccaggggccctggactcgtggcttaactatcctaaatagtcttgtgtgtctggcttaattaatcttcactctgctttctgggaaatacatttcataatttatgtgggtagctaaataaagttcttgaagacacatacccaatattaaatcaaactaagacttgccttcttcttaaaatactagagagtctttaatcttataaagttatgcattggtttgagggcgtgctctgtttaagaattccctgttaatggaataaatgggaggacagctccctcatagcccgtcttatgggcaatgactattttaccattttattagtatctgtgccatgaaagcacgatttcaatcaaaatggtaactaatgaggtatttttaaggctgtctaatttggtacttacctgatgactaatctaactatgtgagctgaattaagatgactaagtagccaattctaacaacaaaaaactcaaaatagaggagttagatgtagtgacttgattctgagcagatgttcctgatagcttgatttaaaaatccttgtttaacttaattgtaaatcttcttttcatgttatttcactgtttttattttattttcttgaaagtaatctaccattagtattttcatcagttggattgacagctaaatcctcagccatgtatggatgtctcttaattatgacaaaagacctacagagctaaaaatgttgaataccagatggacactgaattcataaattagtcatctttcattatctacccaaataatatttttaaaaagaaagctttaattctttagtagtctatcgtctatcttccttgcattgcttaggagacttgttaacaaatgttttattttgtgtgtgtgtgtgtgtgtgtgtgtgtgtatctattctggtacttctcttggtgcatgatatggtttggctgtgtccccacccaaatctcaccttgaattgtagtaatccctatgtgttaagagatccttccttggggtcgagtggaggtgattgaatcatggggggtggtttcccccatactgttcttgtggtggtgaataagtctcacaagatctgatggttttataaatgggagttccgctgcacaagctctcttgcctgctgccatgtaagatgtgactttgctcctcatttgccttcagccatggttgtgaggtctccccagccatgtgggactgtgagtcaattaaacctctttcctttataaattacccagtctgaagcatgtctttattagcagcatgagaacagataaatacagggcatgatacagaattatccatgtgagaagcagtttgaatttcaagcattggctttgtaatctgagcagcttttgagttgaagtttgtatctggattttttttaacctaaattcatgtgatggtgttgtatctcctgatcagcactccaaaacttcactttcagatgactgcttatctctttgtggtgtttcaaccagggcctccaaagtgaattttgtgtgacatggcctatattttaagtacacattctagatcaccaaatattatatatatatatccatctactttgtgattcagtaatagacaaccttagcctgattgaataatgacatatacaagttttacattcccagaaagttttagtcaatatctttaatacatattttaataagatacgtgatctaatgatcttttagtcacactgaaaattttagtcacagtgagcaggggtcctcaacctctgtggcaaatattagcccctattatatatacacttaaaactatgatacacatttatgtgatttaccatgaatattatagattttccaataattcttatcagcttcatcagatgttgtagtgatgtatttaagaccttttaataatgcagactgaaatgagattaccattttctttctagatctaaaaataaaatggaaaaaataaacattatatagttgttttataaagacagtccacaaaatgggggaaatagttgcagaataaataattcctacaaatcagcaagaaaaaaaataggcacaatctaatggaaaatgggcaaaagactggattaggcactttacaagagaaggtatctaaatggtatatcaacatgaaaaacactcagtttcattggtcatctgggaaatttaaaactacattgagataccacacaccagaaaaatgaaaacagtaaaaaagatgtaaaatactaagtgctgatagaaatggaaagcaaccagaaccttcactgttggcagtaaatagtttggaactctagttggtagtatctactaacactgaacatatccatgtcctaagacccaagatttctagtcctaagtatgtacctggctaaatatagttatgtatcatcaccagaaggtgtgcaaggctgttttgtaataatcccaaactggaaaatacccacatatgcatcaacagttgaatgagtaagtagtaatgtatctacacagtgggatagtttatagcaaagagaatgaacaaactacaactacctcccacaatgtgaatgaatctcagaaagtggagcaaaataagcaataaagtaactcatatcttatggttccatttatatgaagttcatgaataagcgaaaactattgatgatgtttgaagtcaggatggtggttactctatcttggaacatgtgactagaaggaggcataagctgcttctaaagaactggtgatgttctatttcttgatctggggctggttatatgggagtattcacattggacaactcgttgaggtataaatttattatctgttcacttttaaagctgttattttaataaaggtttaaaagttttcatcccagacactggcaataactttaaataaagtggattggggcccaggaggagtcagtgcctggttatttctctaggttgctagtttctgatcttgatcttgacatgataggtctctactgtgcatggggaagatgaagactttggggttctctctttgctaatattttccattgaccttacaaaatattagtgatgatttggaaccaaaacgtgtgatttttaaagatacaacattttaaatgcttaggattaaaaataaacttttgtaaaacagcagttggtatctttgtggtgtagtggaagaaaccctgaatgagaagacagtggacccatgttctagctactttttgttctcctccagcttgatgaatgggggcaagtctaatcctcagttccttctctctaggattaatatgttacctgcctaaagggaaagggataaactatgctttaaactacaacttttttactattttcatttttctggtgtgtggtatctcaatgtagttttaaatttccctgatgaccaatgctctatgctctcttggatcctttctgaaatataagatccaccctctgttgttgtgggagaagctcttaaaggaagtgatgccacttattcataccatcactcatttccaaccttttattctgtggacatgttcaattataaatatggtccaaacacaataataaataatagttggcatatagctaattgttatcttaatgctattgatcataagggtatctcaccttatcttcactcccaaattgatttcttggttttcttaggatttgttgttctgcagcgaggatgctttttaggaaatgttccatactggtgaagagcagaagatctttgtttttatgaatatactgtagagaatgtggaagacagagttaatactcttgttaccatttattttaagtgcccttggatcttgttagccagaatgtggacctgagagtactatgtacaattttgcttttaaattaaagcaatatctcttcatagggggtggttagcagaggactaacattccagctccacaactattgctatgtcttaggcaagtttggtgtttttttttttttcacttctaggcctcggtttcctcatccataagttaggaataagagtggcttccaccttataagagcatgagaagattaagtgagatgatgtatgtaaaactctcaatcataacatggcatgtagcacatggcaaggtaataaatgtttgctattatctgtcttatagttagctcaggtagattgtggtttcagtatattgcatcagggcccatataaatctacttgttcattaacacagtaaatacatctcaagcctactgtgagcctggcacatggcctacatcaggaaatgaaacaaatctctctgccctcatggagcttacattccagctgaggaaggaaagtaataacaagtgtaagtaaattatgtagtgtgttaggaaaggatataggaaaacttaagagaaagctgctgagtagggggaaaagagttgcaaattaagattggatagtcagggaaggcctcattgagaaggtgatatttgaaccaagataagaaggaggtaagggagtcaggggtagaccaggattggcactattttgggatgagtaactctttgctctgggagctgtcccatgcactgtaggctgtttagcagcatccctggcctctacccactagttgtcagtggcaaccccttctcctgagtcatgccaatcaaaaacatctccaggtattgccaaatatcccctgggggacaaaaattcctcctgggtgagaaacactgccctaggggaaagagtattccaggcacagggaaccctcgagagaagtgtccctagtgcttgaagaacagtgaggaggaaagtgtggttggagttgagtgaatgaggggaagggtagtaggtaagagagtgagatataaggcctcatgacaatattatttggcttttgctctgagtaaattggggagacacagcagattttgagcagatccaatttccattttgaaaggatcactttgctgtgttgcaagtaggctgaagagaaacaagggtggacttgaggaagccattagtaaggattatagtaatccgggcaagaggcaatggtggccttttcacaagggtggtattgtagttgatgagcagtggttggattctagatatgctttgaaagtagaacaacaggatttcctgatggattggttgtgggtgtgtgtaacagatgagtttcaagggatgctttggcctgaaaaacctgaagaacagtttctatcagttgagatgggggaaggttttgagtggagcaggtttggaaagaaattaaaaattgcgttttggacatgttgagtttgaaacagtcaggtggagatggccaataaacagttggaggtatgggttagagaattggggttgaagatagaaatttgagggtcattgacatatagatgagatttaaagctggaagactagaagagaccttcaagggcagaaaatatagactggagaaggggacgggactgagtcctggccctccaacattaagaggccggagaaaagagcagggatcagcaaagaagactgagaaggaacaatcagagaaggaggaaaaccagaggaggccagtgtcttgggagccaaatgaaaaaaatatgtcaaggaggagaatatggtcagatatgtcaaatgctgctgatggatgagcacagaaaatggactgttctctgtgatttgtgggaattggggtccaacagaattctgtggtctggattaccgacatcattatcaaacccacaaaataaatctgccttagtaactaatagagattcaatgatggagatatgtgtacgggacaattacttagcaggattcaggaaatctagaatctagtctcagatccaccactacaaatagctttataactttgggcaaattccttatcttctttttcaataatgtggctaaaagtatagacactacctactttgcaggattgctgggtggatcgagtgacactatatataaaagtggctttgaaaattatagtttgatataaatattgaaacatgatatgttcttgttcataagaatgaattaacctttagtgcaggatgatatttttcttatcatagacttaaattttatgatttttatttttaatagttaaaatgctgagatactttcaaaaaagtgttttattgtattttttgagataggatctcactctgttgcccaggctagagtgcagtggtgtgatcatagctcactgcagcctcagcttcaaactcctgggctcaatggatccttctgcctcagcctcctgaatagctgggactacaggtatgtgccaccatgcccggctaatttatttttattttatttttgtagagatggggtctcactgtgttgcccaggctggtctcaaactcctgggctcaagtgatctttctgcctcggcctcccaaagtgcagagattacaggtgtaaactactgcacctggcaaaagtgctttaacaagatattaagaatatcattatcaagcttgcacagaaaacagcacaccataagtttgggtaaacatgctgccacttgggcatctaaagttagtatgagtcacagttttacagatgggattctgcttaattattgataatacattagtgagacatgaagttagcccacatttgtactcctcatgactcagtcatgtaactactgtctgccctgtagaataggatttttattgtcatgaggccaggtgccatggttcatgcctgtaatcccagaactttgggaacactgaggcaggtggattgcttgagcccaagcattcaagaccagcctgggcaacctgacaaaaccctgtctctacaaaaaattatgaaaatttgccgggatggtggtgtgcacctgtttggaagggtgagatgggaggatcgcttaagctcagcaggtcaaggctgcagtcagctgtaatggcatcactgcactccagcctgggcagcggagcgagatcctgtctcaaaaacaaaacaaaaaatattgtcatatgtggcttgaggtcagaaatatctgaatacactgaggcatttactctgtgaagaagtccattttagtcaagaccatgtgatacacatgataaagttagttacctcttctagtgattctggctccaagggagatacatgcttcatttcaatgagtttagacagaagatccctttctctgtcagagatgggctgctcttccagcaggatagcacttatgctttggtcaagtttactgtccctggaaactgctgccattctcagtgtgatagggaatgcttccctgaaataggcctccaggcccttggtcaagggaagagaaggcaagggggacagatcagtagggcttctatacaattgctgttaaagctttaaaataatagttgaaagaaaaatggggcttgagagttctcatctttacttgccctcaccatgggttatcattgtctttagcagttctggtgcagtttatgtgtgaactgttaaacagccacagaaagctgagatgctgtgctcataggaaaaccacttctgtgaagcagtggtacgtgcattttgtcatatgctgccacgggaaatctgattaggaaaatcctcttcctggccaggcaggaggaaccaaaggccacaaggggactcaagtagatttgaaatgttgcaaagcctaaagcatttattctcctggggaacggggtctgagtcacagagaaagagaagcaaaatgccctgtacatgttataaataccttgtaaaatgaccccagaaaggcagggctggagtcctggtggggttccccagcagtgatgtgggccaggcagcggatcagcagcagaacaaagcttcccacagaggccaaacattctctcccaatgaacagtgtgttttcagcactgtgagaggagaaaacacccaaacacagagatgtccgcccctgggaacattcccaccgcccgtttctttctcagggtttatggcacatggtctaaaacaatactctctggccctaatggaaatttgctgaagggaagattcagatgaccggggaaaaattgtttgagttcaactctctgaataagtcatttgctccactgtctcccaagttttcctactgcctccatcttacagaaaacaaacttagaaattcagagttacttgtgtatctcttttgtcaatatcctccaatcactgtttccttaagcagtggttttcaaacttttgtgtaataagaatcacaagggggtgattctgttctcgagacccatccccaaattcctggatctgtggggtctatgtgcttccatttttcccaggttccccaagtggttggttcaggaggtctaaggatcacagtttgagaatcactgccttagagggctctcaaggctttcttcatcttccatgcctttattgtaatcaagttttcaaatcgcctctcttgcctgttgatttgaagtaactctcttgttcattctcttaagagacagtaggttggcatgaaaaaacttcaggtagtttggaatcagacaatctgagatctatcctttgactcagctgtgagtggcagctgcatagactcatggttatgagtttttggtgtcaaacacacctgggctcgagttttaactcttgctaactctgtgatcttggggaagttacttagcctctctgggcttcaatttcctaatttctaaaacaaagataacaaaagtaccccatagtgttgtgagtcgtaaatgagaccatgcctgtaaggcacctggctgagttcctggcacacggcacttgcaccacaacctgagttcgtttacccatccataaaatgggattaaattctcgtctatttcatcgagttgctttgaggatcaagtgaaatgtgtggagagtaccatatgtgagtagtttctggttttattaaaccccccaacaacctactagtcaagtataaacctttttctaaccctccagtatcgatgagcagtttctcctctcagaattgtttagcaatagactgtcatcagtgtttaaggcagttaccagcaaggcacttccaatctacatatctgaagaactgccaggacaggaacaatttagatccttttctgtagaaagatgctgattgtccaggattttctgaagctggaaccatgactcttataggaaataccagcctggaacctctggctttgataatgacagagatctattaaagggcaccaagctattatgcttctctgggcacaagccagaacatattcattttactgattagagaaagctcttacactgtgacatttattatgccttagctaaatgacttatttccaggagggaataaaatatgtcaggattttaggaaaaaattataaaatttgttctttttgctttcatttatctatactggaccccagaattttataacccacatctgggaatgaatttgcagcacctggtagaagaaggcaccttggaaggcactgccttgggcttccatggcaggaagatgagaagaaatcttcagggtgatttctggagcctgaaaagaataaaaaacaaaaccaaacctatccttttgctaaaaaattctcatgcatctcagctacgtggcatcagccaaattgatgagaagtaaatgcattggggcattaatttaaattgcaacagggtaagtaggcttagtatacaggaaaatggaaagagtaactgcatatttaatatttatgctaaatatgacaatcaatttactacttttctaaatagaacttgactagactagagagatttgagccatgatgcctagattttaaccttggctctgcctttttggctgtgtgatcttgggtaagtttatgtaaccactgtgtctcttctgctcaattttaaaataggaaaaataatagtatctgtctcatagggttttttgaggattacatgagttaattaatggaagttattagaatattttctggcatgtagaaagtgactaattcattctacctgtgattaatatcattcgagagattagactttggattggtaaaataactcccataaatccccttaaaggagagactagaaagtttgctgttccaggtgcttaatcctagggaatatctgccatctcaaaggcttcttcctggctaccctgaccttctaggctccatgagtaactgctccatagagaggccagaaacaagacttacatgaagctgggggataaggaggtgcaggatggagaggccatactggtaaaccacaaactccctggcagaaaggtcagtgggttgcacagttatcaactcttccttctgcagtgtctgaggttttagaagatcctgcagagagctctttgggtctacagagatcaggagaaaccagtaataatttcactaacttttctgtacaataatgatatgttaacaacacaactcaatttaggaaaaggtttattgcaaccatctatcatccatccatccatccatccacccacccatccatcctcctgtgctatatatgcatcatgctacatggtcttctgtccacctttatggaaaaaatgattttcagtcaataggaacagaggggctaggacagaatgagggtccacagaagatggcaacagattttcttcttctatttccttgagttgcttggagcattaaatgtaatatactcagaacagtgtctagtacatagaaagcattcagcaaatgttaaatatatttaagaatcttacttccctacaatatctgtacggaatgtctgtaatggccttgagtatttaaaatttctatttttttaattgtttttgagagaacaataaagaatggattggtagcaaagtttagggaagactgctgaagtagcagtcagaagacctgtgttctggcccaggttctataagaccccaagaaagtcactgaacttctttgagcatcagttctcatctattaaaaagtaattaataaccttctactatcttctagaactagaagatataaacaagataatgtatataaaattactctcaaaattacaaggccagtataatggcaagacgaaggttgaagtggggctgggaacccttaaaggagagctcatttctctgccattcccttcctagtttcacccaaagaaaggaggaattaataatgagattggtcaagttctctggagtcagtaaactttttttttctggaaagggccagatagtaagtattttaggctttgttagccaaaagccaaaattagggttcaaagttagtgttccctttcctcacggtagaagcatggcctcattctcctacaaagccttctcttgcttctctggtccagaaaagcaagtgatctgccctcctgggaactcaccaaaatgtgttacctgcatcttcttttggcactgccttcatagtgttgaacaacttttcatttgaggaagcacgtgaggagcacagggtctggggaaagactcttggggattgaattccagctgaactactcactagcaatatgatctttgaatactttcttgacctatccaggagcttcagttccctcatctata

SEQ ID NO: 16400 - DNA, 31444 bp, Human
ttttctgccactgtacaagatctgatttgtcagagtagctctgggtctcaccttttccttccctctttccagaggacagaaatttattccgggggatatagcttctgttgatctgcttcaggttttaataataatgatcctatattactactaacaaacatggctgacacttggcatttactgctttcaacttaataaatatcttttattttaatgatttagagctctggctctagtcagatgaacttgggtctggcaccagcctataacctgatagcttggtgacattggacagatgaaattccctaagcatttgtttgtttctctgaacaatacaggtagacgtttccttgcagcgttgttgtggtgactagattaggtaatgtatttaaggcttaacatggagcctcttgcacagtaagtggttatattattactttgtggaaatcatcatgctaggcctgtggggagaaactgagatgaataagaaaaagttctgaatttcacggacttggagagaataagacatgaccaaaagagacaaaagacagacccgtgggagagaggaccagcgaggccacatatcctcctacgaacctgtgagacactcacagaactggttcttcattttatagatgaggaaactgaggctagaagagttatgtgacttgttgaaggggacacagtgagtgagtgtcagagccttcatgggaacccacgtctcctgtgactgaggcaggcctgagggatgtgcctctgtttctcatggaaactccttggcgcagcccaaggccttgagatgctgccccctgccaggccagggtgtgggctgccagccaccacagcatgggggcctccactgtcctgaacttcagaggctttgcggggagggcttataggcagccaggagacagccttctctggcttttaagtgaatcattgataaaatgttgacagcatttctcctcaagacctgccctcaaatcagcaaccgattagagacagtaattcataactttatcagatgaatttttattgggggtcactatgctccaggtcttgtgtggggcactggagaggcaaagatgaaacctccttgagaaactgtcagagtcatgtgacaattcaccatcacataatgaacaaagtgctctaagatctgagaagacgaacaagtattctctgggctgggggtttgtccttccggcaagagaggacggcaaggtcaaaggcagggaattgcatgggtgtttggtggtgcttagagggcactgggaccagtggtaggagggcagttggtggtgaggctggaaaggaaggcaacggctcgattgtgggaggccttctaggcctccagctctgtggctgaagggagaaggtgaatgctttgtaggctaggggatagcatgatcaggtctaggtggtgcaagatggctctgaggcagtatggacggcagagcagcaaggccccacacctgctctagggggtgtgccaaggggtcttgaccccaaactgactgagtccctggagcctgagcatgtggacctcagatatgcagtggcagaaggcttccaaactgtgaaggaaccggtagccaacaccatctacacttccagatggtgagcccatgacttacttaaagaagcttcctgttatcagtgggtgggcactcgcaaagaggctctgttcatcttgtgcctacaagcccagatccagtcaaagagcacgggcatgttctccttccttccttgagggttggcctctttctccgtgggcatagccgacatcagagccagcgcccccatatttcagcatgattaagccttgccattttgggggtggctgggggcgaggggaggggctactgtgtttcaaaatggaataaacagaaaagcaatattaaaagaatgaggaggttgtttactgaggcttgaagagatgacaggtgtttcctcccagttgagaaccagtgacccctgggaatcgcatttcccgctgagcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggccgtggctgcccgcgctgcgctgttgctctgtcccagctggctagctccgagtgtggagcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacgtaagtggtttggctgtggctgtcagacccaagcgagtgccagcggggcagggcgatcacagcttggcctggaattggggagctggtggtggaggtgatggcgccacggggggagggggtctgggttccaagccccggagcagggagcggggaggtgggcgggatggagcctggtggagaaaccagcctgtcagaggtgatgctgattttccaggctggaggggaacgaactagtgttccaaggtgggacggctcagggtacctccgcttctgtgtatgaatcactgtggtgaagaaagggcagtttatgattcacacaacaaaagccagatgtgggatgggtttggggttgggagggaaaagccatgcagttctttacaggaggggctttatttccataagcagtggctcttcagccttctgttgaataccctgggcctgtttctagctgagtgacttagctttctgccagggtgtgacttgttcctgtggataccctgggaggagtggagatctggcttggtgaagcgtgtcctcacttgctccactgtcttgcctttcgtcattctttttccccttctgtgacaaggcttgtccatcccactgcaaaggatgcagtgggtttatctttggccttgatttttatccccggagttggatggaacaattgtgaactttattttcctttatgtggaccaaacagcgacttaccttactaataactgaaataatacagattatttacaacattcttttcacgaggtaaacagcgtcaactcatcagcttctgagagttgaaccttattggggctagttctatacttcctcaagcaagaagaatgaccaaaaattgctctgtctttctcttaaagattcttggttccttaaaattccttttaattaatttaagtatgctgtgcctcaagcaagcttaatataagagaatctagatttacagaagaagatatattagggaatgtttttattttatggaaagatacttgattggatccactaaagttcggaaaatataacttcattgattaaaatgtgacactgtcatcaccaatttattgtttgctttatgtcttatgtaaatttctctggaattaagctgattaaccagtaacacagaagagtgatttcaaaatttctcaggttgtgaagacccaccattgtttgatatcaaaaggtcaattttttaaaaaaataaagagaaatgagctttaatttgggtttgagagttacggactccttccaagataactaggaatattcaagaattgttggcacgccactcttcccaacaggcgatggagcagcggcagcctatcctttctgggacaatggcagctgaccctgttgtgagtgctctgtggatgagagcaggtgggcattcatctttttactgggggcccctaagcatctgtgtgccctttcactcagggctgaatcatttgatttttgtgtgagcccctggaaggagttttgcctcagctcctaccttctatgagcaagccactttcctttttctcaatccttaggttttttgtatgttaagtgggggtaaaaatcatatccacactgaggatctatccttagtaagtgaggtgccaccgaagtcatgttcattgctctgtctgcatcagcctctgagatatgagttgcttccctgcattcaccatctgccatattctcccctcttggttctgtagtacattttttcatttctaattccttctaagagatgaacagactttttttgtttgtttgtttgttttttgagacagagtgttgctctgttgcccaggctggagtgcagtggcgcgatctcggctcactgcaacctctgcctcctgggttcaagtgattctctcgcctcaccctccctagtagctgggactacaggtgcccgccaccacacccagctgttttttttttttgtatttttagtagagatggtgttttactatgttgttcagcctggtctcgaactcctggactcaagtgatccacccgctttgacctcccaaacaggtgtgagtcactgcacctgtcccccaaattttttaaaggggatgctggagggcatgcttcctgctcacaccctggagaccagtcagatagatcaaaactccattgtaagggagaccacattgtaagctcatcaatggaataactggggtgaatgtttccacatgttcagatgaacacaaatcaaaattatcttgaattgtcctttaagccttaaaggaaaagtaggagagaccctgggctctggacccacccccttagcctgaacccaagtatgtggtatagagggcacctgggtgactaaaccgtgtgggaaaatcagtaaaaacagggcagcatgtcagcccacttagagtcacccgatggaagggcagggtttgaaatcagacaccaagagtgctgaaagggcactttcttttttcagaaaacaccctcgaggcatgagctgaaatgactgtactatggggttctggaaagggttaagaaaacattcactttgtgaatgttacctcctccctacctagcccatgaccctagtttgtggactaaatgtgaaccctggcttttggttaagattagagcataaagtgacaaagcccagaactgctggcacagagaagtagaaatcttcaagccccaaccaatggatttgagatttgcttgatgggccaattggatgaagaagtcactccatctgtagattctctccctgggttctggacttggacctgctggtcaggtgcacatgtgaagaattaccatccctccccagctagtaacagtgtagtggaaatagcaggaaccttggagggagacaggtctgaaagttgcctgtgcaacttagttctttctttgtgagaaggaaatttccattcatttccttatctgggaagtggggattctaatgtctgcctcccaaggtttttgtgagaattaaagtagagaatgtaggtaaaatgatagcaagtttcctgataagtagtggtaggggtgagttagtaccttccgtcctggaaacctcctgtgggcccatcttgaatgatcagtgttatgttaaattcatatattcttttccacactttgattagaatagttaaaaagccacagtctaaatattcttgggtgataggatattgcaaaattttccaagggtctaaaatagtggtctgcaaactatggcctctgtgccaaatcaggcctgccactccatttgtaaataaagttttattggaacacagctatgtctatcatttgaatattgtctagggctgcttttgcagagttgagtagttgtgacagagactgtgcagcatacaaagcctaaaatattttctctctggcttataatagaaaaacattgccaacctctggtctgagatgatttgcttggttcttcaggcattcatttccttaagatactcagtatcaggccgggtgcggtggcgggcgcctgtaatcccagcactttgggaggccaaggcgggcagatcacgaggtcaggagatcgagaccatcctggctaacatggtgaaaccccgtctctactaaaaatacaaaaaaattagctggggttgtggtggcaggcccctgtagtcccagctactcgggaggctgaggcaggagaatggcatgaacctgggaggcggagcttacagtgagccgagatcgtgccactgcactccagcctggggtacagagcgagactccgcctcaaaaaaaaaaaaaaaaaaaaaaaaaaagatactcagtatcctggggttgtacattgccaacaccaatgggaaataaaacttgcagccaattcattaaataatttgtacaatgccccaaactgatttgattgaatttcttccttaaaagtgatagaactgtgtataataaactgaactccatttgttagaaagtgaacaaattggacagttgctttttattgttgttgtttgtattagggaacaatctacatgctaatgaaaggcaggcttgactgattttctttggactggctgattgtcttggtgtcctgtggacttggccttggaacaggaaataattcgtatcagattattatgtcatggatatgcctttgctttcagacaacttgaacagagcagagatttagcaaacagaaaaattaaggacttaaaattctcatcaacatagaactctgctcttcagatgtactctagggttccactaaagagccaatattgtttgggaggcagttaaagataagtaaaatgtgtactatgcatataatttttggaagcctatctcctacataaatttaagcacaacttacaatgagaggtaatttaggtttctggacaacctctaatatttctattctatgttacaacctttgcttatttaataagcctagtgagcacctttacttcttaccaagttgattccattgattcagcagttctttttttgagatagagtcttgctctgtcacccaggctgcaatgtagtggtgcaagatcagctcactgcaacctctgcctccaacttcaagtgattctcctgcctcagcctcctgtgtagctgagattataggcacatgccacaatgcccagctaattttgcattttcattggagatggagtttcactatgttggccaggctggtctcgaactcctgacctcgagtgatccacctgccttgacctcccaaagtgctgggattacaggtgtgaaccaccacgcctggccaattaagcagttcttgctgttaagggcaagtagaatccaaaagagagacacaaattcacgtgcaccgtctggaggtgaaataaaggacaaacatcaaccaaatacacagatttaattggtaaaagagcagatgatgttcttgatggatattttacttcctgccccttatatttatttactaaagaaaatgccagatttgtccccaaagttactgactcagaagttttgaaagctctctcccaattcacacttgggattctgttctttcatgaggaaccaaaaaaaaaaaaaaaaaaaaaaaatcaagttttcctacagctgttcattaaatatgtggacatttaattcataaagaagtcttataaatatttgcttttaactttcccactacaaagtgttttttccccctttgacatctttctaaagtagtttatcttcccacttaatgaagatgtccacctatttcttattctgagccaaccaaaccaaagttggctaattgattatgaatattaacataattctcacctttatgaaatgcttaataacactctagttttctcatttttgtagaactgcttgacaactaagtgagcctacctgggatggggaggccttctctgaaaccctcttgtcccgcttgtgtgatactggggacaaagcacttgtaggcaggagccaggggttttactttccattctacagataattagatgagagaccttaagcaagccacctaaccactttgggtctcaaatgttctagtgctggaatggaacttgccttttcctggctaattttcctggagattgaacttgattgaggttctttgccagctctaattgctgagttttcctgagtgtttatacaaaaaataaattaaagtttaaaatcagaagtccttaatttaatagatgggattcttctatctgcttagggcagtgtttttataccttggctacacactggaatgctctgaggagatttaagaaacacagatgcctggatctcaacctagagcttctgattaaattgtcttgggcattgaaggagagctgcaaatggctcccaggtgagaaggctgagaactgctgacctggaggttgaaatggatggcttctaataaacctttgggcattgctaagagcagaagaatgctcaatccttttaacagtgataaacaaacatctctggggaatggagaacttatttggtgctatgcagtatacaaaatgttctgttggatcagtttggattacatttgattgctggtgaagagacctgaaataacgtagatttaagtaagacagtggtgtcctttctctcacataaaagaagtccacagtagggtgttcaggatcttatggagtctcacagtgccaacatcatcccaggctcctttttcctttctaatctgccatccttggcatgtggctcttgtcctcaagatttttttcatagttgccattgtaactccagccattacatctgtgagcatcacatcttcggacaagcaagaagaagaaaaaggaatagcaaaagatcatgcctcctgatcgctgccccttctccctcccaacacacaacttctgctgacatctgatgccatttctatctacaagggagaatagcataattgtttagctgggcacattgccaccctccataatgcaggggctgttagaaaggaagggaaggtggatgttgagtgtaacaactgccagtcttcactatgctttgagtgcattatctcatttaatcctcataaaaactccatgaagcagattctgttgtaaggttcattttatagatgaggaaactgaatcatgaagattaagttagtaactctcctacaaagcaaaattcatgtgaacagacctcaagtgttggcctgctaagctgtcctgtctccctgccacagtgcctgtctctctcacattgcttaggaagtattcttggtaaaagcacaggccttccatgtcagataagggaccaatggcaaaaaaagccctgcagatggtagttcataccatgagaaccccttttgtttaacatttacttcagcttacctgttgaagaaaacaaggtctctgcttgctgctgggcctcttctgcgggacagtttgaagatattttagctataataaaaggctcagagaaggatctagagtttgcccccaaataacccagccctactcttttctgggcagttttagtagagagcccgatgtagcaggcagcctttgctgggagccaaggcttctgcctccgtggcacttccttgattctgaactttctagactttggaaaagtcaggctgctccttcctctctctctctctctctctctctctctctctctctctctctgtgtgtgtgtgtgtgtgtgtatttgtgtgtgtttaggtggggtgtggagagtaagatgtagagagtagggtttaactttgagttagagagtgacacttctgttctttctttgcctttagtagttaaagcttagcttctggggcaggcagatctgagtttgagtcctaggtttatgccttactggttgtgtgacactggtaagtcctttttcctccttctgccaccatttctttataggcatgcaccagaggtgtgactcttaccttatgggattgtggtaggggttttctgctgtgcttggcattaagtaaacactcaataaatattagttgctattattattttcccattctgtcacaatctacctctgaagacaaaggttatgccggctaattttagattacaatttgtatgtcctctgagttctgaatttcttgtgaaatggcagggcacacatctccagtcttgtaacttgtggtgggttagtgatcatggttacttctgatgattaatctgaccattctgtgatcaaacttggaactcgcgtcacaattttcctaccgaccttgtaaggtagggtggcggcaagacttgtactgactggcaaactcgtgtttgtttttttaattcacaagattggactgagtgtttgtaatctagttgtgagcagaatgacacttgaaatatgcaagaaatagataccgaaaactgaaacaacaatgtgtggcctccttttcttagtaacagtttcattagtaccactttctgggaagagctggtcaccaaaagattataaaccagaatcattctcagaccaggtgctgggacaaaaaaggatttgaccagtcttaaactgaattactttttaatgcactagaaagagccatacatttcattggaagacagcaagcatacaggacattgttaaaactttccaggactaggaaatgctgaggtgacagaaaggaaagaaaagaagagaggcaagagagttgacaatagaagcaagtcttaatgttggatgaaaggtacaccaattcaggaaggaaaggtatagaaggaaaatcaaccatctattcatcatcccatgcaggtatgcatccctctaagcatccatccaataatggaattatttccagctagagaaaccaaccaatgaaataaattatcttcagcagaaggtggggatgatggaatcagggaaggtgtcatggaacatatagcattgggtttggatcctgaagaatagatggtaatcagacttcttgcttagatcctggggtgtgcagatgcatcttaggacataaaatattagcactgggaagaaaatccaaggattttaggctgatgtctataacatttttgctacaaactcccttattcaaaccaaatctactgtagaacttcagtataagaataaaaatcgtgcggttttggggggctatctggagctctgattgctcatgttcccccacatttccctgccattctcactctgttggcacctgcaggcaccataactatattccagggttcttcaggtcacagctggatccccctgacctggccaatctacccctctttttagcaagatccctgctagctggtcacagagagtggcagtgagtggctgtgaaacatattgcattggtcttcatcaagctctgaagctgtgaagactatgtgttcggtctttgtgggtctcttgtgaataaagagggggtaaattcctaaaaaactgaccaagtgacttctttctcaggcttgatactaacaaccactccccttctccaatgtctttcataaaggaatcccttgcatcatgagggccattggttagcaaagctgaacattatccagaaagctcctcttgaccagctgtgatgtttctcatgaatccattgttagggctactctcacttgcgaaggctacaccccaggccaccatgagccttggaacttgggcagttgggtctgaccccaaatacaaaactaatgctgggatctgaagagtccattctccaagaaagtggtccttacatgatggtctcaggaaaagttaagttttttcaataaagctctttagtcttgaaaagccaaaattagatattgcttgaatcaaggaacaaaaaatcggatatccatctgcctcctccagctgcctaactacaggttattcccatcctagctcagatgggcaattctagattcaagccttgatctaataaggaaagagacagccctttcctctgctccatccctcactatggtactgccttgctatagaattggggtggccactggggtaggtggactctcctcattcaccttctggtctgggacggtaggtctggagctctgtttaggccctttctctttcctgatgccccactctcagcaaatttgaggcaatgccaaatatgtaatccaggaatctgctttgctctacaaggtgataaaactcccatctatgggcactgaagagccctcccttgcccattgccacatttctattccatatgcgatatgtgctcctaggtttctagcccccttgagggagtatctacaacatagcctcagccatggctgtgtccctggcctttaggagatacatataggttccttaaggggctgcatctgaggtcaggacaagggaatgccatcatactctgtctgcaacctaatcgctgccattcaaaaatatccaaggtttttcatttctgaagtcatactttaaaaactcacatctgctgcaaacctaatcctctggtgacttctaaagaaagaagtcttctgctcagctcatcgtatctttataaaaggccatttccagggtttggcgtctcctgtctaggattgctgtacgaaagcgaagtcttttaccagcccctctgcagcatcattggcttccctgtctcctaagtaggggtatcttgctgcctggggattccaggtacctgagggattaattccaggagcataatgaaggcaggtagagacaggcctggcaggcaacagaaggccctgggtatgctgaagacagagacattcagtatcaggatgtagctgaatggaggcaagttagggtcactgtaccaaggctacttctccgatgacagatgggccatggattgttggctgagatcaaggagaaagggctatttgttgggagctcattatgcaccaggtgtttcattgtgttaatctcatacagttctcatgattaccctttgagatggatattattactttcattttgcagatggggaaactgaggcacacaatggttaagtgatttgccaagagtcacacaggtgataagcaacataacaggctttctaaactaggtctagtcccaaactgtaccacactgcttctcaatgacaaggattttagtgttgcactgggtgcttcttcctctcccaattgaagagggccctcgcttagatggaggcaggttatgacttcatcaagggtagctctagcctggcacaaaagcctctgcagatttggatcttagcaagtcacgctcgagactcagtatggaagctctgaaacctactgatttccatcttagaatctgagttccctggactcctcttctcttggtgggccgatcagccaagataggataggaccagctagtgacacacccttaggattcactcaggacctgccacttagagtgtctgggacaagggtctgctcatggtgaggcctgagtctctggccccagaccagcccctctgcactggagatccaacagtcatatctcttgcactcacctctatacagtctctacagacttggggccccagtttgctgcttgttcaagccttactaaaccaggtgtaggtggaaaccaaccaaacaaaccagaaccacttcagttctgaggcagatgcagctctgtcacagtttgtaattctaaatttgtttgtgcaattatttgattaaagtctgtgtaccccactagactagactgtaagctccaagagggcaagaacctcatctgttctgctcagcaagtacttgttcagtgaatgctctgccaggggtctcttggtcttgtcccctaccctgggacacagtgtatctgcgaaccctttctgctccggtgaccccagtttctgtaaaaggcaggcagatgcagctgctttctcaggtggacctgtccgctgtcatttcagtcgaaaaataccaaaaataaaaccttgcggggaattgtttgggtctctcagttctcgtcactcctcatgtgagaaggctgctgacaaggttctcgtggacagatctctcctctcttggctgggcaacaccatttcttggggaaactggcaattgagggagactggatcagggtagtccaagcccagactttaactggagcaaggagggttaggatggggccaggaatcatttgatgattaactgcagtgtcgctcagagaaaaaaatgggacttgcccgggcagagacaaggcaggcagtgaggcagaagtggagtgtccttggaatcacaggtcctgggcttggttgaggacactgttacttacaagtatagtcgtttggcaagtcactgaatatctctgagcatcaatttccttctcggtaaaggaagggagcggaagaggaatacgttgtactgagcctctatctgcaatcattagtgtcaaaatctctatggaacatcatgcaaataggagtgtggtgatttcagagctcccaagagttaagaatgtgaccaggaaacacatggacctttaccacccattcattcaacagacctgagtccctgggagcagagaatgggtacaaacagccttctgtgcttgacctgatctgcaggaggctcagaggaagggaggtgtggtgtggaaggtgcggagagcgccggggaaaggatccctgggagtcttgcctgtgagggaagggttagagggccactgccacgtggaaacctctcgcactcaaggcctttggctgcccctacctgcggttgtggggcgggacacccagaagtttagggacaatccaagtaatcctgaggccttagggtgtaaatgctcaggtctgagcttggtggagaagggtggtcttctgtgggtcagtgggatcttgacttcagcctaatacaacctagagggatccctgtgactgccctgggggtccatttcctgttggctatgacctctgttaagtaggaatcacttggcccctagaccacttttgtctggggctctgtggctctaagactgaaaaaccctctgctgtcacctccaacatactttaagagtgtcccctgggtctcgttgtcagggctcttctttctaggtcctggtggcttgcctaggtctggggaaattctcagtgaccgtggaccctggttcagcctttcccaggggacctgcctatggttgatgagtgagatcttcagggctgatgggaaggaatagtcttttagaatgaggacacagggagggcacatgtcactgtccctttatcttctccacccagaccagagaacgtgaggtcagccaccatctttgtgatctgatacagacatcccagcctaccaagcaagatattacaacttattcttcagctgtccagcagccttgcaggcaacatcaaattgtacatcaatcatggttcccctttctctcatgtcttccaaccacctttaacgtcagttttctccccctgctgtctttttctcctctgtcctgggtatcatccagattgcaggatatatgagtgatgtgtttataattcctggctgcagggtcctctcagttcaaatgttagtgaatggaaagtctgcgtttacatgcatatgggatttctttgttggcctacattaaacaccaacaacaaaggtcaactaaaatatagtgtaaatgagcgggaaagcctttctgtagtgtgtcaagtccaacctttggccaaaacccaacttctttcttcctgtttggaaaaaaaatcagccattgtccatgaatggaaagaacaaatttgaaaactttgactcagaccgtaactgtaagaaaagcacccacattagtgttccagttaaagatgtgaataatcctttagccaactggagttaatgttctctagaagtccttgggccacaagtacaaacaaaattctttgcatgaaaatgtaaacaaattttttttttttttttttgagatggagtttcgctcctgtcgcccaggctggagtgcaatggtgcgatcttggctcactgcaacctctgcctcctgggttcaggtgattctcctgcctcagcctcctgagtagctgagattacaggctcctgccaccgcacccagctaattcttctatgaaaatgtaaagaattctttatacgaaagtgaaaggtgacaacgactattgtgacttcattttcagttagaagccagggcaagtttgttggccatagtcttgaattcctattgtttgattagttttgctacaaataaagagaaaatcgtatttcttctcagtggggttttttttccttgaagattcaacagcagaagatatttccattgattacttagagtgatcaacagtgtgtcactattaacggtgtgtcacatgtccttctgggctaggggcttttatcttgcaaaatggccttgtacggctacaaggtttacctgttgtttaggtaagttcctaaaaaattgaccaagtgacttctttctcaggcttgatactaacaaccactccctttctccaatgtccttcataaaggaatcccttgcatcatgagggccatttgttagcaaagctgagcattatccagaaagctcctcttgaccggccgtgatgtctctcatgaatccattgttagggctaccctcactcacataggctgcaccccaggccaccatgagccttggaacttgggcagttgggtctgaccccaaatacaaaactaatgctggggtctgaagagtccatcctccaagaaagtggtccttacatgatggtctcaggaaaagttatgtttttcataaggctgtctttggtcttgaaaagccaaaattagatattgcttaaatcaaggaacaaacaactggatatccatttgcctcctccagctgcctaactacagatcattcccatgttattcctatgctagatcagatgggcaattccagattcaagccttgatcaaataaggaaaggtacattcctctcctctgctccatccctcactgtggtgctgccttgctgatttgaggttcaaccagtcagttgtgaatggagagtactctcagtaggtgagatggtgggacggaaatgcatgcttatcctgcagcccacctcgccattagagcaactctcttaactgttatccaccctggtgcctggccctggcagctcatgggacgtcacaagaggacaatggctgggagaaggaccttctctcaagggtgccttggaggctgttttagggaatgaatggcttctgacatgggctttcttaaagttgccccagaagagaagttaccattgaccaggccctaggtgtttgcttagctcagagccatcaggagggtcttagctccttagatgagcagctcctgcactgtggtgtgaacgtggtttgcaaggtgccattaaataaacaagtgctgacaattttgcatgtttcctgggtgatattttattatactttcatcaaggaactggagcaccatatttatttaaatcagtacactccatatgttcctagcttggtgcaaagcaggcacaaatgtccacatgcagccagggtgctgactgaggtgaccagtttgcttgagttttcatactctgcactctccagtggaacagcagctgcaggactcttatttttgtgatgtggagcatgtctgggtgtgtggcagggggaactgaaatagtctctgctgactttttgtacctacagattttgtttcattgctcattttggaaaagggaagcccttatggggccaaattaatggtttttctgtaaatgattttttttccccctcaaactccattggcttgacttccagtggtatagaaaggcaatatggtgaacttctcagcccgaaaaaggagatctccaatcagggccgagaggctcatgctaaggtggaaagattttcctccgtgatggactcttggatacctacgggagacttaaaaggccctcagaccacaggattaatggtgagaaagcttcaggctttgagggtgaactacttggagttacaagttaatcgggagcttattaaaatctctggagaactctactgtgggaaattgggcttctatcttctctgctgatatcttattatttcaatctcctggtttattttctttggattttttattatgattttaagaaattatttaaaaagttaaaaatatttcttttacgtattccagtttagttgttttgaagttaattcagggatccgggatccccaaggtgaggcaaccgtgattttagacaaacttttttcctctcccaaatttgtatttgtgggctcagttctcatgctggtggcagtagggagctcagtgtttactgtggaattaaaaatgtttattgttgctgcacataggttggtgtgaaaggtaccaactgcaagtttcaacttgcaaaaacacttggccgttgggctcctttggaatcgtcttgaagcttcagattctgatatttcatgagcactttgcaaagtcactatgagaagcaccctccttcttacctgctcagctggagtcagttacagaattccttggcagctggctgtggacacgtgccgggcagtcaggagacccgtgggagctgtgggagtcctgcaacgtcaataggaagaggtggggacttagagattgccccacatatggtctgttgtgccagggcacacctgttgacactgagttccaaggaagtccagacattagagggtgatactctctgtccacagcacctccaccaagcgctctttgttcatcgacttagaaacagtaggaggcgggaagccctctcttgacaagatcctggaagtggccagctggtccctttccagccaagtgtgtggtgtgtccacttcctgggagggactgggaccaggaggcctctgagcccttcctcagaagtgtacatgcaaacaagagggggctgagccatacacctgtctctgagatggtctgagatatgtgcatatgggattgagcccttcttgttcctcagctgaattaagagggtgaccacagtgctcagacccccccaagtaaccccatttcccaaatttctcttgagtacacaatgcctcagactgtactttatgcctaaggaatagctgagaacccaactgaagacaagtgtgaactgcaggatatggttgtgaacagaactgacgtgtgcaacagcatggatggaactggaggacgttatgtgaagggaataagccaggcacagaaagacacaattctcatgttctcacttgtatgtgggaactacaaattcacacaattgaattcatggagatagagagtagaatgatggctaccagaagctgggaagggcagcagggggagtgggagtggggatgacttatgggtacaaaaatatagttagatagaatgaatatgatccagtatttgacagcacaacagggtgactatagtcaacaataatttatggtacacttaaaaataactaaaagtataattggattgtttataacacaaagaggtgacaaatgcttgaggggatgggtgctttatttaccctgatgtgatgagtgtgcattgcatgcccgtatccaaatatcttgtgtaccccataaatatatacactgactatgtactcataaagattaaaaccaaaaatgctgacgtggccatggggtgaccctgagaaagagtgagttgagtgtggcagggcaggtgccctgttcgctgacacgtcagattgtacctggggcctgtggtcatcgctgggcaccacccagcagtagggaaagtggcaaatggaacttgtgcaagagtgactcacccagaaggaaggtggggagactaaaaccatgtcatttagaaatagctgaaggaatgagaagtcccttcagacctagggggacacctggtatctgtcctcagatttcggaagggaatattactactaatactcatgataatcggagctcacatgtattaaatgctctgtgccaaactctattccaagcacttcacatgcaaatcttaaattaccctacaacatacataccattatgatcttcactttatagatgagacagctgtaaatggactaagaaatgtgagtttcattagaaggtaatggagggaaatatggcatgtgttaccataagttagcctcagtaggaggaagagctgtctgacatgataatatccccccgaaaggaaggtggaaatggccagaaggaagataattaaaaccacatgtattgagcatctaccctatgccagacatggcctttgaagctccccatgtattattttggttaatcctcacaaccactgtgtgagagaagaattattattcccgttttacaaatgaggaaattgaagcccagagacattaaataaatctaagaactttccaccagtaagtgacagcccagatttgaatacaggtatgtgtggttctcaagtctactgtcattggtgttcagagcaaaggtggaggcgcacaggtggccccggggcacagaaccaggctggttcccctgctagacactcctatagcagcctgaatttcacaagttgtgacacattcatctgctggtaacttttgttgcttgtcttccccgttagactgcaagatccacgtgggcgggggctccatgggtcctgtgcagtgctgtactcctaggcactagaaatatttgaaaaaatgaatgaataccagtagagatctcttgttcagacaggggaagttaaaataaggataatgaatctcctattgggatgttatcgggagattcttatgttaaattaggaatggattatcagcagttgtaatcccagtatattttcagaaatactggacagattttttttttttttttttgagacagagtctctctctgttgccaggctggagtgcaatggtgtgatctcagctcactgcaacctccacctcccaggttcaagccattcccctgagtcagcctcccaagtaactgggattacaggtgcctgccaccacatctggctaattttttgtatttcagtaaatatgggctttcaccatgttggtcaggatggtcttaatctcctgaccttgtgatccactcacctcagcctcccaagagagatttttatacatacagattcctaggcctatatcagccccctagaatcagactctcctggagcaggacctgtacctgtatattgcatcatttcctggttgatttgctacctggccagctgagagaccttggaggatgggtctaaagtccacctgagatactgggattcctgacccccaacatctgcccctgggactcatttcccacttcctgttgcctctgcccaagcttctctctgccttctgggcttcaaggccaggccttgctcgtggctggagcctggagggaggtctggtgccgagtcaggcatgggaccttatcagctgggtatttactgagcaaagttcaaccagggcagtgctgcagatccgggtttaacagatacctaggcttccgggactttgattcagagcccaggtccctggggcccttatcggtggataataatgggctccctgtggaagtcctaaggtctagtgtttcttggctgacccaggcctgctctctgagagcccaggatccctaggccacaggctgtctaggtgggcagcttgttgcttcccagccacggctgcttttcagttgctctcccaggccaggaagggccctatgcactggctcttatttgggtcaatgctttggtttcctggctttgatggcaagaggggaaggaaaccttccctcagcagcaggtggacactgtctggccccagggtacaaggatcacccttgggtaattgtcccatgccctgaaagtcactgagaacctgggagccacttgcctcaatcctaaaggtgtaggagaggtgaagggaagacaaatggcagcatgtcttaaagaatcacccaatcgattaatcaataagtatcaactgagcttaaaacgcatgggcatgccactgggaagacatagagaaataaggtacaataactcaccttgagacgtttataatctagttgtgggtataagacacttccatcaaaaagaataactattacataatagactgaatttttttgaatgcctaccctgtacctgaatttatttgaggcatatactgttctaccaatttcccacatcaagtgacttctctcaatattcctttgataaagaaactgaagattaagaggcacagagaggtttagtaacttgcccaggatcacacaggaaggtggtggcaggggcaggatttgaggcctgtgctatctggctcagagtccctgctcttatggctgtcctctactgccacctatgatgaatactaatcagatctggaaatgtttgagaagctgtagaatgtggaaattactcaggctgcaggggtcaggcaggagggttgcatttgtcttgtgtcagcaagaatcaagaggttggaagaagtgagagggaattctgaccacggaaaacctcaaccacagatgaggaggtgagacacgcaggaacacgtagagaacacagacagaccttctggttggagacagggtttgtgtagtagggagtgtgcaaagtggtgagaaaaatgggttcggatctcattctgaagactgtccaattctaggacaaggagctgggccttcgttgtctgggtgcaggggacccacagaaggtttgggagtaggaggagtgacaatactggagaggcattctaggaagtgtcacgtggttctccgtgttcaagcacgacttaggggagcaggcagatccatgaggaaatgagcactttggggtgggggctcgtctgagaaggaccatgggctccagggacattgcttttcacagccacagctccggagcaagccccagccccggcccggccataccagggcgtccgtgtgaaggagccagtgaaggaactgctgaggaggaagcgaggccacgccagcagtggggcagcacctgcacctacggcggtgagagtttgtgtgtgtgagagtgtgagtgtgtgtgtgtgaaagagaatgtgtgtgtcagggatagtgtgagagtgtatgtgtgtgtgagtatgtgtatgcgtgtgtgtatgtgtttgtgtgtgatagagtgtgtgagagtgtgatagtgtgagagagaatgtgtatctgcgtcagtgtgtgagagtgtatgtgtgtgtgagggagtgtgagtgtgtgagtgtatgcatgtgagtgtgtatgtgtttgtgtgtgatggcgtgtgtgagtgtgtgatagtgtgagagagaatgtgtatgtgtcagtgtgtgagaatgtatgtgtgtgagagagtgtgtgtgtgtgagagtgagtgtgagagtgtgagcgtgtgtgtgagagagtatgtgtgtgagggagtgtgtgtgagagagtgtgtgagtgtgtgagagtgtgagtgtgagagtgtgagagtgtgtgagagagtacgtgtgtgagagagtgtgtgtgtttgtgtgagaatgtgtgtgcgcgcaggcagatggcttgggaggtgaccaaaaggatcaggcaggaaggagcgcaggtcccttggtggaggctgccagggatagagctagggtggagcaactgggatgagggatcagggccggctcagctggcccaccgaacacagctactgtcaaggcctgagtgagcgaatgacttgcataccctggtgtgagttgggggctccccctgagaagaagaagacaccagctccctgagcgcacagacttcctgctaaatagaaacgcaaatctctcaagtgtaggtggtgatggttgggatacggggtgggatgttttgttctaaccagagagattcctatcttctattctcctgccctgaggccctctgggcaagttctctgcacagggccggttgacgagggctaaacattgaccctggtcttctcctctcccctctaggtggtgctgccccatcagcccctggcgacctacaccacagtgggtaagagtgccccgtagccctggtggcccccaggcctctcatctgggtggcatctgaagttctgtaatttccttcttcccacaggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttgacctatgcctctccgccactcatcaccaatgtcacggtatgtcacacaaaggcaggactgcacccgcccatgctgagtgcacccttttataaccagagctgacttctcgatcctgatcttccttgctattgattctcaagataatcaggtcatcaaagctcgccttggtctccatggaggcctgctctgattctcatttcctgagataacttccacaaagatgtctcgcagcctctctcgtcatactttctgctcctcaggactggggaggtcttctctgattccctgttctaaatctccccagcttccctgcaagcagtgagtcttggttctgagttgaagtttttagtgaatgtggcaccaggcgagatctacatggggtcttgtgttggaactagcctttcatttctattcagataacttagggagtgattgttcacttaataatggggtttaacagaagatttctaggctgaacaacaggtgatatttttgatggtgtcagacccacgtgtggggtaattttttaaagttctgtctctactgtcagattgccttgttcaaatccctgtcccttcacttactagctatgtgactctgggtttagtgacttaaaactctctgagcctcagtgtcctcatctgtaaaatgggaataccaagaaaagggtcgttgtcaggatcaaatgaaataatgagtgtggagggcttagcacagtgtctggcatacagaaaccactaatatatgttagttatcatcatatcaaaatctgctaacattaaccaagggcttgatgggaaaggaagagcctcttcccccgggaatgaaggaaggaagggaaatagatttatgttaatgattcctgttcgactaaaggactgggaattttgcaagtattcaagggcaaaaagacctgtggttacagctgtatccagctccagtccagggaaaccgtgggaagtagagctgggccttgagcagtcccagagcccaccttcgatggtggtgcttgctttggtccaccttgtctcttccgtttccctccagggtccagtgtcatcctgatgcacctgcccctgcctccaagcaccttctatgaaaggcctgcagaagcccttccctcccaggtccacctgcctacccagcaaaccaattttggagcctggatgatgatagataagaaggagttaatccaacacctctcccaggcaactcatttccatgtcagaggcctggggtgagggtggtgggtggaggactcatggctcccacccatttcattaccaaggattcctttcattatttatcccctttcatcattcccaccttctgctttgaaaggttctgtttatcaaacaaacagtattcattaagaattgatttatttgttttgccattttgtaaattaagtcatcaaagctggctagagctgtaagtccacactcctgatcagcagagataagacctgctgtgtgctgagtggaagtaattgtattcccgagcaaagaaacctatagttacaggtttatgactgggaaatgtagaatttccatctggatttttgaaaagctgggaatcatgaggctttcccggattctgtctggtttcaggacactgggatggggaccactggcttaagtcaaaggagaggaagtgattatgctgtggtggggtgtacacctcagcccggatttcgggaggctggaaggcctctgagaccatttccagctctatcattctatgcaaaaacaccctaaagccttgctactcaaactcttgtccctggactggccacattggagtccccctgagatctgattagacatgcaaaatcccaggccccactctagacttcctgtgccagaagctgcgttctaacaagatacccaggaggttgagaaaagccctgccctaaatgattctaacagtttgctgtcaagacacagtgacagtaggagggatatatgacaggggagacagggatggtagggggagattttggcctccctctcatgaatccatgcagagagcatcctcttctatctgctttcctcaagtgtgaaagaaaagtaagaatccaggtcccgcccctgttgcaggcctgatctgaggtttgtgagggcagtcgccgtgcaggtgagaggtatgactcgcagagcattcaggagaaggactctaacacttggagggtcatggggggtgcccataagtgggatggccatggagatcagctcagagacagaggacgatgaggatgtggaaggcaccaggcagcagcaggaaggaaggccaagtttgctgacaaagcagtgcttcccccatctggggatggccaggcctccccatgctggccaccactagaggggtgggaggtgatggagctgtgttggcccaaggggacctccaaagctgttgtgtggagcccggactgtctttgtgtctgggcaggacagtggccaccttccagatacagcttccaggctgtggtttaacatatattttcacagattttaagatgcatatatttttaatgttttaagatctctgaaatagaaatgaattttgtattcaacgaaacctggaaaatcctctctaattggcctaacccaatgagttcattactgtttgtattctatttcgtagatgagaaaaatgagccttctgagcaggaagtggcctgagcaaagacatatagctaggaagggtcaggattggggctgcggttgaagtcagcctggctcctcccttggggaagactttgagcaggaggaggtggagccccatgaagtgagaaaccaggaaagggcagaattgaagggggagatggagacccctctaagggcaaggatgggtggatgggtctcctggggctgctaaccctctgtcacgtgttttcctgtcacagacaagaagctccgccacgcccgcagtggggcccccgctggagggcccagagcaccaggcacccctcacctatttcccgtggcctcagcccctttccacactacccacctccaccctgcagtaccagcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttaggcgtggctcccacctgagtcctgttccctgaaactgggattttaaaatgagcctggaattgagccccaggttcatgcttgtttggagtagtcatttcatgactacactttctacgcacagctagaattgtagacctgtaaaccttccttcccttcttccttcccctccctccctcacttcctccctctcccccatccttccattcttcccctccctcccttcttcctttccaaccccttccttccttttcctccctcccttccttccctccttcccttctccctttccaaccccttccttccttttcctccctcccttccttccctccttcccttctccctttccttctttacctccctccctccctcgcttcttctctctttcttacttcttttttcaattctgttccattttgggaggtaattatagggattttagcaataacattttatgtcaaatgttgccaagtctgtggtccatgggctttcatttctgtcacatttcatttcttggaaaaggcctccttcctccagtgcctgctgaaccatcttagggtcactcacaccctctgtaattttaagatgtatgtggtggccggcgggaagaccagccccgacagcacctcctgagaaagtcagccaagggcctaccctgatgccagagtccttgagctgtcagttcccacagttgctcctttgtttgctcttctcagcctcggccagatttacagtccaggcagcaaaatctcaaggcctggggctcagagtagtaaggggtgggaagtgggtggcagggagaaaagaacatcagggtgggtggggacaggccagtgacgaagagagggacagaggagggatgggaacaggctgtgcatcttagttggagagaggggtgtgggaggaagcttgagtttgatgcagggaggaggaaggctgaggaatgacttggctccagattacttggttattaagaagaacaataaactaaaggaaagcattgcttgaagagatggttttgctgctctccttgaggatacgtgcaagggaagttgggctgttgtaaacagggtgaagggtgtgtttggtcggccatttctgtctcacctctaggccctctgctggtgctgtggaggccaagaccccattaagcctaaaggtgatgggtcctcgcctagtgcttagtgctaccatgtgggttttgtttctttccttccttccttccgtccttccgtccttccttccttccgtccttccttccttccttccttctttccttccttccttccttccttccttcctctctctttctttcttttttttggttttttttgggacggagtctcactccattgcccaggctggagtacaatggtgcgatcttggctcactgcacctctgtctcccaagttcaagtgattctcctgcctgagcctcccgagtagctgggattacaggtgcatgccaccatgcctggctaatttttgtatttttagtagagacggggtttcaccatgttggccaggctggtctcgaactcctgactttgtgatccgcccgcctcagcctctcagagtgctgggatcacaggcgtgagccaccgcacccagccttttaccatgtgggtttctttagtgtcttaaaagcgtccataagccaccattctgtggaaccaaggccccctccacgcaaacaccctccctcctggggacctctggagcctcagccagaagtaccattaggtttaattttaatttgttttgctggagaaacatcaggtttgtaggagactgagttgttagcaggtgtgcttagctcttgatagtgaacgtgtaccttgggaactggctcacccacctgctaatagcaccatcgtcactattaagcagacatttcagttggtagaatccatgtagaagtcatggacttttctgggaaatgacttttctgggaaatgacagtttctttgacatattttctttgcccactttaaataaaaactctggagaaagttgtctgttttggattttctttttctgcttaagattaattttgacccagatttctctgtgcctgccttaaatcccagtacacaaatcttgaattgtttttattcagatattttttagatttaaaagttcaagacagcatttgagaagatgcatttacatctttgtcggtactgatggtaagtaggtgggcagggctctcagtcctatttgattaaaagccctggttttccataaaaaaagacactatgcaagatttttcagcgtaccatttgagagggtgcagaagcaacctccgtaaaggagttaaagttggcaaaaactagcaaagaaatatagtactttacgtgtttgctaagataaatggtctattttttctcttatcttgaggtcaaatgtcttggtagtagtccatctgggtttcttcccgagttactctgctaagatggaaacattttcataaagatttgtagagacttttctgtgccaaagtgtttcatttcttatcaagttgatccccctaagctttcagtcccatgttagacagtgtgattagaggaaggaacttaacactagtcttgttgactttgcaaattgatctgttgcagaagaagataaaaccagtccccaccgtgcctgcagtccagttctcccaagcaggacatgcgcgtggctagggggcttgttgtccaggagagtggggagctgaggagagagggaaatcttttaacttgattgctcttcctgttattcacgccatcatgagtaacttctcatgacgctgagtgttcagggataagttctaccacgggcatttccatagcaggctctgaaaatccatcaatcaggatccaggagcatgtgacatcaggcaggaaccatgacctaaggaagccatctcatagggccagacatcaccacggaatggaaattccagaagccaattagtcccctccaagatcagtcaatggagtgagttacagtttggaaggggtctccctttcctggtgattttctgagtttctaaaggcctctgagctcactgcctacattgttaatcttcgttggagtaattgttttaaaattatctacactattctgctatgagccttatttccagattttggaggagagagtacatccagttatttagccttctttagattaccagcaccattgtctttttggcttactctccctgaaaaccagaacctagaaaaatgacatggaaggaaagggtttgaggttttatcttcagctttagtgaggctcaagtgaaagggaagatctattaaaaatgcatttgccttactctcttttgaggtagaggcatgaaaaacttgatctgcaacttgaagaagagcatggccagtgtgatgtagattagtgctttacaagattctgatccatgaggctgtccaattccagcataaaacaggctagcaaggagacaagtatgtggctgagatgaagaagatagacatctggaaaagaacaaaatcacatgaccaagtggctcaaattctctgaacatcaggttgcactcatctctaagtggaaatctgaagacatgttctaaagctaaacacaaatttcttgaaatcagaaaccatagataacttattttgcattaatttacttcatttgagtgtcaaatatgagactctctcaataatttcttgttgaattgaattaaccggggggattctctgtccactgcttctaaatattgatatagatgattgcaagttgattataatgaagtctcctttattggatggacagagacatgatgcctggcagatgttttttctgaaagcttgagtagaaatattcataagctggtgatgttaatctgtttgtcagttcttctacagctgtggctgctgtggaaggtgtttcattcattcattcaacacagatttaaaaaaaaattattttattgaaagttgacaatttaaatatgtttgtggggtatgaatataatacaatatattatggga

SEQ ID NO: 16401 - DNA, 28884 bp, Human
acaaattaaatacaaatgaaaccacaaaatgaatactattcaattaaaaatattatagtaatttaacgtgacaaatgatgtattttgctaaaactgtcatccgtcgtattgttactatggtgttgcctgctatagctcagcttcttttgtgttcaacatgcctatgccaccaagtgactcctgatatcttaattttctcaccatttttctgttacaactaccaaatagtgcaatctcatgatgcatttggctttcattttgtgcatgaaagtatcattgtcattttaaaaccacctctgttcttttctcattatcccagaacaataaaagcagcactaaaacacacatgtaaatgtgggtgctgaaattgtgtggcaatacttggttgtaaggtggtcacccaaataattcagaatatgcttatacaaatctaaaaaatatgaaaatgaaaataaaattaaaaccctagagaatacattcgcagacataatttgagaaaaactgttcaggtctgctggttcccaaactttcattactatcaaaggctctagctattgtgcttacttccaagaaccccatttatttatttatttatttatttatttatttatttatttatttattcattatttcattcattcattcaaaggctctattgtgcttacttccaagaacgctatttatttatttatttattttagagacggggtctcactctgccgcccagattggagtacagtggtgcgatcctggctcactgcaacctctgcctcccgggctcaagcgattctcatgtcagcctcccgagtagctgggactacaggctcccgtcaccagcccagctaatttttgtattttttagtggagacagggtttcaccaagttggccaggctggtctcgaactcctggcctcaagtgatccgcccgcctcggcctcagaatcccatgttttaaaaaagtttgtctcctacactgcatttatagttttattaatcaggcacatagaattaccatttcggagcttgtgatcaccatatgtagttatcactccaagctgcttaaattccagtctaaaacaaacaaaacattctaattattctgtgctaccctgacaggggtaagtgaaaactttccattcaggtttgtaagaacgagctcccagacctccacctcttccccttgctgcctctgaggactcttggaggtctagggaggccagtttgggttttcttgctcaagaaagtagccaccccacccaatttggaaggattaaagcttgtcctagttttgcttcattgttgtacttctagcatgctaaagagctaaaaaatgggaggaagaaaatacaacagaaggcaccattccagtaccaaactgaaaagaaacacaaaaacaagagagcagcatgtttttaacagcttgcgtggaaaaaatattgactggggagtttggacagcactgttcattttctctcaccgcccgcgttatttgtcttacggagcaggagccagataccattctggagaaagagccgcgggaagaggtggaggggttctgtggaagtttgagtctgagcggagaaattagggctggagatccagtggctcagggccaggaagaagtcaggggaggtgctaaagcctttttcctcctggcctcgggcactctctttggtccgcctgagtcttaagagggcacagcgcagatcattcaggtaggttcctggctccttcagactacaacgagctggatgaatccctgtccctgtttctttcggctggggaaaggacgcaggggttccattcgctttcttagcccacccgtcttcttgagttcagacctacaactcctgcagtgggggtcagaagggagccttaatcatcgggacagaaactcggctccccaacttcggctaaaccagcgtggcggccttcgtccctactgcctgggcgcggggcggggcctgggcgcggggcggggcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcaggtactggactgaggccggggacccgaggcgagaccggctggtcgcgtggtagagaagggggaaggcctgcgtcgcggtgggggtggccgaggtactgaatgagtcggactcgtagcagaaacttgaaggggaggcggggaatgctccgcgaggggctgtggtgacacgccccgaccctcccgggtacctctctagtaaccttgcttcggaccccctgaggcgtccgcccggagccttgcccttcccgggcggttgtcggggaacccgcttcccgcctgggcgccccatccgggccgtgaggtggccgcgtctcttgggcgagggagcaggagaagcgcggtgccaggccgagacggggctggagcggctgaggggcgcaggatgcccagaagccctttgaagtgcccctggatcccttcatctcggcttggaactggctcggcttgttgggtagaaagcgggggtgggatggccgattaatctggacgagtagtgtatccgctctgtgggaacttttctttgaaaccacaggtgttgtattcaaccgtttcacctgcttcaccactgccaaagtgctctctttttaaaattatcttacttcctaggtgttgtattgtctttccttcatttctcttccggtcccttctgagtgtttctcctgggaaatcctccgccggctagtgaggccgagttacacttctttttggaagtccttatgagcttccttaacagtaaaatctaaatgaaaggttatcttcattcttacccctgtgtcataatttcacctgttagcaccttttgtcttttgatctaaattcagccgtttctttacattgttcttctttctactttcttttctgaagctccgactcaacagtattaagaagttatcaacaattgccctagcacttggagtagaaaggacccgaagtgaattgttgccatttcttacaggtatgtgaatctttgtttaaagaaaggtagggacattccattttccagtagctttcaacactgacttttttagagtttattacccacattaaaatgagccaggtgttttttgtgcaaaagaaacagaacagagtatattgttagttgtggctagatatattcaaacatcaaccatttagctattgaaagtaattgatacgggagtatgaatttctaattcgttgtgcaaagcagatacaggaagacggttgagaagaaagaaaatgctgttaggattttgactgggtcaccttcctggtcgcatagtgaatctgttcctagttttgtgtcagtgtccagctgtgggagagctatccatgttgatgagtcctgttgttgtcacttccagatacaatttatgatgaagatgaggtactattagctcttgctgagcagctgggaaatttcactggcctagtgggaggtcctgactttgcccactgtctgctggtgagtatttataagctgcctaccctccttctacaacttttgcagtataaatgatacattgtttggtgatagacacactgcagcattttttatgcagatctttttatgggcagatagtcataatgttagtcattgagagaataagtactgtaggcactttgcactcaactccttttttttttttctgtaaataagagaacttcgtcctccttttctgcgtctgtagacttattagtttagatgtagggagaaaaagggtttgattgtttttatggttcccccgcgcgatggtggaagttttaattctcacctagcagcattttgtctttgtcagtttaacttttgcttctgactttgtgagtttgatgaatttagttcaatttaattgacatttattgagagtctactttatcagacacatcatagtttacaatgttaatgttgaagaagaccaatgtgagggggcttggtggcacaagcctgtagtaccagctactcaggaggctgagactggaggatcacttgagcccaggagtttgaatccagcctgggcaacatagtgagacccccatctcttaaaaaaaaaaaaagaccaccaaaatgaatctaatgaggtcactgcctttatgtgtcagcaaataattaccgtgcagtcgtaaatggaaagatataagtacccacaaaatacccacgtaatagaagggagaaagggattcactccgggtgatcagggaagaccttgggagatgatgtctgaactaggttttaaaggatgaccaggaattcaacagttggacaaggtaggggtgtatgtgtcagagctttgaatactgggtatgtaatactgattcttgtgatttctgtctctagttctgacttttccatggaactcctgaggtagattgattaatagataagtatgaatatatatatatagagagagagagagagagagagttttttttctgtctatgtatataggcctatgcttttttctacttgtatgtcaaacaggtatttcaaacttaacatacccaaaacaaaacttagctttatcccccaaatacacctctcatttagttgttccacttcagtaaatggtatcactatcttcccacttgcacaagccaaaacctagaatgtattcttgaatcctctgtgccttgttccacacatctaatccattagtaattcctatagagtctacgtatatttcaaataagtccactttcttccatccctcctattaccagcctagtccagactgtcatctttcctctagattgctgtagtagcttcctagcaatgctttccactcttgcctctcacccgactcttacagttcacatcacccagcagatggctcactctctgctatagctcttagaaaatccaaattctgtaccttagcttacaaggctttttatgacccgcctctgtaggattatcatatgcccagtggtactgcatgagaagaggtgacagtaggcagggaacagactgcaaaaggccttgataacctcttccattcacattggtcatctttctgttttttgaactaaccaagctcattattcccttaggacctttgccctaggtcttccctctaatgaaaagctctttcaagctttctgtggctggctccttgtcattcagggatcaacttcaatgcatctcctcagggaggttttccccaaccactcaacttaaaatagcctcacagtcatcccttactacatcatcctactccttttttctatagagtactcatcaccatctacttattttcttgattgattgttgtcttactccattagaatgtaaatgccactagagtgaggaaccttgtctgccttgtttcttctgtgtcctcaatgctagaatataccaataataatgtattgaaaaaatgagtttcagaggcttggaagcatgaaacaggctgggttcaaaactgccggagtgtggctgggtgtggtggctcacacctgtaatccttgccttgggaggccaaagcagcaggaggattgcttgaggccaggagttcaagatcagcctgggcaacatagtgagaccccaacacttaaaaaaaaatagctgggcatgatgtcatgtgtctgagtcctagctattcgggacgctgaggcagaaggacgaggagtctgaggccgcactgagccatgattgtgccactgcacttcagcctgggcaacagagcaagaccctgtctcttaaaaaaaaaaaaaaaaaagaactgctggagtgtgaagtgttgaggctgggtaggcagagtggtcatcaagggccaggcagagttcaaatcaagagaccactcataagcaattctcaggagcatggcctcatcctgtagtaatgatagctattatccagtggtactgcacgagagggggttacagtaggcaggggacagatcatgaaatgcattggcaagtgagaaacagtatcttttcaatgagtttctgaaataccttctaggaaagctgaatactgtctacctgtgtgtatcaaacaatttttaaaatatattattagacacacttcttttctttaactcattatgcttctgtttcactcttggttagttctatatgtgggttttatgctttaaaatctgtagctcatggcatgtgtagaatctacctggactacatgcaaactcagtaaggcagaggttcagagagccagcctgtttacactttttactaggccatgccatattcagttactgctcttaatccagaccatccaccccatttggcttcttttatttctaaagctgtaagcaaggtgtcctaccatctctgtactttaccttttttttttgagacaagagcctcactctgtcacccaggctcaagtacagtggcacaatctcggctcactgcaacctctgcctcccgggttcaagtgattctcatgcctcagcctcctgagtaagctgggtttacaggcgtgtgccaccatgtctggctaatttttgtattttttgtagagacagggttccaccatgttggccaggctggtctcgagctcctgacctcaagtgatctgcccacctcggcctcccgacggctgggattacaggtgtgagccaccgtgcctggccagtctctgtagttttcacttgattgttctgtcagaaactcctttctgccctatggctaatggaaagttgctgaatgtgttctgaaaaaagcaattttgcattcagcattttataggttggataaaaggatgggatggagatggtggataagggttgcttgcacctctgggaatggtggaaagatactgaaaaggctgtggactcagtgacctgacaagctgttatcctgtatttgtggtgcctaacattggtcatagttttgtacttactcttgaggaaatatacatgatcctgtctgaatttggctatgtatcttttaaacctagtgattcaactcacagtaatattaatattgtgtcaagtcttttacactgtgtcatttgtagacaccatctgggaattgccatctgggacacgagatcttggcttttctacagaagtcgtgtctttgggttggccgcaccatatgttatcactgtgtgagctgaaagtaaccatttggtatgatgcagctaacattctggttacgtgtaccacctcccttcagtcactttaaaaggtgattatctgtttctaacctgattcaataagttttcttctctggttttcctttttaatccattcagcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagtaagccatggtatttttttgccttgttaaagcagaaatcaggtagtaagctatgagttatttgggattactggggacttgtagctgacaatttacatagtaccttgttaccaatgagtggctgatactaggatagtaggatttatgacatctttcttttttttttttaagagataaggtcttgctctgttgtctaggctggagtgcggtggcacaatcatagctcactgcaaccttgaactcttgtgcttaagtgatcctccagcctcagcctccaagtagctaggactaccgacatacactactgcgcctggctaatttttaaaaaaaatttctggctggatgcagtggctcatgcttgtaatcccagcactttgagaggctgaggtgggaggattgcttgaactcaggagttcaagaccagcttgagcaacatagtgagaccttgtctctactaaaaagaaaaaaattagctgggcatggtgggacccgcctgtatttctagctactcagaaggctgaggtgggagttcacttgagccccccacaaacaacaacaaaaatatttttggcatatagatagggtcttgctatgttgcccagtctgctttcaattcctggcctcaagcagtcctcctacctgggcctcccaaagtgctttgattacaggtgtgaggcaccatgcctggcctatgatgtcattttttattatccagttgaatatgttttatttttgttacttctataagtagaagcttagtcactgattattgtaagataaaacctctaaaagtctgtctgtgtgtatggggggcaggtttattcagtgttatttgatgggaaataccttcattgttttatgttgcaggcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggtaaactaactcttagtatttaagggacacagatatgctcctttcctctaaattttcagaatttctttggggagttttagttttcttgttaggattctttttacagaattagtgctgattctggcctggttaaagtgtaacatgcttatctcaatgttcttatgtttctttcttaaccagaccatgatttctctcttacattagcagctgttaaaagagtggggagtcagagaggaaatgggagccataattagaaaggaagaccaaagctgcatggagggtaacatacctttgggaattgctggctgtattgtaatatgagggagtaatgtttcctggaatttttgacttttcagataaataagcttagaatgtgttaggaaagctatttgactctctgcttcttctatagtagtgtatgggattacttcacataatcgtattcaattctgaagatctagatctctttggtgtagaaataacaataaaactagcaaacatccaaatgaagtacttaatttttctctgcctttaagtagttatgtgtattaagtaattcagtccttacaacagccccatgagatagcccattttacacattagaaaacaaaggcacagaaagtttaagtaacttgctgaagtttgcatagttagcagtagtggagtcagaatttgaatctaggtggtttggctccagaatttgtgcccttcacagctaggctgtcccgcttctctgtaatggtgcttaataggatcagctcccagagttcctggactctagaatagtccttttgggcttttaatttgcatgttgcctgccctaagatcgcttcatgtgtacaggaccacaagccccaggacacatattaatgagtctcattttcagatcctaaatctaaagatctaaatcctactttgaaaataattttaaaaattattagaatttttattctaataataaatgtacaaaatgaatgtataacttaatgaactattagaaggtaataccaacttgttaacgatcacctatgataggagacatcactttgacagccactatcccagaatccctccatggattccctttcaaacacaatctctctttcctcctccacttgccactccatttccttaagagtaacattatcctgacttttatggtaagcgcagcctttgttttctttgcactttttcttttcttttcttttctttttttaaaaggagtctcactctgtcaccaggctggagtgcagtggtgcaatctcggctttctgcaacctctgcctcccgggttcaagcaattctcctgcctcagcctcccaagaagctaggactacaggcgcatgccaccacgccaagctaacttttgtatttttagtagagacggggtttcaccatgttgaccaggatggtctccatctcttgaccttgtgatccgcccaccttggcctcccaaagtgctgggattacaggcgtgagccaccgtgcccggccttctttgcacttttattacctaaatgttatagtttaaaacagtgctttacaacagaaatataatgtaagctacctgttgattttaagttttctactggccatgtttttataagaaaaaagaaataggtgaaattaacaatatttgtattcgaccaaaattttccaaaatcttattatttgagtgtaaataacgtgtaccagccacatttcaagtctcagcatgagatgatgttgttaatagggtggtagtgaagatggaaaggatttggatgtcagtttggaagtgggatcaataggttagtattattggattggatcagtgggagaggaatcaagatctcctagattttttgcttgagcaactgggtggatgatggtgtcatcgttaagatagagaaaattctgggaagaggaacaggtgtaggagagaaaacgaagttctggaagagaagtaatttttttttttttttttttgagatggagtttcactcctgtcgcccaggctggagtacaatggcatgatcccagctcactgcaacccctgcctcccgggttcaagtgattctcctgcctcagcttcctgagtagctggaattacaggcgcctgccaccatgactggctaattttttgtattttcagtacagatggggtttcactgtgttgggtaggctggtctcgaactcctgaccttgtgatctgtccgccttggcctcccaaagtgctgggattacaggtgtgagccactgcaccagaccagagaagtaattttttaacaaatatgtattagcttatatttcagtagttgattagcagtcccatgatttagcatcattttcgaaattcaaaaatatctgtgtagtcactaccaagaacttagtcctgtcttttttagcctgtgcacctgcatacagaggaatgtgtgtgtctttggcatatagtcagttattgttgatacacagtttctaagatttgtaatattttggaagttggagtcactgttatgtctctcaagtatgtgtatacgtatatacataactgttattgtacacacttaaaattttttacctatttctcctgggtgctaatgtttacatgtattaagattctaccttatatatgtataatacacaaatctacagtctcaatttctaatttctcattgatgtttcttttttttcggtgtttttttttttttgagttggagttttgctctgtcacccaggctggagtgcagtggcgcgatctcggctcactgcagcctctgcctcctgggttcaagcaattctgctgcctcagccacctgagtagctgggattacaggcacgtgccaccatgcctggctaatttttgtattgttagtagagatggggtttcaccatgttggccaggctggtgttgaactcttgacctcaggtgatccgcctgcctcggcctcccaaagtgctgggattacaggcatgagccactgtgcctggcccctcactgatttgtcttgtatattttccacttgttcaaaggacgtaggtgtcacgttgacattggctgtttacatttggaaagttgagttcattaatcccatacttttctaatttctgtgtttttctagccacagcttcctcaaagttattctgtccttgatcttcgacatttaaatccaactgatttttgtttttgatttctaacttttaattgttctgtgtatttctttccaagtcattatcttatgctgcctacactcctgttactgcgaccctgatctgagttttttgaaaactaagctttctaagtgatttcctttactcttactcttacctttgtcctaatctgttataaataacttgtacaaatattgttttcatttttatccctcaactttctgttatagtaaggctttgaaggcatcattaaaatgttttttttttcttttttacttaattttaaaattttcatttcctttatagaaactctgcattctagccaaggtaattactttgctgtttactcatagtacaaagtcatttctatctttatgactttgacatgccattccaggcaaagggagcagctctttcttttttttttttttcctttttgttttttgagacagagtgtcactctgtcgcccagactggagtgcagtggtgcagtctcggctcactgcaagctccgcctgctgggttcacgccattcgcctgcctcagcctcccgagtagctgggactacaggcacccgccaccacgcctggctaattttttttgtatttttagtagagatggggtttcaccgtgttagctaggatggtttccctctcctgacctcgtgatccgcctgcctcagcctcccagagtgctggtattacagacgtgagccactgggcccggccgggagcagctctttcaagatataaatacacggccaggcgcagtggctcgcgcttgtaatcccagcacccagcactttgggaggccgaggcaggtggatcatttgaggtcaggagtttgaaaccaggctggccaacgtggtgaaactctgtctctactaaaaatacaaaaattagctgggcgtggtggctcctgcctgtaatcccagctactcgggaggctgaggcaggagaatcacttgagcctgggaggcggatgttggaatgagcggagattgtgccactgcactccaatctgggtgacagagtgagaccctgcctcaaaaaaaaaaaaaaaaagaaaaagatgtcaagacgtgaaactatataaggtgtggcagtcttggtggtgttaatttttttaaacacctgcaccaccccacagcagttccccatgggtctcagtaaatgtctgaattacagaaattttgttcctttaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagaggtaaagtgatcatttttaagtactaaggaaataaacctgaaaacacatagatttgctgttgtacccaaagtttctgaattaattcttttcaatgggaagtgctgtggcaaaaatatgtatttacagattgcacaattttgttttgttcttgttaattcttttgttagtatacattaaaacccgttcaaattcttttatagctccagaaagccatgggtcctaaaatcaccctaaatgacctcatccccgcctttcagaacctacttaaagactgtgaagctgaagtccgggcagctgctgcccacaaagtaaaaggttaaggagttcaatttatgttggaacatgtgtcattcattttggtgcatttttttgttagtcaattttgcatgttttttgttctagaatatgtttttaaaatacatagggatgtttttagtgtgtggaaatgttacattgtcacttaaagatagtctctttatatttaaaaccaagaaatcattttgtcttgtttttgtaaaaaaaaaaatgcctttcaggttggattggtgtgatatgcaatggcatagagagttcacgaaaaagtttatttagaacaagagctgttttccttatttgcttaaacatataatttaattgaaattattgataaacctggttaaatgtcctcatttggctctttgtaaatggccctgtgaaagcattctttttttctatttatcttttagaacttggtgagaacttgcccattgaagatagagagaccataattatgaatcaaattctgccttatataaaggtaaacctgactttattttgtttcactctcttttatatgaaggtaaaccttaatctcattatttttgtttgtttgtttaccttaaagctctttgagtttaaaggttgacagggaatgaatggggaagatgtgttaatgtgcaacattgttattcatcacttattagcccattgtaattgtaaactgctctttggtgcataggtttatgttacctaacaagtagtctgaggaaacattatcaactaatcagtattgaaatagtgctgtctttaaattccttggggtcaggcatggtggtacatgcctgtaatccaagcactttgggacgctgaggtgggaggatttcttgagcccaggagtttgagaccagcctgggcaacatagtgagaccccattgctacaaaaaatacaaaaattagttgagcctggtggcatgcacctgtagtaccagctacttgggagtctgaggtgggaggattgcttgagcccaggaggttgagatggcagtgagctatgatcatgccactgtactccagcctaggtgacagggtgagacactgtctcaaaaaaaaaaaaattaggccaggcgtggtggctcacacctgtaatcccagcgctttgagaggccaaggtaagaggattgcatgaacccaggagttcaagaccagccctggcaatgtagtaagaacctgtctctgcaaaaaatgaaaaaaattagccaggcctggtggtgcatgtctgtagacccagctactctggaggctgaagtgcttgagcctgggagggtgaggctgcagtgagccaaggtcacgccactgcactccagcctgggcaacagagcaagactctgtttcccagaataatggtatggaagtttctgttgtcttgtaataaaggcttttaatttcgattttattttaggaattagtatccgataccaatcaacatgtcaaatcggctctagcttctgtaattatgggattgtctactattttgggcaaagaaaataccattgaacatcttctacctcttttcttagctcagttaaaggatgaggtgggtcttgctttatgttctgttgcctttgatagtaatttgattttatttgattttggtttagggtttcattaaaatagaacccccaaaaagaaaatggataaaaaaatcataacttattttaaaccaatgacacctgtgattttgggtatggggttataggttcctcagaaagtgggcaaaagtacccattagagtaaacctagaaatatctgtttatcatctttacctgatttttgctttatactccctggtttctttaaagctaatgtgtctttgtttaaaaagtttcatttatttaagtttaaatatagtatcaaaaattataatgatacctaatatttactgagtaattactacatggcaagcatgagccttagtgctttgcatgtatttttacatgcaattctcacaacaatcctgtgaggtaggtcttattattatccctttttgtttgtttgtttgtttgttttgttttttgagacggagtcttgctctgtcgcccaggctggagtgcagtggcgcaatctctgctcactgcaagctccgcctcctgagttgatgccattctcttgcctcagcctcctgagtagctgggactacaggcgcctgccacagcacccagctaattttttgtatttttagtagagacggggtttcactgtggtctcgatctcctgacctcgtgatctgcccgtctcggcctcccaaagtgctgggattacaggtgtgagccaccgcacccggccaattatcccattttacagatgagaaagctgaggcatagagggttaaagtaacttgagcaaggtctttcaacaatgacagatctgaaatttgagtgcatctgatttagttccagagattatgctctttaccatcttacggacttttcttgtagtctttagtattacggacttttaattgaaatttctgattaagatcatttatgttccttgagttatttatgtattcactattatttcttcaagattatccatttttttttcacctgagtcttacctcaccttttatcttaccctgacaggagactgttgggcagagtacttgatttttatatgtggtcttttggggcttgtgtacttgcagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctggtgagtatgtgttgctccatgaactgcagggtagtgtcagatagtgacaatttaccatggcaagtaggaggcctagtagcctgtatgcttatgtttgtttagatgcatgaaagtatggccttgttcttgttacctataggatggtttttatgtttgttagtgcatacgtttcttttcttttaagatggagtttcactgttgttgcccaggctggagtgcaatgatgcaatcttggctcactgcaacctccacctcctgggtttaagcgattctcctgtctcagcctcccaagtagctgggattacaggaatatgccaccacacccagctaattttgtatttttaatagagatggggttttaccatgttggtcaggctggtcttgaattcctgacctcaggtgattcacccgcctcagcctcccaaagtgctgggattccaggcgtgagccactgcatctggcctattagtgcatacatttctaacaaaaaggtataggttgagtatccctcatctaaatacgcttgggaccagcatgtttgggaccagaagtggattttggaatatttgcattataaatatttactggttgagcagcccaaattcaaaaatgcaaagtccagaatgctccaatgagcatttcctttgagcatcatatcagtgctcaaaaagttttggattttggagcatttcacattttggatttttggatttgggatgcttaatctgtattacagaaacatatttcacctcatcaccaccgaaaaacaaagccatagaataatcagtttcttggtatatataatgtaaattttataatatttaatgcctttgtgacttaagaaatgtttaactgagaagaaaagggattatggttttagggtaagtctgctgtgatttttgctcaaggaaacttccctgtttgccttgtattctaagcaaaatgtccctaggtaccacttgccctacattctgattaaagggagttgaggaatcaccatatagaaaagaagtattgaaaggccgggcacagtggctgacacctgtaaacccagcactttgggagccagaggcaggcgaatcacttgaggctaggagttccagaccagcctggccaacatggtgaaaccccatctctactaaaaatacaaaaattagctgggcacggaggtgcacacctgtaataccagctactcgggaggctgaggcaggagaatcgcttgaacccaggaggcgaaggctgcagtgagccaagattgcactactgcactgcagcctgggcaacagagtaaaactttgtgtcaaaaaaaaaaaaacaaaacaaaaacaaaaactgaagcttgtaatgttagtattttggtcaaagtccacattatcacattatctgttactgtttgagtttcgtgatcagtgttaccctaactaataccatgttagttaaaatttcaaagctgggttttatagccacatcctttcctttttttgagtaggtggcctagacagttctaagtttgatgtaccttcatctctgttggtagcacttattacagagtattgtaattgtctgttacagtctagttggagagatgggtgatctcttttagggcagggactgtattttatttccagtccctaccatagtgcccgtcattaattaggcacttaacattttttattttgggggcagggtcttgctgttgcccaggctggtcttgaactcatggcctcaaatgatcctcctgcctcggcctcctgagtagctgataataggcatgagccactgtgtatagccaacatttgttgattgttgagtattttttgagaaagatgtgtcagtttactattgacatcgctacagtttgtttccccttcctcactcccacttccattcctttcaggtcacaacatatggaatttattttttcttgtcttgaacccctgaatttgtatttttaattttagtacatttagtttatgaacatgcaatttgtggatgtctgtggcattatatgttttataaaattgaaagtgtccgattctttgaaaagtataccagaggtattagtgcatggcaaatgggatcaggtgaagttattttgtcatcctttttgtctgtcactcccaagtgctatgggtcatcttctcttcactggtgattgtcatggatctacttttcagagtggagaggagcagtgattaactgatttgctgaagaccaaaactatctggaagggagggtgcattttagtaccatttcttttaacctctgctccttctagacctggaaagtttcccagggttgctagctctatagagagcagtgtgaaagcaaggcagatggtgtctttggctgacttacacctgtctggcaggggtgacatgcctcagtcatgaacattttgctttacaattttaacttcttgttagtatatatattctccttaatttctcttcatatctaaatatttttatatcagatagtcattttataaaattctctcaagactttatgtatgacctggcttgtggacgatgttaagtaagtgtaaagttaaactacaaaaaccggaaaataggccaggcgtagtggctcacgcttgtaatcccagcactttgggaggcctaggtgggtggatcacctgaggtcaggagtttgagcccagcctgaccaacatggtgaaaccccatctctactatacaaaaaatttagccgggtgtggtggtgggtgcctgttacttgggaggcttcttgggaggctgaggcaggagaattgcttgaacccaggaggcggaggttgtagtgagctgacattgcaccactgtactccagcctgggcgacagagagagattccgtctcgacaacaacaacaacaacaacaacaaactggaaaataaaagttaattaaaactgaaggaaaattctcaacctgaaatgaaaaagaaatcttggctgacgtaatctaagtgtatgccaaaatttgttcattatgatcttttagtacaaagcaattttgggccaggtgcggtggctcatgcctgtaatcccagcactttgggaggctgaggcggacggatcatctgagtcaggagttaagagaccagcctggccaacatggtgaaaccctgtctctactaaaaatacaaaattagctgggcatgtgctgcatatctgtaatcccagctacttgagaggctgaggcaggagaatcacttgaacccgggaggtggaggttgcagtgagctgagattgtgccactgtactccagcctgggcaatagagtgagactccatctcaaaaaaaaaaagctattttgtcttattcaatcactattttcaaagcactgacacattatattacctctctttttttaaaatatagaatcaccagtcaggaacttcttagagttcaaagaagcaagactgtaaatgtgtagaccccagaagggaggcactaggaaagtgtgtcacagcattctccatgtggtgtggaagccccggggttagaggactgtgtaaatctgctcccggagcccatccccagcctgcactgaagtggccacctgttgacagtcgggaggaacagggctgggagagcaagccatgcctgggccatatgccctgtagtcctgggcctgctttattctccctccagggctttctcctgttgtctcgaaaatactctctttaactggggatatctctatgtcttgaggtcagttgctttatccttaaggatttgtcataatagtaaccaaaaagggaagacgattgagaattagtaatattactgacaggtgttttcctgggtaattcatttttacaggtaatccagatttgcttggcagaccatacacagtgcattcttcctgctcttttgcagtgttgtggctgacttctggccaccctgttctcttttacctagcagggcctatgccagctcacgtatgctttttttttgtttatgatttccgtccaataaatagatttatggtttgtttgtaattcctgtggtgtttctatctcttatttgtttatttggaaacaagtttttttagccttcaggtaaccttggtgtaatgtaaatagaccatctttatttctgaattttggcaatgtatgttaatggaatcttctgtatctgtagggtgtggaattctttgatgaaaagctgaattctttatgtatggcttggctcgtggaccatggtgagtagataaaaacagattattgaaagcccatatatccatgattttcatacatttccttttagaaaggaatctcagtctgaccagatattttgccttaatattgtaggaatgaagaaaggctctaattaaagtttaatcttctgaatataaatttgacgtttctaccaattttttgtatcttcgattttattttctccattaaacaatttatttgcattattttcttactcaatctattacattatcttcagaccatctcttttatatatctacttactcctcccttatctgaagatcctctttttgaccatcctgtaattggtgtcttcagcagctatacactaggttgtatggagattggaatcagatgaaaggcctgggtgggagaaatggctacttggctttttgaggtgacatagaagaggagatctacagtgagacagtagaggattcttaggtgtgggaaacactagctttgccatagggagagagagggcctggatttctggtttgggtgaaaggaaggcttactgcttgtactctcactgctgctgctacagtgctaggagagggtgagctcagggcaggtcagataggacagcaggaatgagcaagtgacttcctggtgaggcttcaggtagaggtatatgtgtgtatccccttgtgtgccaggcagcagtgggtgacagatgtaccgtctctgccagatcccaggtccagacttgacagcttcagtgttgtcttagacctgtttcgatgagtgtgagtgcccctatggggtcatgtgacattgtccttgagctttgtttccatgttttggtggatataatagataacctgagtcagttccacagtatcttttatatacttgatatatgtatttagtgtatctctttgttcatctatgggtgcttatgcctggaaatttgggaggaatgaggatatttgtgtctgcttatacgtgtgggtggttttgttaaaggcatgtttgcatcatatggaggatcatatggttaagagtgtgaagaggaaggatgtgaaaaaatatgtgaaaatgtataagggcttatatatgtgggtatttccagtgttttcaaactggattgtagacttctttctctttttcttctctaaagttatcttattgtggcctatttatttctttttaaataaaattaaaatttggcaaatcataggaaagaaataccacttttaaaaaaaatgtttatgttatatctgataaatatttgacgttactgggaatggtgcatcctagcaaatcattctgtgcttttttaaattttattttactttaagttctaggatacatgcatagaacatgcaagtttgttatgttacatagatatacatgtgccatggtggtttgccgcatctatcaacctgtcgtctaggttttaagccccacatgcattaggtatttgttctaatgctctccctcccctcgcccctcaccccctgataggcctcagtgtgtgatgttcccttccctgtattcatgtgttctgattgttcaactcccacttattagtgagaacatgtactgtttggttttctgttcccgcgttaatttgctgagaatgatggcttctagcttcatccatgtccctgcaaaggacatgaactcattccttttttatggccgcatagtattccgtggtgtatatgtgccacattttctttatccagtctgtcattgatgggcatttgggttggcctcaagtcattctatgctttctttaaaagttggcattttagattaagatggtgttttattttgaggaatttttaaagttctaatattccacaaagaattaaattcctggcaccctttctctgtaagattgtcttctctatgcaacttgattactccttcctcttttcggattttctctttcagtttgggagcaggagaaacccttgtttatttcactgcagcagcatgctgaagtggggactgcaagagttccatgaaccaatgaaataacagctctgaaattgttttgtacttaatcacaggagcttttttgcttttgcatttcagataagtgttatataatgatcactggatcagttagagtttttgaaacttttcccctagttaggtaactactaaaagaacattgtgaaaattccagagaagtataaggaagaaagtatcactcacctatattcctgtggttgagtagacagttttgatcagagggaggaatgtagaagggaaatttatttatttattataggagaaaggagaaggtatcagttattgagcatagatagacattcaaagaaaccttgcaggtcagccaggccttgagaggagatggggagagagaaagagacagaaatagacaaaagaaaacaggcagaactctggaatggtttgcattcttctgaaaacagtcagaggaaccaagaacatagtaggcatctggccaagtagagttcagtgcagttaaggtcttggtcaaggctatgcatgtgtgttccccagtctctggtttttctggcagtagagatcccttcctatggtaatggcattatgataaaaatctaaagcgtgttaaaaaaaatagtaatttgctgagcatggtggctcatgcctgtaatcccagcactttgggaggctgaggcgggtggatgacttgaagttaggagttcgagaccagcctggccaacatggtgaaaccctgtctctactaaaaacacaaaaattagctggatgtgttggcgggcgcctgtaatcccagctactcaggaggctgaggcaggagagttgcttgaacccaggaggcggaggttgcagtgagccgagatctcgccactgcactccagcctgagagacagagtgaggctctgtctcaaaaaaaaaaaaaaaaaaaaattagaggagaagacacaaatactctagctagctcctctttagtggggaggacagggaagggtttgggccaaagacaaagactatggatatgaagggaaggaatctgtattacagtaaaacagttgacttgagtttgctccttagtgcatctgagtcttaccgaaaggttgcttctcctgtagactgtcagtttaagtgttgataatcagttgtatgggtcacttgtctatgctgtcttgcttgttctcaacatcattgcccagaaggatctatgaatagaagaagttgcctatttcttggttggaggcttgtataaattgcctaggactgggactgtggcttggatagctattcctgcccttcctatcatcccaggaaggttgggcccacctggggagagaagtagaataaggaattagtacctaccaccctcgatttgttaatctgagcccaaattttgagtcttactggatctgtaaagtgaagtgacaccaggcttgtttttgttcagtgctgtatatagcaactaattgtgagaggattgtagctgagacctttattatctagctttatgtctttgataaatgatcaaaggatatagggaattattagatgttaaggcaggcacattgattcaaagacatttgacatcttgtttcaacctaagcattttcatggagaggaagcaagtcagtctgatgtttgtatttgctgttgtatagatgaccacagtggcctctacaccatttccttgttgtctttctcagtcaacgtcgcttctccgtgatgttgctggaataatcttgctaaaattccacattggtcatcaggtcacaagtttgctttaaaaacccatcactgtttttcctaatcaaatctaagtctttcataatgctctgcagtctgggtccaccctaattgtctaacttagaagtctcacaggtttcagttttttctgtttgtgtcctggatacatgtctttaccctttctaggaattcctccccgcttctctccacttacacagatcctcccaaatcttcactgcccagtcaaggcttctttctgtgccgaagccttcctagaccttccctgttcactcttctctgcactgctacaaccctcacagcctttactacacaatgccacacttcattctaattgctcttacaccatgtgacttcatggagtgtgttagctttcatttctctgataagagcatatttcttgtgagggaaagtatcttctgtgttctttttgtagcacatagtaggcacttgtatttgttaaataattgatgatgcatatggtgagctccttgcatcccttttctgtggatatgcacacttggaaactgagttggagctgagcatgcttgtcattgcagcatgattacatgtggagtctgattgcagaggggttttgcttttggtccacatttgattttcatgtaagtaaactaggttatgcttaaaaaacaataagcgatatgagaacatgtttttgacctcttctgcagtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgtaagtataacataactgttattgctaagcttaatcattaaagcaaaattattcatgactatttctgaattatcagtatactgtcttctatttggaatatatgtcttgtattgattaattggaatagacaggagatgagagaaaatgtcaattttaaaattcatgttaaaatctacagtattggctgggcacagtggctcatgcctgtaatcccagcactttgggaggctgaggcgggcagatcacctgaggtcaggagtttgagactagcctggtcaacatggcaagaccttgtctctactaaaaatacaaaaattagccgggcatggtggtgcatgcctgtagtcccagctacttgggaggctgaggcaggagactcccttgaaccttgggcagggggcagagggtgcagaggttgcagtgagctgagatcgcgccactacactccagcttgggcgacaaggcaaaactccgcctgaaaaaaaaaaaaacaaagaacaaaactacagtattttaaaagttcaacttatttgtgaattctggtctaattctctgatcatttgaatgattcttgtgtcccccactcagctgctcaaactagaaatattttcctattggtcaattattttcttattaaatattaatttgtttcattagattttggaattttttaaagtattttaaatgtgccatcttacttatttttctaggcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaagtaagattttagtgtttagtcttgttttaaaagtgtactttaaattttaccttatagtggggagtaattagctaaaattaagttcagggattttcactttacttaagatctgggtttgcttaaagaaaataatttagcaactatttttgaggatgtccactatgacttttatatttaagctctgtaaatgtgtagatccttgtctgaagctgattttgctgagaatttctttagacattattttgtgtatttgtcaagtttataaatgtctttatttttttactttaaattttaacaattaccattaaccatatacaccaaaaaggatttctatggcccattagactgtctttcacagataatacttttgaatgtcagtgctttacagggagaagtgaagccagtactacagaagttaggtcaagatgaagacatggatgtcaaatactttgcacaggaagctataagtggtatgtatttccttcttttgccttgcagcttatgccttggttaactgggatttatctctattatgtgagaggtgttaagtgggtaggatgataagtattatgggaaacagggagggtagtaagttcctggaatgctggtgtctctctgattagaaccctcttggcccaccattttctcataagtgagcaggctatttttcttagttacatgtaggactgggtaggaaatacgattctcactggtaagaatagtttttcgtttggaatttaaccagtttttaaagtttcacttctgattagcctggctgagtaaagacagtaaccacagtgagaagttgttagtttgatacgtttggatcattgttattgtgcttaatattcacatagatcgttcgtgaactttctgtaccactaacctgattttgtttggaattttccagttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttccagcagtattgacacctagtccttgctgcattgtacagtagcttttcaaactgcagttttattgctaagtttttagtatgggtgatactggagtcttatcatttgaagtgtttgcttttctacttttacagtaaaacctcattaattctgaaatttaagataatgagttaagctgaagagtttactgaagcaaattaatagtgaggaagcctatttgaactacttaaacagtattaaagccctttttaaaaagcacctatttgggatcatttgaggtcaagaattcgagatcagcctgaccaacatggtgaaaccccatctctactaaaaatacaaaaaagttagctgggcgtggtggcacacacctgtagtcccagctactcaggaggctgaggcaggagaattgcttgaacctgggaggtagaggttgcactgagccgagatcgcgccactgcactctagcctgggccatagagcgagagtccatctcaaaaaaaaacaactatttttcacataatcaaactcaccttgtctcatgacttttggttaagggggttttcccatagtttatttttctctcagtgcatcttgctatgaggtttgcttgttacccttttggtttttgaattgttgattttgttcacaacctcttttaaatctaacaagtcctgttctgtttagtgaaggcccaaagactcctctaagactttgtatatttgttacataaaaccaagttttactaaatactttaaaatttgtcctacattcgaaaaatagaaattgtaaatcagaggttatctgtctgcattttaaactgccaaattaccttatagtaagtttctattttatgactttgggccaagaattaagtattttcctaagcacaaatctttttctatattctcattttaatatcttatgctattattctgtaaacattttaattttagtttcatgagtctttattttttgttacctgcaagttatgttcttcttcattgaatttcatatttgagagacatttgtcttcatgaagcagatttgcactggaaccattgctttactctggttggaaatgccattgttttggggacagacttttaaaatgcccttgtgtctcccagtgaggagccctaagcattgacttctctaccctaaaactgtttgagagagggagagtgggccctggctttctcaagcatgggtcgggggttcagc

SEQ ID NO: 16402 - DNA, 48940 bp, Human
caagcttttgcctctacccatctgttcctgtagctgtctctcaagccttcttaactccttctctctcactccagtctctctctttccagtttaccctatagtaaagtacagtaccttgttaaagcttttcttttattatggcatttgtctgcaaataacaaaaaactttccacagtattcccatgacctatggtattctgtagccagactcctcagccggccgtgcaaggcccataccattcagttcactttggcttttccaaccttgtttctgagccttccctggaatgagccctctgctgtcactcccgcatttcctcattattcctgaaactgcagctcattcccacctctgtacctttgctcagggtgtgtcccaggactagttggttctccccttagttgaacccccaggtaatagggggtaagtcggcaatgaatgatgggaaacaggaagaatgaaactggaaggtaaaaagcaaatgtgatcaaacaaggcctaaatggtaatcaggtgggttaagaaggacttagttatcatcaaaaggcacactgcttggtcagattatctagaccagtgcttttcaaactactgtgcaggcaaatgtttggggaatcttgtaaaaatgcagattctgggagtaggtgtggggtagggacctgagattctgctttttttctatctctctcttttgagacagtgtctcactctgtcacccagactggagtgcagtggcatgatcttggctcgctgcaacctccacctcccaggctcaagtgattctcctgcctcagcctcccaagtatctggaattacaggcgtgtgccactaccccccagctaatttttatatttttagtagagatggggtttcaccatgtgggccaggctggtctcaaactcctgacctcaaatgatccacctgcctcagcctcctaaagtgctgggattacaggcgtgagccaccacgcccagccaggttctgcatttttaacaagttcccaggaatgcatgtactcctggttctaggatgactctttgagtatcaaggatctaactaaactctgagaagaggagccttatccaggtggttcgcacctgtagtcccagtgactcgggaggctgaggcaggaggatcgcttgagtccaggagttcgaggctgcagagggctatgattgcaccactgcactccagcctggacaatggagggagaccctgactcaaaaaaacaagaaaagagaaggtgccttgtttatatgacttagatatgggaataggaggtggtgggctgccattaggggactgtttatgtgtcatgagaactccacaagagtcctagactacagtgaagacatttcttgcattctgaacaactgaaaaaaatgtgtgatgatgatgaaagagggggtgctgaaaaccgaggacaaagttgagtgtataagcctgcagcttaaagggaagaaaatctttaatcctagaatggtggcggtgaaaatcgccactgggaaacgaaaagattctaatgttggttgggctgccggcctgtcattacacacacacaaacacactcacacagatgcacacacagaggggaggctggtatgctgtactttcctctgatgcagttggattatctcttttctcaaagggggaacctcttctgatctgctgtaacattcagttcagaatctgtgtccagcttgagtacaagtattggtacttaacctaacaaaacaataggaatcctttctgtagtgtgtatctccaaacagaagaacaggtgggaaaatattttaccagtgtgataaagttgactttttttaacagtttctctaattagcccattccttgtatctttggctaatcagtaactggccttttgattaagttgggtgtcatttcctcatggcttagcttcatgcaaactgcaagttatcctgattaatgattttaatgccatttccttcatcacagtaatttcccctctgcttttatcacagaagaacttctgcttgggtggctgaactctgatcttgacctagagtcatggccatggtaagttgtgaaatacctcaaccctatctggtgccagctgccaacaggtacagaatgtgggctcagcaactgttagcttaaacaaagcattgtttactcaacagaggggaaggaggaggacatgaaaaggcaggtctatttctaaacatcatttaaatttcttttaggggtggtaagcaacttgaccttgaaaactgattcaaagagagaattctttgaattcttttaacatcctgagaatatagaaacaagttgtaattttctgtctgcagaagcgctacatgtttattttagaacatttaaaaaggaaaaactaaaaattctttaggttctaccacctgaagaggactgctatcgatactctgaggtagccacatcatttcaggctcatcaagaggggtgtttcttaacaatatgggtgtgttggctgcctcctgctttagacagtaatcagacaccttggaccttggttatttgctctttggaacaagcatcgaattgaatccctttgagagttctgtaaagttcagctctgaggtggaagctgagcctcttagctgaaaacatggctgtacctaaggctggacatctgctctccttctcttgcccaaatacggtttctgaatagacaagtaattctgatccgtggtcttctggaggaagcaataatagaagtagaaatcttatacctagagaggaactggagagcctgacagcttgagatgccttcctttaggaagatgggtgtgtaaagtaaactatcctgaacaaagagtaatatactcttaatttcttttgcattagatattccagaattttcttcatgatctctgacagtcaaaggcttattcatgtgtgccccaaatctctcatgctttagtttaaaatcattttcttgctgattgattctccctggccatggagaatttttttaaaaatatttacgtatttttattttttatagagatgaggggctcgctatgttgcccaagctggtctcaaactcctggcctcaagcgatcctcccaccttggcctcccaaagttctgggattacaggcatgagccactgtgcctagccaacgtggagaatatttattcagaaatgcttatggtgcccctactttgtggcagatgtgggactaggactcagaattaatgagatgctcttcctgtcttcagcaggctcacagctttcctacaaatgaagactgtaatcaagtggccctttgtgtgctttccactcggagaaaattacctcagttgctctcatctttcctcctaaaacctgtttttctatcatgactattatttattgacagataaaggacattttaaaaagaaaatcacactatacagtcgcaacattggaaacaccaactatttgccattttttaattttagaccttactcatatgtataatgatttttaaataagagtaataagagcataaataatagttttgtagctttccttgtaccccacttagtataggaaaataggaaacaagttattcactctgatcttatgctttatctcttctctatgctaatgagataatgtaatgtttatattacatttcatatcattaaaattatttactctagtggttatgagtgttttaattttcttcttaatttatttttatttttattttttttgagacagagtctcaatctgttgcccaggctggagagcagtggcgcgatcttggctcactaccacctccgtcgtaggtttaagcggttcccctgcctcagcctcctgagtagctgggattacaggcgctcgccaccacgcctgactaattttttgtatttttggtagagacagggtttcactgtgttggccaggctggtctcgaactcctgacctcatgatctgcccgcctcggcctcccaaagtgctgggattacgggcgtgagccaccgcgcccagctttcttcttaatttttaaaaaattttccaaattctctataatattttttaaatcattgtattcaagattttaaaacatgttttatggaggtataattggcatatagtgaaatgcacatcctttaaggttactggtcgttaagttttgacaaatacatatatatacccacataacctactctcatatcaaggtaggacattttatcattcctagaagctcctccatgcccgtttcatattaactccccttcccaccctccactccacacaagaaatgcaactgctgttctgagtgttatcataagttagttttgcctgttctagaacatcctatatattgaatcatagagtaggtactcttttgtgtctgacttctttttctgggcattatattcttttgcaattcatccgtattgttgcatcagtagttttgttcctccattcctttttattgttcattagtattccattgtattgtactctgatctttttggcatgtatcttcttcattattaatgtaataacaatatttcatcaattgtgatatggcacctatttctatctattcatttttgtcattccttcctatatcctctctgtttcctttgcctgctatcacaatgggccctcttgggacagaattccctgtcttcccagaatggataatggcctattatactctgaaattcaatcaatatggatatttatcatgctaacagggaacacatttcttgatctctttcttggagaaaaagagtcattaagaatgctaactgataaacggaaccacccttgccaattcctctatcgattcaccttgttatatattaatcctaatccatagtagtgtcccacagcaacgcagtttgcttaaaagttgaatgcagtgtttgagtgccatccaaaaatttttcaatacggaatttccaaaagaaccttgtgaaacattcaactcagaaagctgtctcatgctggggccaacagccatgttggaattctgacagcaagtcaccaatttgcgtattactactgatatataatagaagaaaagaagtaaagtgcctctgttagtttcttgaggctgccaaaataaagtatttgcaaaagtaattgcaccaacctaatagcacaaactggatggcttagaatagtagaaatgtattgcctcacagttctggaggccagaaatccaaagcaaggtgtcagcagagccatgctccctttgacacctgtgcagaagccttctgggcctcttcctagcttctgggggtttgctggcaatcctagctattccttggcttgctgctgcataacttccatctctgcctttgtcatacggtgctcaccccttgtatgtctctgtcttctcatatccacatcttcttataaggacaccagtcgtattggattaggggcccaccctacaccagtatcacctcatcttaactgattaatctgcagtggccctatttccaaataaggtcacattctgaggtgctggaggttaggacttcaacatgtcttttttgaggggggagatacaattcatccaataacggggcccaaggaagtcgatgtcatacatgtctaccttcctctgtcagacatatagagggtgatgaccaagtgccaaatgcttaccatatccagaacatgaaagcctggtcttgcagcagagaaggcccgtgccctgggtacctgaggacttggatgggcttgatgtgggccactatgggcctgagaggtccaggccagggtggtctagtgcagtaagctcaagtcaggctcaccagagaactgtgctaagggtataaaaatcctccattcctttagatggcccatattacattcttggatccaattagattatcagaaaactttagctctattccacactgtttatgccaccttgtacaaatgctccatcctagattctgctttggcattaccccataggcttgtgtggaggtataatacaagaaatagataaaagaatctcattattttatttattatggaggtacagctgaagttctctttgatgatgatgatgatgatgatgatgatgtttctgagtttttgttttagtgtttacttttttctgggttttgtgctaagtgcattcctgtattatcctgtttctgtgagttattattcgcaacatacaagtgagaaaaatgaaacgtccccaggtcacacagctagaaagaggtaaagataagattcataccccactccagtgcttatgctccttcccactaagcttcttagaccaagcgccaactactccctccttcctcagcctctggacagtgctcgatcctggatttcctatgagctcaaggaccaccccttctcagccatcctttctgggctctccccttttggacctgtactgttggagagacccaggcttatcctaagtccctgttccctattttcactttctttccaggtcatttcatcaagtaccacccaaatgctgatgcatcccgactttattatactggatgtgacctctagacttataccgtataaccaattgtctttttgacaattccacttggatatttaatggacatcccaaacttaacatttccaacatagaacgtctaaatcccactccacactgccactctgaatctggtagtcttcctccagttttctccatctgggtaaatgatacccagctgctcaggggaaaagatttagagttatacttgattcttttctttcctcacctcccacgtcagtccatcagcaagttctgtcgcctttgctccaaaacatgtgctgagctgtctgttcctctgtttatttccatcttaactatttcaccctagtctagctcatatcccacccccagatcttggcccaggctctcaaatggtctctgcatctctctacagcagcccagggggatcttttaaatagataagtcagatcacatgtccctatctcctttctcaaaacctgtcggtggctttctactgtacttagaataaaatacaaactccttacctggtttgaagggctgccttgctctggccccagcccacccctctgatttccttcttttttatttttaattcatttatttaaatatttttattatggaaaactttaaacatatacaaaagtaaacagaatactataaggaacccctttgtgtacctatcaataattattaactcatggtcactcctgttttttgtctttgtttttttgagacagggtctcactctgtcgcccagattggagcacagtggtatgatctcggctcactgcagtctccacctcctgggctcaagagatcctcccacctcagcttcctgagtagctgggactacaggcctgtgccaccatgtgtagctaatttttttgtatgtttttgtagagatgaggtttcaccatgttgcccagtctggtctcaaactcctgggctcaagagatctgcctgcctcagcctcccaaagtgctgggattactggggtgagccaccacatccggcctgtttcttctttatatccacttcctcccctttctctccacctgtgtgattttgaagcaaacccaagacatctcatttcatctgtaaactatttcaatagattaaacctcttttaaaaatgaaatatcaccataatgccattcttatacctaaaaatgttaaaaccaagtcgttagtgtcatcaaatgtcaagtcaatgttcaaatttccatcgtctcataaatgtcttttgctttttactgtttaatttaggatccaaattatggtactacaggttcacattatgatcattgatgttccttttcatatcttttaaactgtagttcccttccatctctctctctttaaattctccttgcaatttatttgtcgaagaaactagatcgttttttaagtgctgtgtctgagagtctggattttgctgactgcaaccctttggtgtggtttaacattctcctttctcctgtttactggaaatttgtttttggctctagaggcttgactggattcaggtttgatatttttcccttttggggagaacagggttccacgttggtgtagtttgtcttccccccactccttgcccaccaacttgagccacactggcctctgtcctgctttccctacaaactagttccggcctcaggacctttgcaggagctgtttcctctgcctgtaacccttgcctccatctttgcatgagcagctgcttcatttcattcagctcttaacctcaatgtcactcctcagaatgggtcctgcaggacctctctatctgcttcacagcaatgctcacccctaggcactttatggaattgtgaattgttggcttgtttactgtctgcctcccatgagctagagcatcagtcccggggagcaagagcttaatttttcatggtcactactgtacccctagcacctagaataccatctaggctatggtcagtgctcaacaaatgtttgccgaatgagatgcctccgtgttggtgagaggctgcctctcagtaacatcactctcttgtgtgctcaggcaaccaaaggaggtactgtcaaagctgcttcaggattcaatgccatggaagatgcccagaccctgaggaaggccatgaaagggctcggtatgtgtcctgctggaagtgaatcctcctgcgtgcattgcacatcacagggtcacacaggagggtgccatgtctgctggccatcacgtgggtcttcctttaataaaacacaagggaggctgggtgtggggctcatgcctgtcatctcagcactttgggaggctgaggtgggcagatcacttgaggccacaagttcgagacaagcctggccaacatggcaagaccccatctagactaaaaataaaaaaattagccaagcgtggtggcacacacctgtaatcccagctacttgggaggctgaggcaggagaatcacttgaacccaggaggtggaggttgcagtgagctgagatctcaccatggcactccagcctgggagacagagtgagactccatctcaaaaaagaaagaaagaggctgggcacggtggctcacgcctgtaatcccagcactttgggaggctgaggcgggtggatcacgaggtcaggagatcgagaccatcctggctaacacggtgaaaccccgtctctactaaaaatacaaaaaaattagctgggcgtggtggcgggcgcctgtagtcccagctactcaggaggctgaggcaggagaatggcgtgaacccgggaggtggagcttgcagtgagctgagattgcaccactgcactccaggctgggcgacagagcgagactccatctcaaaaaaaaaaaaaaaaagaaagagggaaagaagggaagaaggaaggaaagaaggaggagagggagggagggagggaaagaaaacacatggaacaagttgagataagttgggacaaactggatggggaggggcattagttcttcactttaataaagaatgataaatttaatatactcattatggatttcccctattgtttaaacctgctttgaattacgacatcatgaatctgcatattaaattttagaaatgtatttgttttccaattagtgctggtgtgtatatggtgccacagatttacaaagcagtttcacagacattatctcattggatatatgcaacaacctgtgatttagtgaaagcagctattcctattgttattttagccccattttacagatgtgaaactgagacccagagaggccgagtaactctcaccaagtcgcacagtgagtgaaactgagccatggctcacactaggcagatcccatctcaagctcggggtcatcagcactaagtccacattcttgccttgagtccgtctgcttgttgctgtggtgatagacacagctgtgacagcaccgacatgcaatgtgtggaatttaatgtgagaaggctggtgaagcagccttgttgtctggggtaaatactaaggtttttggtgtcatggccaaggagattgaggttgcagacagacacacacacagtgagtttggagcaggagtttaataggcaaaagaaaagaacagctctccatcacagagaggggtcccgagcgggttgccaagtggtagtaaaattgtcagggtttttataaatgggctactgaggagggggctcatgagcagaggaggtcttatcctcctagggtccagtggtttggttgggaccaggtgtgccttctatatagagcagagtttttttaaatcagctcttatcccattctctgaccacatagatggactcttattctgtgtttctttgtcttgcttatctgggagggagagtttctgtgtctgttcccacacatcttcttgcagctgcagacatccgcccaagtctgtttttagctcctcaatcttactgcgcctaaagggaaggaatatgcttattaagacccactgttttactggggcccactgtgtaaatgtgaagtttggtgattacccaggagacttccccctccctttctgtgctcaagccatcttctctgtgttttacagcctgaactttcaggctgcttgttgttagaagagaagtgctttttttttgaactgcatgaggttagaaagggagctatttttgagctgctttttgttaaaaggaaagttttctgctggggactcactttaccctaaatgtctacctaaatcatttctttctgcctcctataacatatttcccccctcaggaatgaaatccataactgctgctaggggaaactgggtgacgatttcttctggctacttcctgctggagagtggcgttgtgtggggaacagcagctagggctcctcctggggttgatttaagggtccctcgtaggagggcagtttcattttcggctccattttcagcaccatctgaagcttgatggtttctaagcgagaagagataaacttcacaaggaggtttagaatataggttctaaatatgagtattaagattactattattaatgggggcactataggccgtaaccatgacaacagagtttgtttgatacctgtgagccattcagatgggttgtgctgctgtaagtgggtatatggggcttggctttgtttagcttccttggtcttactttcccaaaaaagggagaaaccctggggttctagtttacctggcaggatttgtaggataattgcccagaactagaacatgtttccagatttttctattaccgatgcctttctgttttctctgagctgcagccagagattcctggttggttgacaggagtaagcagggttagtttaaaatgtaggcaagaacttaaaaacaactgatgggactacaggttaataacagatgtatgataagtcttaaaacataatttctctttctctagtcctcatttttgttaaaaataatctatgataggactgagttgtttgcaaaacagacttcagtcctatacttggcctaattatttgcataaagtacagcaagaataatcatccttacataagcctcttagattggctttgatggaaccttgttccatgaggaattttagataggactttttaaagccaagcccagccataggtttgtacttttaaatacctgtgagttggataaatttttttccttcttgaggttccagaagcatggggttcctaggcctgttagaaagtgacattctttactcactgcaggtcaggaaccctgtatggagactgtgtagacagatatgaggccagttttccccaggggcttttattggctcagcaagttaagcttgattccttaaagggaaatatacccttctagtcaaagccttggtaaaacaaccagtttttccaattgtgttttgttgcaagagaaaatggattcttgctgcactgattcaaacaactatattgttgtaatttaagaatatttataactagtttccaaattctacaggaattaggcagagagacataaacatgctccaaactttgcctatagtagtacactttgcttagttatcaaaggctgtagctagcttaagacaagtttttttgactctaaaaaataaaataaggattagccgtgttctaagaataagtgaagaatattgctttagttttctattagttcagttcattccattaacttttgttttgatatttataaacattttagccttttatgagtcccatacattttttggtcatgacaaacctgcattggagagaacttgttaaagtcccatggcttgattatgaaccatcttttgaagagaattaaaacaaaacaacaattgtctgtaaatgacaaaatgtccagtttggatacagtcagaaatacaattgacaaagaaatttggttatttttgtgtttttcaaaaacccagcataacaaccttaattgtaatagcacatattcagacactagaaccatagacatcccatacagttttggaacacatgttaatattattccctaaaatataacctgaagagtattagacatcattttggcaattttatgtacctcaacatgttaaataatactgtttacctctcttctagatgcttcaggggtcctctgcagcacccaaaagccaggggttaggaaagacagacttgagactaaagtttgactttgggaagcctgttaagtatatttaaaatttaaaacacttgatattatgaaatagaattttagattaccaaaagtttttgtttttgccaaaatgttgagccagaaatttgaaaaagcaaaaaccattcattagccttttctattccatgaaaatcccgtgttaagagagaaagttaaattttacccttgcattagtttgctattaatgttaaacttaattttaaatgaaacattatagacaatcctatttaattttaaccagtttgaccatgaagtgagattttcacatacctgttataacccttgacaagttttgctaaagagtagattagcattttaagaaaaccttgctgtgcttttatttcagtgattaatttacagaaaaaaaccatataatgcccttttgcatttagttaatatgtttacacgcagtgtttttttttgcaagatttttacagtttttttttacaatttgcttaaaccttctactttaagacaattctttatttctaagcaaaatatacatttccatgccctcttataatctttaaataaaaacatcttttactgtttttacacactttccatgtaattccatgttcagtagtttcaatcacatgttataatggtaacttttagtaatttttaactttaatgtaaaacctgttaggttgttttaattatgtgctggatgcagataatgtttgactcctttcagcatagttaggggcttggttgcttccgtatgttcccaggtgctaccaattgtgaagcaggcacgttgatagtttttaaaggctaaataaagaagtagttttatggccagtcgcaatggctcctgcctgtaatcccagcactttgggaggccaaggcgggcggatcacgaggtcaggagatcgagaccatcctggccaacatggtgaaaccccgtctctactaaaaatgcaaaaattagatggatgtggtggcgcgtgcctgtaatcccagctactcaggaggctgagacaggagaatcacttgaaccagggagtcagaggttgcagtgggccaagatcgcactactgcactccagtctggcgacagagcaagactccatctcaaaaaaaaaaaaaaaagcagtttacaaccttaaaacatttagcaaactagtatttgacctgcataatttagaccacatttttataccttgaagacatttgtattttaccaataattcctaagactctttttatttttaaagattaaagtcacatgaactgaaaggtaccacagcttttacttttcccttaaaaatgtttgatttaagcgcttatttttcttaggccaattaattagagctcctttttttaataggcattacacaagtaacacatatataaccacacaaacagaagaagatccagcagttataagattttgcatttgccaatgtcccaattggattattggcctctgagtgaggttctttcagaacagagctaggaatacagcttccagggcctaataagcaagcatagccagaagacaaagacgattttgagaggtatttattcacctttaattccaggggctccgaggaaaacagatttttcctaaaatgggatttgtggtgcattttctgtttccccaaggagtcccaggccaccggaagccattctaggtgcaccaagagtggcaagacacagtaaaaaaaaaaagcaattcagtcaactgagaaaaaaaacgtttccagatttatgaagatttatttaagaagatttatgaagagaaaaacataaaggccttttaaatatacccattgattggatatccacttttaattaagctgaatgctctttaagaaaatcctttttcattaattaaaactttacaaagaatgcaaacagtaattcttattatttcttttacccagtttgctccacttacctgttcacaatcatgtttaggttctccagttttctctgggagaaagtggctgggctcaggcaagggcaggttttcagctggactgcagatccctttagcagcaaagcttggtatttgaggaggcaattgtttgtcagccagagactttccttagaggacaacagtcctgttacattgtgtggggttaaacagttatttcccatggttaacccagtggcctctgacaccagcaaagcctccactgtaactgcttggaggcaggctgaccatcctttggccaccaagttttaagttccttgcttaagtaactcactggctgttgagctggacctcaagccttagttaaaacttccagggccatttccttcctttttgttacatagagactgaatgctttccccatggaaagactgagggctggtatgttatgttatattatgttatgttatattatgttatgttatgttatgttatgttatgttatgttatgttatgttatgttatttttgagacggagtctcactctgtcgcccaggctggagtgcagtggcatgatctcagctcactgcaagctctgccttccgagttcacgccattctcttgcctcagcctcccgagtagctgggactacaggtgcctgccaccatgcccagctaattttttttgcatttttagtagagacggggtttcaccgtgttagccaggaaggcttggtttagctggttaaaggctttttgagccttaggttcccaaaagagagaggggtgagttttaactgtttgagtttcttttatgaggtggtataaagggtgagccatttccctgtgcccaggtactcacagtttacaaaatccagtaatgcccaagaatttccctaactatcaaaggaaatgggcctaatcctttcctcacctggtgctctggtcccttctgataagaccagaactaggtactttactgaagtctgacagagctgagctttggattttgagactctatactccctttcagctaagaaattaaggagagtcttagcatcttcctgagccttccttgattggggcatagaggaaagtgttatctacatactgcaagaccctgacctgaggacgggaaaacttagaggggtcctttgacagtgcttgtccaaatgagtgagggctgttttgaaatccctgaggcagcaccatccatgttaactgtgtggtctggccggagggatccttacaggcaaacaggtattgagagtcaggatgtaacggtatgcagaaaaaggcatcctttaaatctaggactataaaccatttagttccttcaggtatttgagtcagcaaggactcaaacggatgaattgggactatggcccattaatgaggcagatgtcctgaactagtctccattccccattgggtttttatgctcctagtatcggggtgttgcaaggactgttacagggtctgaggaggccctgcatttttaggttattaataatagcttctagccctttcctggcctctggctttagaggatattgtctctggttaggaaaagaagtgggatttttaaggcggatctgaactggcctagcagttttagcttgacctattcttccttgagttgtccacacttctggattaatgttggctttcactaagggaagacaaagagtttgtcctggggccatgaggatgctggcccccatgtgggctaaaatatctctacctagtaaaggagtggggggactttcaggcatatttaagaaggcatgtgtaaataataagttccccccaactacagtgagagaaatattgggttagagtctttcctgagacacccaccatggttgtgctatgggaagaggggaggccttgattggacaggagaacagagagactggctccagtatccaggaggaagcccaccctccttccttcaatttccagaatcacccggggctcctgaacagtgatggcagtctgagccactggagccaggggtctgagccctaggacctgtcagtcctgccggaccatctgtgagactagttctggacctagtgacctccatatccaggggcagtttaatatccagtggtcttcaccacacgctggacagggtcaaggtggctttttcttgttgcctgggcaattcttcttaaagtgccctggcttgccacaccagtagcaattagtggatgcttcctgaggatcctggactctgcaagcctgcaaagcatctccttgagccttagtcactttctctttttctcctggggctcctcccagtccctatggtaaaagaccaaggtggccaccttcaggagatcttccaaggtactatctggtcctatagcctgtttttgtggtttccttctaatatcaggagctgcctgctttttggctgcagtgagggtttgacttagaagcaacataacagctctccatgtgaagtcaaacacttgagttagattttggaaggtctctgtctacctattagggacatcagaaaatcggcgcaagtctccctttatttttctacagtcctgtaatgagaagggaacatgtaccctaggggtgccccttccatctggcatttcttgtaggggtagaagtgaagctggggcagtggggagctttggagatggtgaagctggagaagctgatggtgcagttggagggggccccagattaggaaaactagaaggactggggcacttagaagctgcccccaatggctcctgcaaaacttgctcttctaacttaggggaattactctccacagacccgcctgatatgattgctaagagagctgagtcaattgtgcagtgcttgctaacgtctgggttgtctcgcggggcaaagaaagcctgtgcataggggaccttggaccatttgctctcctgtctacagaaaagatctaattgatggataagattaaaatcaaggttcccttcagctggccatgtctgttcatccctgagacagtaagaaggccatgcccttctgcaaaagaaaatgagctgctttttcttcaaagttttagggtcaaaggactcccagtgcttcagaatgcactccagaggagtgccggctgaagatggcttgttacccatctgcaaaagagacaagaatagaggtttcctcggtctcctggttcttttcaatgtgactcagggaggaggggacacagtaggagagtcctcctggctgttctccctccttggtccccgggtcccagcaccatagttgcagccccatggttgcaggtgtgacccccaagcgtaataccagaggacctaatcaatgggctagtcatgtttacccatatgacctcagtcctctgcctaataattgggtaattactctctgacctcctagacctgtgtgacctgtgtggcttcttgataaatggatctccggagagataatgtaacacttgcatttaagcaaggccccttaatagagggagtgtactggaatgagctttatactctgctattatggactggactagaggatttattcttaggtggtggttccggttaacttccagacataaaatcccctttctatttagatgccattctagttgtaggcagaatgggtgtcttcagagaacgtaagggtcaaatggtggccttcctgctaacagagagagtactgagactaaaatttggttttggaggacatgttcctccttgctgctgaaagcagagttctcccacttgcagagggggcataaggtttggtctctattagagggatgtaaaagggaggagaactgaaaagccagagacttttagcaaagggcagacaagattcctcatggagaggattcccattttactaggtggtgctagtggaataccaggcagtaactttgcctccatatgctctttaaacaaaggatggagagagaagtctgacctgtggcatgctgtccccacagcatacctcctaacaggagaaagttagtttgcctcatagaggggctatccggtccgactggacagtgctggttcctcacatgggaaaagaaacagcctaagtggacagaggggcatttactggggggaaaataacctcccacccaaccccaggaagtattatcattaggagttaaatagtctttgagatctggatcatggaattcccctgtctgtaaaaagtcagaaaaacagcaatcccttaacctgcattcctggttactacggtggttgctaaacctgcctaattgaattatttcctgggctataaaaattcctgcagcattgcatacagagaggagatgggagacatggtgactgcagaaaggaaaggaggaaaataagatttgcaataggaaaacttggagatcctatggctgacacccagtcaggcaatcagaggctggggtcagtccaggagccttttgaataacaccagggtgtggccctggccagaaattctcagttgctccaggacctattccagccccatacaacaaccaggctttctgtgaaaagaaactagtttggacacagccaacattcccggcaccctgagggcaggtcctccccagcaagcctcacatctgagtcttcaagactggtggccagcccttgtggctccttaatcagctgtcagatgcccggtgtttttgatagttatttgagagaataaaaacggaggacaagaagcctcggaagtgaaagtagagtccgctcctttactcaccattctgatgaagtcaccttcaaatcccagacgagccctcaaaatgaagcagccttgttgtctggggtgaatactgaggttcttggtcacacgaccagatattgaggtcaaggacatgcacacacacatcgagtgagtttggagcaggagtttaataggcaaaagaacagaacagctcacagtcacagagaggggtcccgagcaggttgctaagcagtagtaaaaatgtcagggtttttataaatggtctagggaggaggggcctcatgaggaggggatgtcttatcctcttagggcctgatggtttagctgcgaccaagtgtgctatctatatagagcagaattttttttatcagcttttatcccattccctgaccacataggctgactcttagtctgtgtttctttgtcttgcttatctgggagggagagtttctgtgtctgttcccatacatcttcttgcagctgcaggcatccgccccatgagtctgcttttagtttctctatcttagtgcacctaaagggaaaggaatgtgcttattaagacccactgttttactggggcccattgtataagtgtgaagtttggcaattacccaggagacttccaccccttcttctgtgcttgagctgtcttatctgtattttacagcctgaactttcaggttacttgttgttagaagagaagtgattttttttaactgtgtgtggttagaaagggagctatttttgagctgctttttgttaaaaggaaagttttctgctggggactcactttaccctaaatgtctacctaaataatttctttttgcctcctataacactggtagtgtcttccagcatgctaccctccagttagctccttgggggccaacaccttcatgctgggtaggtacagtgattctatgtgcaccacaaactacctggcctagcctctgcccccaagaccttgtctcagtagacttttggccagagaagtatcccctggttcttagctgctatttagaatctccttgagatttgggtaaaaacacttgaccatgagaccatctttctatccaaaaagaattcattttactcagcctcaatgttgctaacagtaacaacaaccgtagcaataatagaaaatgtttattaagctctactatgtgtcagacatagagatagatgctttccatgggttatctgttttaatcctgacagaagcttgtcttactgttgagaaggtaaagtatagtgagtgaggctggctgacttgcccacggtctcagaactattaagtggtatattcaggattctagataattcctagaacactttcctttcatctttgcatgatcagctgcctcaagtctgattccagagctggagttcaagccactgttctatgctgctgcccatctctgaagagaacattgtcctgaatctatgtatcttcttcttttccctttttcataaaaagagaaaggcataggacccaccttttttttcagtttatcctaattctttggttacaaggacaccataattcaaaatgtagcccatgttacattcagaattatcagcataaagggtgaggagacatttggcacaaccaaccccttttcagtgcctgttatgtgtgggccaatgcaaggcagactgttggagaagacaaggattataatccctagttcttgtgttcaaatagtctatgaatactagcacagctaaggcatgcacaaaaataactatgattaattcataatataacagtgacaggaggggcacaaataagatcccactggggttcaaagagaagagatcacatttcacttgggggcatcgggcaaagcttcttggaggatgtagatgttaaaatggaccttgggagatgattgagtttctgtaaacagaattaagggacaaggtgtttcaggtgaatggaatggcatgtgcggaggtctaggggagtcatggtaaatccacagaaaagtgtcttgcagcagtgaagtggcctcgtctggggtgacacccatggtttgttgtctcacggccacagatatcaaggacgtagacacacaaagagtgaggttaagagtggaagtttaatagggaaaagaaagagactagctctctgctacagagagggattccagaaaaatgggttaccaattcacggtgaaatgcagaggggtttatagatgagctgtggcaggcactgggggttggggggctgatgtctgatctacatagggcaccaaaaaccagttagaaacaggtgtgctatctgcatagggcatgaatctctgacagtccctaccccagtcttttattatgcaggtgggttttcagcctgagctgtactgtattggtcatttctttcttactgtacacatgctaacaaaaaagggaaggtggagtttccatggtggacatgcctggcccccaggtagcccttttctgttggtacagcggccagcattcccttgtgcaagctttcagtttccttatctacgtttgtagcttgatttttcaggctgctctttgttagaaaaaaaaatgattttgggggctgctttttgttacaagggaagttctgccaaggactcttttgccctcactatctgttttttgttttttttttcttttttgagatggggcctcgctctgtcactcaggctgtggcatgcactggcatgatcttggctcactgcaacctccacctcccgggttcaagtgattctcatgcctcagcctcctgagtagctggaattacaggcccccaccaccatacctggctaacttttatattttaatagagacaaggttttaccatgttggccaggctggtcttgaactcctgacctcaagtgatccacccaccccagcctcccaaagtgctaggattacaggcatgagctaccacacccgacctgccctcactatctgcttaaacaatttctttctatctcctgtatcagcaggaggtacttgcaaagcaggagtaggctggttgggagctttctgagaaagcaggtaccagaaggaggttttaggggtgctactgagaaagcgcccataagaatcacagacatgcgggaatgacccacaggcactggctgggaaacaacatatgacagaatcatgatgctaaatggagggggttaagaggacatataaaccaatagactggtaatgaagggggtcaggagcctggagtgcagcacagttgggtaaagcacaatatttcaagagctgagtccatgaatttggctgcctagtgtccttttatgtggctatttacaatagtgaatgggatactgtagagagtctcaaatgtcaggctgcagtgcctaaagtaaatccagcagatgatggggagccattgtgtatttctgagcaggggagagacattgtgagagtttttctttttacaaaaatgaatctggcaagactctgggaagaccaaccaggagttaagaatactagttagcagacatctgcacttgtctaagaagaaaccctgaaatcttgaattggaatggttgtgataggaaataaaaagagtgaaagaatgcaaaagaggctgtaaagcaacattttgcatgaccgtggacttgaatgaagaggaaaggagagggtaaaaaaatcaaagctattgggctgggtgcagtggctcacgcctgtaatcccagcactttgggaggcctaggtgggcagagcacaaggtcaaaagatcgagaccattctggccaacaaggtgaaaccccgtctctactaaaaacacaaaaattagctgggcgtggtggcgtgcacctgtagtcccagctactggggaggctgaggcaggagaatcgcttgaacccgggaggcagaggttgcagtgagccgagatggcaccactgcactacagactggccacagagcaagactctgtctcaaaaaaaaaaaaaaaaattgaatctattttgaggatttcagcttggcttgactggggggaagagtgatccctttcacagaaacagggaatgaacaaaaggtaatgaaccctctctgccccttccacaccccctcctagctgagagtgccaagggagaaattgattgttatatggattgtcctctcctttttaaaaataggaacacggctgggcatgatggctcatgcctgtaatctcagcactttgggaggctgaggcaggtggatcgcctgaggtcaggagttcaagaccagcctggtcaacatggtgaaacccatctctagtaaaaaatacaaaaaaaaattagccaggcatggtggcaggcacctgtaatcccagctactagggaggctgaggcaggagaattgcttgaacctgggagggagagggagtgagctggactgcactccagcccgggtgacagagcgaaactccatctcaaaaaaagaaaaaaaaaaaaggaacagaaagtaggtccccaaggtatgtaaacttaaagttctatagcttcctctccacacctcacatctttttgcatctctaaccttgccaaggataactaaagtttggctgtattttttcatttctccctgaaatattttcaatagaatcatttctgaaacccattccaaccccccatacagcacaaacaacgaggaaacagaagattcaccaaacatttatgaacagccagctgttataaagacaagggaccaatctgaaaaatcagaataaagtctccttgttaaagctgctgcaagaaacaggcaagcaaaacttagaacatttttaatttgtaatttttgcttaaagttttggtaagatgttgtatcatggtaatttgtcagcagttctaaaagggaaccatttgtgttcaggaaagatagcttagaagtgcaaaacatagttccagattttaaaacacagtgaatgcagtaacagccaatttaaactctgcaaaatgccaaattggtgaattaacagacaagtttgaattgtttcaaaactcagaggagatgataaagagataaaaacaaaaaaaaaggcaagaatatggaagagagagagaggagattcaaaagacatgaaaagaattctagaggagatggctgggcgtggtgtctcacacgtgtaaccccagcactttgggaggccgaggagggcagatcatttgaggtcaggagctcaagaccagcctggtcaacatagtgaaaccctgtctctactaaaaacacaaaaattcgctgggggtggtggcacagccctgtaatcccagctactcaggaggctgaggcaggagaatcgcttgaacccaggaggcggaggttgcagtgagctgagatcgcgccattgcactccagcctgggtgacagagtgagactttctctcaaaaaaaaaaaaaaaaaaaatattctagaggagagaaaaaattactccagccaacatttattaaatgtttagtaagtgctaggcatttaattatattaacacttgcagcagcctatcgagggaaatcactgtcatcattcacatttgcagataaggaaactaatgtttagaaagttaaccattttcttcagtagtaaacagctaattaaaggagaggctaagtcccgaacctagcatctgtttcccaaaaagtagacaaaccctctgaataagggcctcttttcttagaaagccctctgcatgtgtttgggtaactccaatgtccacagaggaacctgctttctcattcctctctcaaatcacacttacctgctgtctcccttcttcccccaggcaccgatgaagacgccattattagcgtccttgcctaccgcaacaccgcccagcgccaggagatcaggacagcctacaagagcaccatcggcagggtaggccacagtctttcctgctctgtctggctgacttcgcagcaacaggaagcagggcctcttcctgatctaggttcccgaagtgaccttgtgttttaaaagatcgatcctttgtcttgtttaaagatgttcttgaggccaggtgtggtgggtcacacctgtaatcccagcactttgggagaccgaggtgggtggatcacttgaggccaggagtttgagaccaacctggccaacatggtgaaaccccatctctccttaaaaaatacaaaaattagccgggcatggtgctgagcacctgtaatcctagctactttgtaggttgaggcaggagaattgcttgaaccaggaggtggaggttgcagtgagccaagatcatgccacttcactccagcctgggcaacagagacagactccatctcaaaaaaaaaaaaaaaaaaaaaaaaaagaatagcgattcagctccttcttcgtcaattgatcttaaacaagttcttaaactctctgacccattccaggaggaaatgtgaataaacatctttagaatttggtccattttccaaataattatatttggaaactatatctcaggaattgagccttaagaaatagtcatgaatgatcacaaagatacaactaaatgccttatgtatataacagtagaaaaatagaaacaggtgactagttaaagaaattaggctgggtgtggtggctcacacctgtaatcctagcactttgggaggccgaggcgagtggatcacttgaggtcaggagttcgagaccagcctgaccaacatggtgaaaccccgtctctactaaaaatacaaaaaaattagctgggcatggtggtgggcacctgtaatcccagctacttgggagactgaggcaggagaatcgcttgaatccaggaggcggagtctgcagtgagtcaagatcgtgccactgcgctccagcctaggcaacagagcaagactccatctaaaaaaaaaaaaaaaagaaattatgttgcacctatctatagaaatctccacagctgctaaaaaggttatcagtgaatattgacttggaagtatattcaagacatattgttaagtaggcaaatacatttacatcggtgtctacaaacatattcacctcaaagttcctttacctcttaaattttttaggacttttggttttgtgggttatatcttttgatatttgccctattagaaactaaaactgagggcatttaaaaatagatatttgttaacttagtaaaaataataagtatattgtatgttactgtaaataacattttaatgaaaaatagctatatatcccaaaacgaaaaaacatttagtgagaagattggcattgttttacattttgcagatctctttaatgtctggcttaatggaagacagatggcttctcatatctatttctacttcaatttgttatgatatgtggttttggttggggtatatgaagaaaatctggcttgtacagatatgtacttgaaaatggggggagtatttgaacagacagttgttgatgcacagacaatgtcaaatagccttaggaaaaccccactgtatgcttgtggaagaatgacagtgaaaaggcaaataacatctgagtgttattctgaggatagttttgacttgcaggccccttgaaagggtcttggagaccccagacatccctggaccacacctggagagtagctggtctaatttgctatagcagttaagcggagctactttcttgcattgcaggacttgatagacgacctgaagtcagaactgagtggcaacttcgagcaggtgattgtggggatgatgacgcccacggtgctgtatgacgtgcaagagctgcgaagggccatgaaggtctgtgctcttcctctcgtgctcttggtgctgttggtgcaaacgctgatgtgctttcttaagaaactgtcacccaataagaaagacatggaagcaacctaaacgcccatcaatggtagactggataaagaaaatgtggtacatgtacaccatggaatagctgtaaaaaggaacaagatcatgtcctctggaggaacatggatggagctggaggtcattgtccttagcaaactaaggcaggaacagaaaatcaaataccatatgttttcacttacaagtgggagctaaatgatgaaaacacatggacacatagaggggaacaacacacactggggcctgttggaggatggagggtgggaggagggagaggatcaggaaaaataactaatgggtactaggcttaatacctgggtaatgaaataatctgtacaacaaacccccatgacacaagtttatctatataacaaacctgcacatgtacccctgcacttaaagtaaaagttaaatttttttaaaaaagaaagaaactatgaccaaggccttctgagagtagcaggtgtaaagtataggagattttccttcatttacgacaacttgaaaacatcattactttacattataccaattataatttaaaagttcttttccaaaaagttagggaatcatttgctccttcctgtggctcaatggggagtgattataattgtcgcttttagtacagctctagagacttttagctatctctagacagctaactacttttgagatatgtaactttatgactgacactttaggggcctccaggtctactataggcttacttctggcaaaagagttcctggcttccctagatgacgtacccactgtgccctagcctggtctgccaaattttaatgaccaagtatgtaatgcaaatataaatggtccccaccttaggatggttctacttaaaaattttcagtgtattgtactcctcatcataagtcgaggagtacaattatcctcctcaaccatgtcaataaatactcagacttgtggaaggttctgggccaggctctgggaaagcaaagaggtgacaaagtctttgccagaaaattctgcccttcagaggaagagagcagaagaggtcaaggaaaaattaagtccccagagggcagaaaccatacctacccgggcacagtaacgaacacataataaacagcctagaaatgtttgttattactcataattgttacggcaaacactttgggtttcgggtgggacaataaaagtgaacaaaccctgttgttagaacgcagtggattgtctttattctctgcagattcatgacagatgtattccttctgtgtctgggcctcagctttgtaaactggctcatatagccctgtcctctggtttcttgtttagggagccggcactgatgagggctgcctaattgagatcctggcctcccggacccctgaggagatccggcgcataagccaaacctaccagcagcgtacgtgacatccgcagtggccctggctgaggtttcgctgtgattagagaatgagggtagcagcgggttgttgtttgctgattagacttttcacagaacgctgagcatgagggatcctcggtgccaagctctgcttcgagggagatccctgtttagccaaatggcggtctgttggctccttaagatttctcaggtgaagatgacactctattttgcctacccagtgcagtattttattaccctaaaagttggaaagttgttccttattatcagacaaagaatctaaggtacttgttcaaaagtggtggcaccagcagatcttagcattccaaggaatggtctggaggggccgtctggcccaaattcttcccttcagactggactgtacgtcctccagccaaatcagaatgacagccattcactcccccttagagacctccagagggtgatacgtatgaagtgcctttaaaaaatgcctgactttttgccctaagaatataactaaaaatgcacagaggttcagatctcacagtgtttattcagcattgtctacattagctaaaaatgcccaagagtagcagattgtctaaacaaaatattatacacttacacaatgaactattatgtagtcattaaaacttatattaaagagtatttttttcttttatttagcctttttttttgagacagggtctcactctgttgcccaggctggaatgcaatggccccatcatagctcactgcaacctcgacctcctgggcttcagcaacccacccactgcagccttctgagtagctgggaccacaggtgtgcgccaccacacccagctaatttttgtattttttgtagagatggggtttcgccatgctgcccaggctggtctcaaactcctgggcccaagcaatctgcccacctccgcctcccgaagtgctgggattacagatgtgagccactacacctggccaagaatactattaaaatatttattaaatggtttggtatatgtaagtgaaaaagacaagccataaaatagtatgctatgatcccatttttaaaaaattaacacagttaataacacagtattttttaaataaatgaaaataatttgtgcatgtgggggaaaatgaggaaggatatttacagaaatgttgtcaatgattcttatttctgggtgattagactgcagtggagttcctcgccttgccccttctttttacttatttgttttttcctaagccttctgtggtcaacatgtgttacctttatagaaagaaaacaaccacaataagagctttgtgggaagtgttcagagcaggagattctaaaccttaggagtctggatttagcaacccaatccccacatctgcccaatgagggttttcttccctgagggctgtgaagggctggagcttctcttttcgtttttgctttttaaaaattaattatgaagaagtgatttttaatttcttgctgaagctccccctgcctattttttttgacacaggatctcgctctgtggcccaggctggagtgcagtggcatggtcatggctcactgcagccttgacctccccaggctgagatgatcctcccacctcagcctcccctgtagctggtactacaagcatgcgccaacatacccagctaatttttgtattttttgtagagatgggggttcaccatgttgcccaggctggtctcgaactcctggattcaagcagtctgccctcctcagcctcccaaagtgttaggattacaggcatgagccactgcgctcggccgtggagcttctcatggataacctgtcagaacctcccaagtgagagacgtggcagagaggcatatgctaggatttgcatttgacagcgctccaaccccagccccacctcaaagctgggttcagaagctcctatctggttgctttccatcagtgaagcagcagaggctgctccacagctgtggttccctctgtgtcactgagaaccacgttcagatcggacccctgggtggcaggaagcacagagggaggatttcagacccagctttttcaaccccacattttaagaaacaggaatatcttggctgggtgcggtggctcacgcctacaatcccagaactttgggaggccaaggcaggcggatcacctgaggtcaggagttcacgaccagcctggccaaaatgacagaaccctgtctgtactaaaaatacaaaaattagctgggcatagtggggcacacctgtaatcccagctacttgggaggctgaggcaggagaattgcatgaacccaggaggcagaggttgcagtgagctgagatggtgccactgcactccagactccatccagcctgggcaacagaatgagactccatctcaaaagaaacaaaacaaaaacaggaatatcgtgtgacaggataagctgatcttgaccattttaccagagtttagtttttgaaaaactgtgtgtggggtgaaaaaacctcatgataagctgcttccataagcaggctggtcttgaggggacagattgctctggagtgtgacagggcattgggcaagactcttaattctgaagtagctaatttcactctcttgctagaatatggacggagccttgaagatgacattcgctctgacacatcgttcatgttccagcgagtgctggtgtctctgtcagctgtgagtgactgcttctgatggggggcgggttttatcgaaatgtccactctatcccctttgccagcctttctcatcctttcagcccctgacatgtggatattccccaggtagtgttctcagacccctctgttcctttatcttatttctccttcagagactctggctaatcctgcctgcccattttttctactttaatttgatatttacaagtacctaacacctgccaggtccccctgtcactcagtgcattgagagttatgaagatgattcagaggcagttcctgggccttaagagtatatattgtcataagggaatacatcaggtacacagttgctagaaggcatgaaaagattacatgccaaaggagaggcgcataggaaaaagaagattcaaggagaaaatttggttgtagaaacaaagaaaagccttcatgacagagatgctggttcagagaggacttggaggattactagaatttcaagaggcagagacgtgggtgggtgtattgcagacaggaagaacagcaagaataaggcagggaacatggggttcagggaacaactgggtgaacagttgggctggtgattctggaaacagggtgggaggataaactggaattctatgttgggagcagtttacacttatttatttgggagcagtagatgacgtgatgatgacaacgatgatgggagtgatgtgactggagctgcactttcagaagagtaatgtaatagtgacgtgtaggatgaacagtggagaggaactggaggctggacgaccaggtaggaagctacctggaaaattccagctggaaaataaagcaggactgagctaggtggggcagggttgcctgaaaagggaagctggagacttcagacatttcacatcacttcccaattgcatctttatccccggcctccttcctgagcttgagactctcatttcacattgctttttagatgtttcattacagatattctactatccccttaatgaactgaaccagaactcattttcccttcaaaccagctcttcttccggacttgcctgtttctgttaatattgctgttgttcctcctacacctaaagaagcagaaccctggaaatcatctccaatttccactttgctcttgtctccaatatttacttagtaacgcctgcctgtgtctcatatttctttcccactttctcttttcctcccatatttaccactctgatgagccatgcctagaccatggaacatcgagacagtataacaataaaaatagcctaaaaactagaggaaagtagcccattttatcatttgttagcattcttcagaggcttccaccctgccttcttgtgagctggtgttggtgaggggtagggggacatttttatgggatcctcaagtcccaccataggtctcatattctctcgactctcctctgttcccaacctccccaccttttttttttttttttttaagattcaaggtcttgctatgtttcccaggccagctcttcacaggtgccatcttagctcactgccttgaactcctggcctcaagacatcctcccacctcagcctcgagtagctggaactacatgcacatcccgacccccttttggcagaggttgatcaatgtagatttgccagttaggaaggcatgagtcagctgggaagacacaggagagtggggtggtgggggaggccaggagatagtggagggagctgtccttgggaagcttctcctgctattggcagaggcactcatgcaacgttaggggccacactgaggctcagccctctaggcacacatcagagccattgtaataatgcgagcgcatttagaggacgtctgtcctccctccctgggtctgaagctccaattcttgtggtattttgtctcattactctagacctgctatcttaatggtgtccccagatcttcatgtatactctcgaattattttttatttgtttttctcatcctcagggtgggagggatgaaggaaattatctggacgatgctctcgtgagacaggatgcccaggttggtagaactgcagcttctttcttccagctttcttctctttcgccaatgagacaggccttagtgggtggatagcaacttatattacagtgtatattagccaggcttggatatgttctttaaaaatattcccacagatagcctttaataacaggtttcttgcagaggtacctggggctggacatcattatataagcactcctgggttccaagtttctcaacattaggaccattgtgtggcaatcccagagaaccactgtcttccgaatcccgtggaggtgaaagggactgttcactgtgcacttctacttcatcaaagaggacatttgataggacctatataaaatagcttgacacagtgtataccctgctgggtaaaattaatagcaaaccccaagaggcatttgcctctctgtttcccagcccagtgatggttgtcctggaaccaacccatggtctaatcagctgtggccagataacactaacgataatagctaataaaaagtgggtcattaccaggtaccaaacactgttctaaaattttttttttttttttgagatggagtttcactcttgttgcccaggctggagtgcaatggcatgatcttggctcactgcaacctccgcctcctgggttcaagtgattctgctgcctcagcctcccaaatagctgggattacaggtgcctgccaccatacccagctaatttttttctatttttagtagagacgggttttcaccatgttggccaggctggtcttaaactcctgacctctggtgatccgcctgccttggcctcccaaagtgctgggattacaggcatgagccatcgcgcgtggcccactgttctaaattctatattaagtatgtcattgaatctttgcaataacttcataaggtaagtattgctatccccattttacaaacaaggaaactgaggctcagagaggtcaagtaccttgctcaagctcagaaagataataaagggcagagctaggatttgaaccaattggcatctagacccagtattctctctctctctctctctctttttttttttttttttttgagacagggtctcactgtcgtccagactggagtgtggtggtgtgatctcagctcaccgcaacctccccctcccaggttcaagcaattctcccacctcagcctcctgagtatctgggattacaggatgcaccaccaccacccggctagtttttgtatttttaatagagatagggtttcaacatgttggccaggctggtcttgaactcctgacctcaaatgatccacctgccatggcctcccaaagtgccgggattacaggcatgagccaccgcgcctgaccatagacccagtattcttaaccaatacataaccataatgagggattggttccattcagtttgtgaggtatgaacaactttgttttatgcaaaaaaaaagaacctgttgctttcattagaggggatagaggtatgtgtgtggcttgggcttcttggagcacggcagctgggtttcaagaaggagcacccagaaagcaagcattccaatagaaacaatggcagttgcatgattgtttatgatctagcctcagagatcagtgtcacttccactaacctgtattttattctttttttttttttttttttttgagatagggtcttgctctgtctcccaggctgttgtgcagtggcatgatctcggcccactgcaaccttcacctcccaggctcaagtgatcctcccacctcagcctcctgagtagctggactacaggcgtgtgccatcatgcctggctaagttttaaatatttttttggtagaggtggggttttgccatattgcccaggctggtctcaaactcctgggctcaagcaacctatctgccttggccttccaaagtgctatgattacaggcatgagccaccgtgcccagcccacaactatgctttattaattaaagcaatgtattagtcagaattcttaagaggaacagaaccaatagagagagagagcgagagagacacagaggggtgtgtgtgtgtgtgtgtgtgtgtgtgtgtgtgtgtgtgtgtgtgtgtaagaaagagagaggatggagttgggcaagtaccaggatcttcagagggaatcagcaagctggagatgcaggccagcctatggttttgttccagtctgagtccaaaggcctgagaactaggagcagttcccatctgaaggccagcaggctggaaacccatgaagagctgatgttccagttcaagtccaaaggcaggaaaaaaactgatgtcctagctcaaggcagtcaggcaggaggagtccctctcactcttgggaaggtcagccctcttcttgaaaacaaaagctttcagctgattgtatgagggcccctcctccatattggatcatccaaaaaccctcacagaaacacccagaataatgtttgagcaaaaatctgggtaacccatggctcagtcaagttgacataaaataaattgtcacaagcctgttgagattcaagtttcagaagtgctgaataagatgaactcttttgaattaggtgaattagatgaacgctttcagctttaaatttttatgattatgtgaattgactctaaagcagtgagggaatcagagaaagaagtgaaaaaatgggggagtatatggaggtaagcccaatgagccacaatatgtgtgagttaagatctttttgagaaatgtaacaggcaagctgcttattaaaaatgaacagtaattctgattgagcaataatgtagttaaattgagcagaatgagtttcctatattcctacctggttggaatgtaagcaattggcaatgggtccctggttctactgtgagacctgtagcctcaggaaaatcacagatcattctagagcagggctatccaatagaactccccgcagtgatgagaacattccacatctgcactgtcctgtatgggtgactaccggctacctgtagccgctgggtacttgaaatgaggccaatgtgattgaagagctgaattttaaattgtatttaatttcaattaacatttaaacagccacatgtggttagtggcaactgtaggggacagcccaaatctagggcatttcttttagctcttaagatagaaccatgtagtctccagctagggaactgctagtgtttgccctgactcccaggggggtatgacagggtcccaacagccttatgcctgaggaaggatcctgagtcatttccactcaccactaccatttccaaccccatcaccaacaaaataaaactaagccagctcagctctttgagcttctggaaatatttgcctgtgtcctggcacatcgtttttggaattttagacctgtgctttgtttggcttcaggacctgtatgaggctggagagaagaaatgggggacagatgaggtgaaatttctaactgttctctgttcccggaaccgaaatcacctgttgcatggtaaggcacttacttcatttcccaaagaaaaggagtgaaagatagcaaaaactatattgcccataagtagttgataaccttcctccttcagttggtacaaagaactgattgtacccaagtgtcttagattctcaccctggaaatgtattagtccaatgatgtatatgaaagctaatttctgaaagattaattatgaataattagaaaaagtgcatgtagtcatagaagtttggcattcttgtttctaggaaactgaccttcacagtcagtcctttttctaaagtagccccagtattttcattctaatgtagttacatatgaaagtaatctgtagtagatcaggtagcaataaaatagcaatgttggttgatatttattcctgtgtaatatccaagctgtaaagctaatacaagtgatttctttaggggttatgttgtataagatgaatagtggataatttcaaatttgatatgtttctaatttgtttctgataaatataaactttgtaatgtgattttaacttatttgggggaaagatactagacaattttagaatatttgctgtcaggttcatattcttttaaacaagcaagtaaggatataataagatatttcatcttttatacgagttctttagatctttaagtacattataattttataaacccacccaccatacccttttaatcacacacactgatttgcaaagcttgtgggaaatttgagaatgagtttgctaaattgaaaacataaagcaattgagaagtacaacacattctgaagttgtaattatttcaggtttttcacagtgacaaaaaaacaggtgattactgctgttaatcaatatcccgggctaccatcaggtacacaaacttctgactcagcttctttcttcacttccttcccttgcctggttacaaataacaggaatctccccctggtggtgttttccaagaactgcaggtcctcagaagccgatttagtgcataaatgcatttgcaagaattttcacttctgggtacaagtcaatagttaggcagttatgaaatatctgtttgtaagccactgggagaaaatattttaagcactgtttggactaggaaaacttcataattgtcttaccaaccaacaataatggtgagatttcataataactaccgttttgttaataatgttctattttctaggtgcagtgttaagcattttataagcattgtttcttgcaacactcaatggagcagtaattattttccccattttacagtggagaaaactgaggcttagaaaatgtgtcaattaagttctttgattccaagccacacacactgacttcaatttaagtaagaaaagatgaaataatatagaatggcacaggagggaaaatggaaaatactggtagctcacagatttgaacagacagctgaacaccttcaggaagaacagaaatcaaggcagttctgggggtctcagtagaagggaataatggattttatttctaaagcagagtttctgaagttcgttttctattaaaaatgctaaatattgaccccctacttcagactggctgaattagaatctctgagtgtgacacccaggaagtttaataggtttctctgagggtaaagatgatgcagtgcttttggccatccccgtgagctgctcaattaaaaagttcccaggagagagtctaacgggtcctgactgggtcaactgctcacgtgtttgacagaggttgtggtgtatgttgttgggtatggtgtcccttgattgacagccctgttaaaatcacattgatggaagtgaggcagcaccccaaagaaggcgatggtgagaagataaaatagatacctgctctaagaagtttccagaaggagacagcaagagaggggaacatattcaccacattcaaaaatacttggcaaaaaacaacaacaaatgtaattatgtttaagtattttaaaagatgcaaccagctgttattaactgtgactcagttctgaagcagttgaattgttctagttttgatgagccaaaagggagatgacagggaggtgattgccaaggacaaaaacacaaaaagacacattctgcttattaaggaaacaatgagaaaggaaagcaaagctccccagaggccatctccattttatgtgtgagggtcccagataagggaaaggacttgactgatgtcctccaaacatcacagcatttcttcctccttatctggggcccattccactctgcacatccctcctggctgcttgcccacattactaattagtttcctcctgaaatatgccaaagaataaatagtgtaggctagttaaaaatgctcattctctccataaattttagtttcctctgttttttcttcccaataatactattttgttattgtctgcagtgtttgatgaatacaaaaggatatcacagaaggatattgaacagagtattaaatctgaaacatctggtagctttgaagatgctctgctggctataggtaagctggtagggggagtagagaaacaaatgtttatagattttccttctcattatcagtttgcaatatggggatatagaattatttttagagataaaagttgtttatcatgaatcactcatgttacattccagatttttaaacaagaaatattatatacaacctgattgctattgtgccatgtggtttatatattttatatcttctgtgcctttgtatgtcctatgtgaaaggtaataatgtgcagatatacaggctgcagcttgcaagtctgtgaatggttagaactagtaactgtctcatatggcagatacagtaatccttattttgaaatgaaataccaccctttgctttgatagactttatcaattacttctccaggaacttgatgataaattgagggtactttctatctgtgaaaatacatagagcatcgcctatgttcatgaaacattgcttggctaaaatttccctggcaaagcaaatattgataccttgtagaaacagaggaaacaactgtcacttttcttttttcatgggtcttatctgtaatcttttcatttcttctttttttttctttgacagtaaagtgcatgaggaacaaatctgcatattttgctgaaaagctctataaatcgatgaaggtaaatggccttattttcagcatctaaatgaatttgagttatcttgtgtccaccttcttaagcttacttatatcccctatccaaactttgctctgaaagatccaattcaattcatcaaatacttcagtgagtgcctgctaataataatactaggtgatatttactgagtacttaggatgtatggatcactgtttttaatagattaattatatccccacaacagctctatcaggctggtactattactaacctccaatttacagatgaggaaactgaggcatagaaaggatatgcagtttgcccaagattctcagtgaggaagtatggagcaagaatgccaggtgtttacctggcattctagctccagagcccgtattcctaaccctccatcgtactctgcaggctgagaatcacaggaggtgcagggaaggtcaaaatgtagtctttggccaggtgcggtggctcacgcctgtaatcccagcactttgggaggctgaggcgggtggattacttgaggtcaggagttcaagaccagcctggccgtcatggtgaaatccccgtctctacaaaaatgcaaaaattagtcaggtatggtggctcatgcctataatcccatctgcttgggaggctgaggcaggagaatcactggaacccaggaggcagaggttgcagtgagctgaaattgcactactgcactccagcctaggcaacacagtgagactctgtctcaaaaaagaaaaaaaaaaaaagcaaaacaaaacaacaacaacaaaaatgtagaccttgctctcaaagaatgtctagcctaggcaagtatgtgcaaaacaccaattataacaagacagaatgtaagacagtagttgaggatccaaacattgtagaaacacagaggaaagggtttttttttttttcaatatttgttttttgaggtggagaatctgcaaagaatatataaacagttggtatatttgagcaggaccttccaaatgtagaagttttacatcagaggatttcatgtggtgaagggaaggggtgataaggctggggagggaaggataatactccatgagaaggaatcgtaggtgagccaggtggcagggtatgtctggacagcacaggttatggctctagaaaagcagggaacggcatcctgtggtcagaacatagagcattggaaaagtgagttgtggagagccttgaataccatgataaagagtgaggatattcctcaggcctgccaagtagtggagcaaaggacatcgtcagcacagtcatctcctagtcttgctttgatagactaaagaagacactgaaaaacagctaggtttttgtatatgtttggatttcgttttcttccttagggcttgggcaccgatgataacaccctcatcagagtgatggtttctcgagcagaaattgacatgttggatatccgggcacacttcaagagactctatggaaagtctctgtactcgttcatcaaggtaggtcacagcagcctaagtccagagtaaaggatccagaaaaggacccctctgaccttggcatttagcacttgttgtccccctcttcttggcatatatcatttcccttaaagattatgctcccgatatttccagtctctcctctttcacacagatatttaaacctttgccaggatacaagctggaaatttgccttctaaatacagtaattattttatgttgacctcagacaaagattacattttaatgaatacttttaagcacacaatttcctcgtctacctaattatgagagaagataaacaactgaatccagagtcctaggcaggggccagctgaggtctgctgggaatatgggaaagcattttagctatcctgaattactgttctttaccaggcaccagacttctaggagtcctaagagggcatggtagtggtgagaaatggttcacctccctcaaagccaggcattcctgggattttgtttcttgaggatgctggaagagtctcatggacatgaaagtgagacagatttccctaggagctaaggttgcctgcactgcaagcttcaaatcagcgtttgatctgtgaactaaatattctgaatcctactcaaagcttggagaggtgtgacaattaggtgattttaactgcagatttttttttttagatggagtctcactctgtcgcccaggctggagtgtagtggcgcaatctccactcactgcaacctccacctcctaggttcaagtgatcctcctgcctcagcctcctgagtagctgggactacaggcatgagctttgtattttttgtagaaatggcgtttcaccatgttggccaggctagtcttgaactcctgacctcaagtgatccacccgtctcggcctcccaaagtgctgggattacaggtgtgagccaccatgccccaccaagctgtggattttgttactacgtctacaaggcatgcaggaacttgtttctatttctgactaggctatgaggtaacttgattttgcagagctgaactatataactagtttaagattcaaggatgacggtaagtgaagttatgggaaaatatactacaaacaagaaaaaaacaaaataaccccaggaaatgacaaatgatttatggaggatatggagagactagaactcttgtgcactgttggtaggaatataaagcggtgcagccactgtgaaaaacagtctgttacgaaactttaagcaccaaacttcttcaaaaagtttaatatagaccaggcatcgtggctcatgcctgtaatcccagcactttgggaggccgagacaggtggatcacttgagcccgggagttcgagaccagcctagccaacatagtgagaccctgtctctacaaaatcaacaaaaattagccgggtgtggtggtgcacgcctgtagtcccagctactcaggaggctgaggtgggatgatcacctgaggctggggaggtcgaggctgcagtgagccatgactgtaccacttcaagactccagcctgagtaaagacccatcccaaaaaagaaaaagaaaaaattttaacatagaatgaccatatgagccagcaattccactctcagttatatacttaaatgaaaacaggaacccaaacagctagttgtacatcaacataaacattattaacaataggcacaaggtggaaacaacctaaatatccatcaacagatgactggataaacaaaatgtatatacatacataaaaagcaatgatattcaatggtacgctgtcatgaaaaaaaggaatgacatttttgatacgtgaatgaaccttgaaaatatactacgtgcaataaatcagacacaaacggacaaatattgtatgattctgctttatgaaatatgtagaataggtagattcatagggacagaaagtagattagaggttaccagcaatttggagggagaggaaagaatgggagttattggttagtgggtacagagtttctgtttggggtgatgaaagggttttagaaatagacagtgatgatggttacataacattgtaaaagtaactagtgccacttgaaaatggttaaaatgacaaattatatatatatatttttttaccacaagaaaaagtctctgaatttgaataaaattgtttaatgaaatgtgaaaagaatagatgaagtataatacttcatcatagcattatttatattatttacatggctttatgttatttatatttatatcaataatatggtattatagtatataatttattatatattgttattactattaatcaatagggaataacaaattatggaaaatccatacaatataatactataccaacactaaaatgattgagtacaaatatattgattggcttgggaagaaaacactataatctagtgtatatatgtctgtatatataaatatgtaaatatatgtgtgtatacacacacacaccactagaaaagattaaaaataaagaatacattactcattcaataatagttgtcaaaagaaatgaaaaaagcagaatagaagcataaaatatgtaaataatagaaaaaaatgacaaaagataaaaataaaagttataaaaataaataaactctcaggttaggtaaaaatataaaatccaacttcatgctgtttataagaaacaactaaaatacagtgacatgtaaaaagcttaaagaaaaacaccagggaaagaaagaaagcggacatacaagaaagaaagcggagattatgctattaataaaaagaagaatttagggagaaaaagtattaaataggagaaagtggatcacgttatactgacaaaggcaacaattcacagcaaagattaaactgttatgaaactttcagtaccaaattatattgcattcaaatgtataaataagaaacttgaggctccagaagaaaacatataatggaattagtatgctagcgagagactttaatacatcctatgctttggcacatcaatgaggcaaagtataaacaaggatatattaagattgagcttaacagatacttattaaactttgaaccctatatacagagattccatcttttctagtccccacgaatgactaataaaaattaatctaggccaggtgcagtggctcacacctgtaatcccagcattctgggaagctgaggtgggaggatcacttgagcccaggagttcgaagctgcagtgagctatgaccacaccactgttctccagcctgggtgatagagcaagaccctgtctctaaaaatataataaaaataaataaataaaattaaagattaaaaaattaatcaattattagaccacaaaaatttatatgcagaaattatagaacctttccggaagactgttttgtaacccatatcaaaatgtttaagaaaacaggctgggtgcggtggctcacacctgtaatcctagtactttgggaggccaaggtgagtggatcacttgaggtcaggacttcaagaccagcctggccaacatggtgaaaccctgtctctactaaaaaaataaaaattagccaggcgtggtggtgtgtacctgtagtgccagctacgcaggcagctgaggcaggagaatcacttgaacctgggaggcggaggtcgcagtgagccaggattgcaccattgcactctagcctgggccacagaacgagactccgtctcagaaaaaaaaaaaaaaaaaggtttaagaaaatgcatttagtccagtaattcccattttatgaaaatttatccagaataaatcattaagaaaatatacaaaaatgtaactacaatatgcttattgaagcagtgtttataatagtgaaaaattgaaacaacgtaaatatccaacaatagggagagggaggatgtgatcaaataaattattttacctgcatacaatgggatattctgtaaccattaaataatgttgtagaataatatttaacaaaatagggccctagcacggttgctcacgcctgtaatcccagcactttttgggaggccaaggctggcagatcatgagatcaggagatcaagaccatcctggctaacatggtgaaaccccatttctactaaaaatacaaaaacaaaattagccgggcatggtggcaggcgcctgtagtcccagctactcaggaggctgacgcagaagaatggcgtgaacccgggaggcagagcttgcagtgagtcaagatggcgccactgcactccagcctgggtgacagaacaagactctgtctcaaaaaaaaaaaaaaaaaaaaaaaaccacaaacaaaaatgaacaaaatagggaaataggctatattgttaagtgaaaaagcagaacacagaatactactgttctatcacattgggtatctagatacatagaaaaaagactggaaggacattcacacatcaaaacggtaagaatagtagtctctagatgatggaataatggttgatttttgtgttcttttttgtctttattttctacactgaataagtattaccttcgtaataaaaaataacaaaaaaaatttaaagctaagaaaaatccagccaagcttgaaaaagttggcttagatgactttgaactgtgtgtttcattttaaaatctatttatctaactttgcttccctatcgaacagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaagaacgtggaaaaataattttaatttaaaaatggtgtttttaggccgggggcgggggctcacgccagtaatcccaacactttgggaggccaaggcgggtggatcacctaaggtcaggagttcaagactagcctggccaacatggagaaactgcatctctactaaaaatataaaaattagccgggtgtggtggctggtgcctgtaatcccagccactcggaggctgagtcagggagaactgcttgaacccaggaggcaggaggcaaaggttgcagtgagccgagatcacgccagcctgggcgacagagcgagaatccatctaaaaaaaaaaaaaaaaaaagtgtctttaaagtgaggtatagtctttctctgatccacttttcaccttctgaggtttttcatcttggcccctgaaaggagctatttttgaaggacttgtgttactcagtttctacaggaattacaagataagaaaaaaaaaatcatatttagtcttatgcgtgcctactggctaatgttcacatatgccaaacactactcaataacataaaataatgtatgaacttattctctggaaatgagtgatgccctctgctctaagtagaccatttatattaaatatcataaatgtataaaggacattcatattcttatagtgggaatacttgccttttttgttgattttatagcatccattgtattttggtgagtgaaataataagaattttttagtttagtgttgtttattataaaagctacagctactggtagaagctacttatgtgaatatttagtcactccagttacttacaggaaataatactaccacttcaatgccttcccagaagaccacagaatctccacatcagctttgtctttggaagcatggtgatttttttggtagaagttttatctttaaatgatatgtagcttagccaaaattttaaaacaaatagcattgattcaccagaagatttctagaaggtgggataaagtcaccctggacgaatgtttgtcatattgaattagcatgactttgagatataattatgtttgtttttccctcccactgtccacttacatttattcagtgggcagttcttccccttcttcagatgtaaattcagatagagtcatgacttttctgttcactcttaggttttaaagtcctactgtgtagtcccttaaggtcataaaacagtgtcattttagtaagtaatatatccagtcaaaattgcaagcttgatttacagttgatgcttcttccctcactcacctctggcctattgcaagtaggaagctggtttctggggaaagggagaccatgggcttctcttctttttccacctaggtttccttcaatgttctccccctgccccaacctaccatgtctgggttgtagcaaagaagagagttaaggggagcaggaaagttgttacctgactgtcattgctgtggtggtagaggatcagccctatgtgaccctgacagactaaagttgattcttgtgggcattcttgtgggttcctttgtcaacctcatcacgctactcacctgaggttcctctggcaaggcaaatgtgtactcctttttcagcctctaggaatttggtgactctttgaggttctcagtgctgaagttcattgccttcctcccaggcctgttgggcaggacctaagctgtctcatggtggtccacatctgctccatgggaaacacctgcacgttctttgtgctggcaaattctgtgtatgcaagctgatccctctgcagccattattctccgcctcccacctccaccccaagctgcctcggctagcctctctcggttcagatttctcatgcatgaatcagacattagtccacggggaccctcaaactacgtatactgccaatgggagtctaaattggtaccttgatgcaatcaacccagagagcaatttggtaatagctaacaaagttgcagatttcgcagcaaattcacttttgggaatctgcttgg

SEQ ID NO: 16403 - DNA, 36821 bp, Human
taaagagagaaagtgaacttattttatccaaataaactagcttatacctacgtgagtgaggcagcaaattactacttccctttgccctggataaagggttcaccaggacctggactcactcaccttttaaaggttataaaaccaaacacgtctgacccacattttactcaactggtgctagaattattaactaaattaatgtttattttgaaagtcactgattagattaatccacaagtattgaattttagtcaatcttggtggcccggtttaactggatgttttgcttaaaaggaaggcagcaagatgcaggggttatggtttccagccccagcttggtcacttgcattctgtgtgtccttagctaaagtactgaatctccatggtctaactttctcctctctaaactgggaataattttacagtgggcaaagataattgagagaataaaaagagatgtgatgagtgtgaaaattctctgtaaatttgtcataatgtctataaacataatcgataaaacattgtataactgggtcttaatattttcttaatgaaagagctggaaataactgtactggtcaatttagaataaaggtaatcttttcagagcatgcctttgtatacacactttgttattagtgatctagtaatgttcataaatccagttgtatttagatcttcatgaccattgactatcagttcccatttcaggtctgcacattgcagtggttctgtgccctgggtccattcagtgatttccctgtgttccatcttctgttgaatccacaactgttgttctgtgtataatttctcttccttgctgtgtatgattacattctattatttgtaacaataacagaccaaaaacaatagaagcagccatgtctggaggtgactggaaggtggagaagccatagattttcaagccctgtgccataaattatgtgagattggccctttccttaatagtgctgaacaactttcacttgtgaggtgatgcagaggggagaactctaatttttatttcttcttttgagcgtctccggtcctcttatccttataaacaaataacggacttctatttaatgtgaagcctgttgctttctgaacagagtcaaggtggcgtatcttcagagtaactaatgtctggggtttgttttgtttttctaaaattgttcttgagccagctgtggtgtaagtggtaatgaaccccaatgggtatcagaagatctctgctcaaatcccggttttaccggcaatgagctgtgtggcactgacaggtgtcctgttctcccagagtttctttcccaatttgaaaaataaaaaatgataatctttatactccagtctcttttaatgatgaatatacatttatatatatacttttatatatttaatataatatttaatagtataaatatgtatttatgttattattatgtaataatgtatgtaacactccctgctaattcagtttgtctctttgacatgtaaagtaaataatcacctattattataataatgtaataataacacaaatattattatgtaataacatatatatttatgtatattgtttatatacatttaaatatatataaatatacatttattagctaataatttgatatatgtatggtaattcaacatgtatgagttatattcactatttcatgtttaggcagctgtattttaagtgaactatactaaatatttgaaaggcttttgttatcaagggctaagtctcctattttttgatatagcattacaatgtacattttttatatacaaaatatagaatacactgatttccctcaaggtcataaattcccaactggtcattaatctgagaatattgaattttgagtatattctaacatagaatcatttacttcagtgtttctccatcatcacagcacattggaacaaccagggacttttaattaaaaatacctgggctccaatccaatacaattaaaccagaatctcctagattggcactggaaagaaggagtaggacaaaagaacattttatttctatccatgggccaaagtccactcagaaaaaaagtataaattggatctaggtgattgtttactttacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatgtaagtctgccttatgttcctccagccaattgcaaagggtaagttatttgactgctatttttagacaaaatatattcctggaagcacactattataatagatcattgtaaagcaaaatactccctctgaacttctttgatgtttcttttgtcttcctatttttttttttttgagacggagtctcgctctattgcccaggctggagtgcagtggcactatctccactcactgcaagctctgcctcccaggttcacaccattctcctgcctcagcctcccccgagtaactgggactacaggtgccctccaccatgcccggctaattttttgtatgttttagtagagacagggtttcaccgtgttagccagaatggtctcagtctcctgacctcatgatctgcctgccttggcctcccaaagtgctgggattacatgtgtgagccaccgtacctggcctcttttgtctttctaagtctgtcattgtcagaaatagcggagtgagttgatgcattttgtgaatacagaaacattggggtcattgtattatataatcatttaatacagtggcaaaagtttaaagtgctgtttctcctctttgtttcacagtgttttgctatgatttttgactgaaggtgaagggaagtgtgtgtgattagaaatttcatccaataagttctctactatagtagtcatgtgttttattcagaatggtcatgaaaattgaacttctctgaagattcatttgatggctgatgtgaaataaatatctgtgggttcagggcaaacataagtgcatgaaagaaagaagtaatcagtcagggcccaataggtagttaacagaattcttttggattctgaagaaagccactgtctgtggccaaggttgctggagaatggaagaaattgttcttccaggagatgctgaatgtcctgattctaactttgtggtgcttcatcgttccatattggtaataccagcagttacaaactggactgggcattagaatcacctggggtgacactgtaaatacagatttctagggttcatcacaggactgctgtatcagaatcctcatgttaagagctttacaagtgaccctgaagtctttagctgggtagtggcctcaaggtggacatgggggattgattaattgctcaagcatcagtttaaattagcagagattccagtttggagcttctacatattacctgtgggactctgagaatgaatctgcaattctctggcctcagtttcttcatttttaaaacaggtcaaatgaatgtgctgaatgtgttgaagtgaggatgaactgtgtgatttgtgtaccaattgcctgggtcattgcgtggcacatcacaggccatctataagtggcagctataacaatcaccatcacatttatgtacaaaattcagaaatatcgaatctatgtgtggcaaatatgaacattaaaaaatacaatgaaaatgtcagtctgaatcatacatagtatttggagcaaatagcgacttattttgctgctatttgcatttcctttcccagttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggtaggtgcacatatttctgtgtcagctttggtaactggggtgagggggatggaaaacagagccctaaaaagcttctcagcagagcttagcctatctgcatggctgccgagtgttgcagcactttcttccttggctgtgaattctcccagtttctgcccctttttttattaggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaagggtgggtgactctactctgcgtcattgaccttaacagttacctgtcttcactagtgacgtccttggaaacatttcaggggtggccaggtcttcattgcgcatcctggttgtcagccctcaggtggtggagggagatttgaagcacagagacaagggaggttttgtgtatctgtgctttgcctgtataaatgtgttggttcatagggtgtaggaataaaaggtcatttaatcctattttctgctcaattttgtttccttgttttcaaatcagaaattataaataagggtcttgagttcatttttgaagagttaaagaaggtttcccccatagcataaatctgcattacctccaccagaacatttcaccagagaacacttggaaagtggacatggtgaaagtgacctcatcacacttcatgaaatatgaaccaagttatatgtgctttcatttaattcgagttttttcatatggtcatactcacatgtctggaaattccttccaggtccatgcctacagctctggccagcaatgacactatgtatggttttacttgcttaggtatatctcagtacagttttcatcagttcttatttctcgggaaacacagtactatttgaaaactgtcaggattaattatttcttgttaaccactacttactgtagcaattaatatattttaagtaaatataatctatagtataactcagcaaatacacaaatactaatttgtaaataatttgtttaactagattttaactattatgaaaaactctttatcctgtcttctttaaatgtaatttggctatgttttcagttttgtcatcttttttcccctgtattggttcttagctttgaaatttgtgctaatcatttttctcccactgccaatttactcacctatgaagtgcttgttataatcaatctgattatcagctgggatataaaattacctttttaaattcactctcccaaatgcagtaaaaaaaaaaaaacctggatatcagattgtacctgagaaacacacacacacacacacacacacacacactctctctctctctctctctctctctctctctctcaccaaggcttcccaaattacctttcacccccttggctaaaacaacagtttttctgaaactttagagccctgtaatgtttaaaggagtctggcatagaagcagctaactcagcaggtttcttgttgttcaatgttccaactttattcacaaccctttcatttcgtgtcactcttatttaggacctatagatgtgaatttgggcaccctttccatttatgttcactagtcacttggttacagcaatttcattttagagattccttcaccgaataaaagcctttttaataatttctttacctgtaaaattacagatttggcctaacttatggtcaaatttaaaactttattaaaacatacttatcttgatgactatactgaataatatcccagaatccacaagagtagttttgcccaaatgaattaaatttggaagatgattggaaatgataaacattatttccaaaggaaggaaattcattttttacaaattgaaaaaataaataaaaagattccatttatcaatttactttttggttagctttactgggatttagatttgaaataaaaagttagcattttacttatttagataaacaaatctgttatacttaatgctcatttatattagtttttcttctcatatcatatggatgtacttgcttttcacatttgttccctaaaacacatgaattcacccacaatctccctaactttattcccattggttcagcacattatactttcagctatatgacatttctaggtccccaacttttctcttcctatctctgtgttttattgtccagaggctttgcaaacagacatgattctgctctaaaaacttgaattattaggatttcaaaaaagtcttctttttccttccaaaataaaagacacttggggttaaaagagtttaaataaaggcagtggatgtgaataaccacatgcgaaatgacattgtttagctagcctgtaatgctcaactcatatttaaggtaaaagtaatgtgtttatttcatccatgctgattttttttggacacatggggaatttgtaagatattgtttaaaatttctaaatttcctttatgtcttaacaaatgcaaatcttttaaatatttattttttaataatttttttaaaaatttttaaatctttagcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtaaggccaagattttattttccttggaaaccatttattcaaggttgtagggaagacttggtttaaaaatgagaaaattgatactaaaatgcttttatacaataaaaatgatgtatgagtgaagaaaataattaccacctttgatttcctgttcaaaattttcagcctccaatctttaggtacagaaaattgctatatgtgcacaataaaaatttccccatcagaagtgcaaggggtcagggaattccctttcctagccaagcaaagctgtgaacagatggcacctggaaaattgggtcactcccaccctaatactgtgcttttctagtggtcttagtaaatggcacaccaggagattatatcctgcacctggcttggagggtcccatgcccacgaagcctcactcattgccagcacagcagtctgagatccaactgcaaggcagcagcgaggctgggggaggggtgtccaccattgctgaggcttgagtaggtaaacaaaaccaccaggaagctcgatctgggtggagcctactgcagctcaaggaggcctgcctgcctctgtagaatccacttctcggggcagggcatagctgaacaaaaggcagcagaaacctctgcacacttaaatgtccctgtctgacagctttaaagagagtagtggttctcccagcatggagtatgagatctgagaatggacagacggtctcctcaagtgggtccctgacccctgaatagcctaactgggaggcaccccctagtaggggcagactgacacctcacagggctgggtacccctctgagacaaaacttccagaggaacgatcgggcagcaacatttgctgttcagcaatatttgctgttctgcagcctctgctgctgatacccaggcaaacagggtctggagtggacctccagcagactcgcggctgaggatcctgactgttagaaggaaatctaacaaacagaaaggacatccacaccaaaaccccatctgtacatcaccatcatcaaagaccaaaggtagataaaagcacaaagatgggggaaaaacacaacagaaaaactgaaaattctaaaaatcagagtgcctctcctcctccaaaggaatgcagctcctcaccagcaacggaacaaagctggatggggaatgactttgacgagctgagagaagaaggcttcagatgatcaaatttctccaacctaaaggaggaagctcaaacccatcgcaaagaagttaaaaaccttaaaaaaagattagatgaatggctaactagaataaccaatgcagagaagtccttaaaggacctgatggagctgaaaaccatggcaggagaactacgtgacacatgcacaagcttcagtagttgattcaatcaaatggaagaaagggtatcagtgattgaagatcaaacaaatgaaatgaagcgagaagagaagtttggagaaaaaagaataaaaagaaatgcacaaagcctccaagaaatatgggactatgtgaaaagaccaaatctacgtctgattggtgtatctgaaagtgacggggagaatggaactgagttggaaaacactctgcagggtattatccaggagaacttccccaacctaggaaggcaggctaacattcaaattcaggaaatacagagaacgccacaaagatactccttgagaagagcaactccaagacacataattgtcagattcaccaaagttgaaatgaaggaaaaaatgttaagggtagccattgagaaagggcgggttacccacaaagggaagcccatcagactaacagcggatctctcggcagaaactctacaagccagaagagagtggtggccaatattcaacattcttaaagaaaagaattttcaacccagaatttcatatccagccaaactaagcttcataagtgaaggagaaataaaatcctttacatacaagcaaatgctgagagattttgtcactaccaggcctgccctaaaagagctcctgaaggaagcactaaacatggaaaggaacaaccggtaccagccactgcaaaaacatcagattgtaaagaccatcaaggctcggaagaaactgcatcaactaacgagcaaaataaccagctaacatcataatgacaggatcaaattcaagcataacaatattaaccttaaatgtaaatgggttaaacgctccaattaaaagacacagactgggaaactggataaagagtcaagacccatcagtgtgctgtattgaggaaacccatctcatgtgcagagacgcacataggctcaaaataaagggaaggaggaagatctatcaagcaaatggaaaacaaaaaaaggcaggggttgcaatcctaatctctgataaaacagactttaaaccaacaaagattaaaagagacaaagaaggccattacataatggtaaagggatcaattcaataagaagagctaactatcctaaatatatatgcacccaatacaggagcacccagactcatcaagcaagtccttagagacctataaagagacttagactcccacacaacaataatgggagactttaacaccccactgtcaacattagacagatcaacgagacagaaagttaacaaggatatccaggaattgaactcagctctgcaccaagcggacctaatagacatctacagaactctccacccctaatcaacagaatatacattcttctcagcaccacaccacacttattccaaaattgaccacatagttggaagtaaagcactcctcagcagatgtaaaagaacagaaattacaacaaattgtctctcagaccacagcgcaatcaaactagaactcaggattaagaaactcactcaaaaccactcaactacatggacactgaacaacctgctcctgaatgactactgggtacctaaagaaatgaaggcagaaataaagatgttctttgaaaccaatgagaacaaagacacaacataccagaatctctgggacacatttaatgcagtgtgtagagggaaatttatagcactaaatacccacaagagaaagcaggaaagatctaaaattgacaccctaacatcacaattgaaagaactagagaagcaagaacaaacacattcaaaagctagcagaaggcaagaaataactaagatcagagcagaactgaaggaaatagagacacaaaaaacccttcaaaaaatcaatgaatccaggagctagttttttgaagatcaacaaaattgatagaccattaggaagactaataaagaagaaaagagagaaaactcaaatagatacaataaaaaatgataaaggggatatcacaaccgatcccacagaaatacaaattaccatcagagcatactataaacacctctacacaagtaaattagaaaatctagaagaaatggataaatttctccacacatacaccctcccaagactaaaccaggaagaagttgaatctctgaatagaccaataacaggctctgaaattgaggcaataattaacagcttaccaaccaaaaaaagtccaggaccaggtggattcacagccaaattctatcagaggtacaaggaggagctggtaccattccttctgaaattattccaatcaatagaaaaagagggaatcctccctaactcattttatgaggccagcatcatcctgataacaaagcctggcagagacacaacaaaaaacgagaattttagaccaatatccctgatgaacatcaatgcaagaatcctcaataaattacggcaaactgaatccagcagcacataaaaagcttatccaccacgatcaagtgggcatcatccctgggatgcaaggctggttcaatatacgcaaatcagtaaatgtaatccagcatataaacagaaccaagacaaaaaccacatgattatctcaatagatgcagaaaaggccttttaaaaaattcaacagcacttcagtctaaaaacactcaataaattaggtattgatgggacgtatctaaaaataataagagctatttatgacaaacccacagccagtatcatactgaatgggcaaaaactggaagcattccctttgaaaactggcacaagacagggatgccctctctcaccactcctattcaacatagtgttggaggttctggccaaggcaatcaggcaggggaaagaaataaaaggtattcagttagaaaaagaggaactcaaattgtccctgtttgcagatgacatgactgtatatctagaaaaccccatcatctcagcccaaaatctccttaagctgataagcaacttcagcaatgtctcgggatacaaaatcaatgtgcaaaaatcacaaacattcctctacaccaataacagacaaacagagagccaaatcatgagtgaacttccattcacaattgcttcaaagagaataaaatacctaggaatccaacttacaagggacgtgaaggacctcttcaaggagaactacaaacaactgctcaacaaaataaaagaggctacaaacaaatggaagaacattccatgctcatgggtaggaaaaatcaatatcatgaaaatggccatactgcccaaggtaatttatagattcaatgccatccccatcaagcaccaatgactttcttcacagaattggaaaaaactactttaaagttcatatggaaccaaaaaagagcccgcattgtcaagtcaatcctaagccaaaagaacaaagctggaggcatcaggctacctgacttcaaactattctacaaggctgcattaaccaaaacagcttggtactggtaccaaaacagagatatagaccaatggaacaaaacagagccctcagaaataataccacagatctacaactatctgatctttgacaaacctgacaaaaacaagaaatggggaaaggattccctattcaacaaatgttgctgggaaaactggctagccacatgtagaaagctgaaactggatcccttccttacaccttatacaaaaattaattcaagatggatcaaagacttaaatgttagacctaaaaccataaaaattctagaagaaaacctaggcaataccattcaggacataggcatgggcaaggacttcatgtctaaaacaccaaaagcaatggcaacaaaagccaaaattgacaaatgggacctaataaaactaaagagcttctgcaaagcaaaagaaactaccatcagagtgaataggcatcctacagaatgggagaaaaattttgctatctactcatctgacaaagggctaatatccagaatctacaatgaactcaaacaaatttacaagaaaaaaaccaaacaaccccatcaacaagtgggcaaaggatacgaacagacacttctcaaaaggacatttatgcagccaaaaaacacatgaaaaaatgctcatcatcactggccatcagagaaatgcaaatcaaaaccacaatgagataccatttcacaccagttagaatggcaatcattaaaaagtcaggaaacaacaggttctggagaggatgtggagaaataggagcacttttacactgttggtgggactgtaaactagttcaaccattatgaaagacagtgtggtgattcctcagggatctagaactagaaataccatttgacccagccatcccattactgggtatataccctaaggattataagtcatgctgctttaaagacacatgcacacgtatgtttattgtggcactattcacaatagcaaagacttggaaccaagccaaatgtgcaacaatgatagactggattaagaaaatgtggcacatagacaccatggaatctatgcagccataaaaaaggatgagttcatgttctttgtagggacatggatgaagctagaaaccatcgttctcagcatactatcacaaggacaaaaaaaccaaacactgcatattctcattcataggtgggaattgaacaatgagaacacttgaacacaggaaggggaacattacacactggggtctgttgtgtggtggggggagggggaagggatagcattgggagatatacctaatgtatatgacgagttattgggtgcagtacaccaacctggcacatgtatacatatgtgacaaacctgcactttgtgcacatataccctagaacttaaagtataataaaaaatgtatatatgtataaaaatttcccttcaaaatggacatgatgtcttattcatatttatagttataatttcaatcagggcttggtgtaagatacatatatcttatgacatgtttatatttaatattcttttctcttttaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggtaagatattagcaacagatcagtattttgatttcttgtccattttgtgattcatcgaatccttctgtaatttactaaggatgtttaaatgatcaggccagtaatgcttgacaagcatcttaattacttattgtatttatgggcctgcactaaacatcatggaaaatacaaaattgtccaatggctagaatgcatagaccctcttcttgaaataaaaataatctacatgagtagaataatatagacactgcagtcaaatggaaacaattataaataagtagaaaatacaaaatatcctaccacaaactgaagatgaatatcaatattgcacatagattatgtgacaatggaaaagaatggcttatcataaatgggcttcctgtatgccctgcacattgacatagcccttaatatattttcagtgtggaacagaagaaaggtttcagatggaatgagtagtttgtggagaggtgagtggtgggaaagagttggtggatggaagagagaaggtttaatttagtgtaacctaaaatgaatttgcacaaaggagttggaggttgatgtttatcaggtaacctgtgagagtgaatcctgttttcattgaactatttattgaaaaagtatattttttcctattgaattgtcttgacaacctcattaaaaaccagttgagtataaatgtgaggatttgtttgtgggctctcaattctactccattggtctgtctgtccttatgtcagtagtacctcattttgaagtcttaattactgtagttttgtgtcaagttttcaaatcaaaaagtatgagtcctcaaagcttttttcaagactatttgggcttttttgtgttcattcagtcgcaacaaaaatttaagaataaacttgtcaatttctgcaaacaagcccataggaattttaagattgcattaaatctatagattaattcagaaaattatgacattttaaatattgagatgaaattcatataccatatatcacccaatttaaagtgtacactttaatggtattttgtttaattacaatactgtgcaactgaggtaggaggtgggagtcaactccagaggtgggtcttggacatgggaccagattgatggctagctaaaacagggccaggatgaaagcagctttcaatcattcctgcccaccagtatgccgtgtcaatttactattcccatggcaacacccaggagttacctcccctttccatggcacccaatgatccaaaagataggaccccttccttgcacaaactgtcccttaatatgcatgcaattaaaagtgggtataaaaatgaccacaaaactgccctgagcttctactctctgcctatatcatagccctgctctgcaggagccctcgcagagctgtaccactgcctgttcaacaaagctgttttcttctacctctgagttgcctttgaattcttttctgggcaaagccaggaaccctcccaggctaagctccacattgggactcgcctgccctgcatcacaactaccattcctctctactttcaaaacttttttatcactccacagaaacatactatatcattaaatagttacacctcattcccaactccatcatgtagtaaacattaatcaactatctttatggatttgcctataatgagtataacatttgacccatggcatatgtgatcttttttcctggcttctttcacttagcataatgatatggagggtcaactaagatttagcatgtgatagtactttgttgttttgtgtggttcaataatattccattttcatgtacacatatgacaatttgcttatcattcatctgttgatgatcatttgtgttattttcaccttttggctcttataaataatgttgctatgaacatttgtatacaagttacttcatgaatatattttcatttttccagggtatagtcctaggagtgttatttctgggtcatatggtaattttatgtttaactttttgagaaacaactaaacatttctacagtaaatgcaccattttaaaatcccatcagcaatgtttgagggttcctcttttccatattatagccaatatttgtaattttctgttttttgtgtcagtgcaaagtggtatttcattgtggttttgacttgacctatgatattaattagctttttaccatttttacatgttctttagagaaatgttattcaaggcccttgttcatttttattttattttatttatttattttggagacaaggcctctctgtgttgctcaggttggagtacagtgctgtcatcttggctcactgcaacctctgactcttggtctcaagtgattctcctacctcagcctcccaagtagctaggagcacaggcacaaacccccacacccagctaatttttgtattttttttgtacaaacttggtttcaccatgtttcctaggctggtctcaaactcctgagctcaagcagtccacccatgttggccctcccaaagcactgggattgcagttgtgaggcaccacacctggccctttgcttatttctatactgggttgcttgtcatttgttgttgaactgtaggtaattgtttatggattctgggcattaaacccttactaaatacgtatgaaatacaaatattttctcccattctacaggttgtcatttcacatttttaattttgtcctttgatgaacaaacattttaatttggtgaggcccagtttatctctcttattttagttgttttggtgtcaaatctatgcatccacttccaattctgaaggcattaatatttaaccgatgttttattctaagaattgtatagttttagttcacatttaagtttttcgttcactttcagttatattttgcataagagtgagataggggttcaacttcattcttttgtatgtggctacccagttgtcccagcactgtttgttgaagaaacgcttcctttatttatttatttttttttgaaactcttcctttagattaaatgatcttggtacatttgttgaaaatgaaccgggcatagatgattaggtttatgtttggatttcaattttattccactggtctttatttctttccttttgccagtaccatgctgttttgactactatagttttgttttgaagtctggaaatttggaaattgagtcctctccctgtagttgcatataaattcaggattggcttttccatttttgcacaaataaaaattttaaaaaggacattggaattgtgacagtgattacattcaatctttagattacttttggaagcattgccatcttaacaattttaagtctttcattattattattattatactttaagttttagggtacatgtgcacaatgtgcacatttgttacatatgtatacgtgtgccatttcaatcctttaaaatgacatggtttgccatttatttagatactccttatttttctaagcaacatttcatagttttcagtcttttatcttcttgattataggttctcagggcttttggcccttttgatgctattgcaaatgtaactatttccttgattttattttcatattgctcattgctgatataaacagacacaactgatatctggaccaatcttacatcctaaaattaagctgaaaacatttatcagctctagttgttttttgtgggttatatggacttttctttatatataattgtgttatcttaaaatagaaatagttttacgtcttcctttcttacctaaatgccttttatttctctttcttgtctaattgttttggctaggaccttaagtgctatgctgaatagcagtagtgaaattggatatacttggatcttttccccctgattttggggtataagcttttagattttcacaatttgatataaaatacctttggaatttttataaatacattttctcataagaaatttcccttctattcatatctttgagtgattttatcaggaaaagtattgaattttgtcttatgctttctcagcttctattcagatggtctatcttgttagatttttcctttctttctaatatggtggtgtattacattgattgattttcttattgaagcactcttgcactcctcatatagatcccatttagttatggcacataatccttaattttttttaaaaaaatccataatatacaagttgctacattatttctctttcttgtctaattgttttggctgggaccttaagaacgatgctgaatagcagtagtaaaagtagatatacttgggtttttttaccccctgattttagggcataagcttttagattttcacaatttgatataaaacatctttggaatttttataaatacattttattatgataaggaattttcccttctattcatatttttgagtgattttttatattatactttaggttctgggatacatgtgcagaatgtgcaggtttgttacataggtatacatgtgccatggtggtttgctgcacccatcaacctgtcatctaggttttaagccccgcatgaattaagtatttgtcccagtgctctccctccccttgctccccaccccccaacaggccctggtgtgtcatgtttccctccctgtgtccatgtgttctcattgttcaactcccacttttgagtgagaacatgcagtgtttggttttctgttcctgtgttagtttgctgagaacgacgtttccagcttcatccatgtccctgaaaaggacatgaattcattcttttttatggctgcatagtactccatggtgcatatgtgccatattttctttatctagtctatcactgatgggcatttgggttggttccaagtctttgctattgtaaatagtgctgcaataaacacacttgtacatgtgtctttagagtagaatgatttataatcctttgagtatatacccagtaatgggattgctgggtcaaatggtatttctggttttagattcttgaggaattgccacactgtcttccacaatgactgaagtaatttacactcccaccaacagtgtaaaagtgtttctatttctctgcatcatcgccagcatctgttgtttcctgactttttaatgatcaccattctaactggtgtgagatggtatctcattgttaattttatgtgtggatattgtaaatgggattactttttaaaattattttttaaattgttcgctgtaggaatatagaaatactaccgatttttgtatattattttgtatcttgcaactttacggaatttgtttattatttctcatagttttttagtggagtctttatgtttttttaaatataagattatattctctgcaaatgagtataatttgacttcttccattctaattgggatcccctttgtatctttctctgattgctctagctaggtattccagtacaatgttgaataacagtggtgaaagtaagcatccttgttgttttccagaccttagaggaaaggcttttagtttttccctatttagtatgttactagctgttggtcttttgtagatagcttttactatggtgaggtatgttccttctataccctgttttttttagggcttttaccatgaaggggtgttgaattttatcgaataatttttcagtatcaattgaagtgaccatatgctttcgttctttattctgttgatatgatgtaccacatcaattaattggcatatgttaaagcacccttgcatacagggataaatcccacttggttgtgatgagtgagctctttaatgtattcattaatttggtttgcagctattttcttgaggatttttgcatgaatattcctcagagacattggcctataacttttttttttaatgtgtctttggttttgttatcagagtaatactggccttatagaattaatttggaagtattccctccttcactattttgtggaatagtttgagtaggattggtattagttctttaaatatttgctagaattcatcattgaagtcattgggtcttgagcttttctctactaggatgctttctcttgagttcaatctgattatttgctataattttgttcaggttttggatttcttcatggttcaatttcagtaggttgtatgtatctaggaatttgttcattacttctaagttttccaatttattggtatatagttgttcatggtagccaccaatgatcctttgaatacctgtgatatcagttgtaatgccttctttttcatctctgacttatttggatcatgtcacatttttccttagtctggctaaaggtttgtcagctttctttaatgcttctaaagaacaactttttgctttgttaatattttgtattgttttctttatttcaatttatttctgctctgagtttattatttcttttctcctactaattttgggtttggtttgctccagctttcgtagttttttaaagtatattgttaggttgtttatttgatgtttttcttctattttgatagttgacacttacagctattaactttattcttagtaccacttttgctgaatcccataggttttgatatgctgtgttttctcatcatttgtttcaagaaatttttcaattttcttcttaatttcttcattgtcccactgttcactcagaagcatattgtttaattttcatgtatttgaacttatacaaaattgacttaagctggattaatgacttaaatgtaagctccaaaactataaaaaccctagcagaaaatctgggcaatacaattcaggacatctttgggagttttattattaaattcctggaagtagtcttcattgggtttaatctgcttggtgttctatcagcttcttgtacttagatagtgatacctttctctagttttggaaagttctctgttattttcccttaaataaattttctactcccttctctttctctacctcctctttaaggccaataactcttagatttgcattttgagactattttctagatcctgtaggtgtgcttcattgttttttattcttttttcttttgtctcttctaacagtattttcaaatagcttgtgttaaagctcactaattctttcttctgctggatcaattctattctattattctactaaagactccaatgcattcttcagtatgccaattgcatgtttcagctccacaatctctgcttgactcttgtaaattatttcagtctcttcgttatgtttatctgatagaattgtgaatttcttctctgtgttattttgaatatctttaggtttcctcaaaacaactatcttatattctctggctgaaagatcacacatctctgtttctccaggattggtccctggtgccttatttagttcgtgtggtgaggtcatgttttcctggattttctttatacttgtagatattcatcgggggctgggcattctagagttaggtatttttgttgtctttgtagtctggggttttttttgtacacatccttcttgttaggctttccagatattaaaaaggacttaacctattttcgatttgcccctagaatactgcaccggcagtgaactgcactttttttaataaatgggaaatgagttaagtgttgtgatctaagctgtatctgctttaggggcactccaagcccaataatgcagtggttcttgaagacttgtagaggtactgccttgatggtcttggacaagatccaagagaattctctggattaccagaaactcttgttcccttcccttaatttctcccaaataaacaaagtctctctctctgttctgagtcaattgaaactggggatggaatgacacaagcactcatgtatccaccaccactgtgactgcactgggtgagacttaaaacaagcagagcactgggtcttgcccaaagcttgctgcaaccattccctggctactgcctatgtttccaaggatctggggccctacaatcagttggtggtgaatccagccaggcctgtgtccttcccttcagtgaagcaaattcttccagtacccaggcatgtccagaggtaccacccagaagccagggactagagtcaaaaaccttagaagtctatttggtgttctattgtactgcagctgagctgacactcaaaccacaaaatgcagtccttctcactcttccctttcctttccaaaggcagtggaatctcaccccctgagcagtgctaccacaggcccatgcagaatacagaccctgtacaagagccaagtcctggttttggagagtccaggagtgcacttggtgctctaccctcctgtgatcaagctagtacctagttgcaagacaaagtcgactttatatttcactctgatttctcaagtagaaggagtctttcctgatagccagctagctgggaatgtgttgagtcttacctgaagccggtaagcctcagagacttacccaaagccctcaacatagtacctgggtattgctgctagctattcaagccccccactcctcaagcagaagaaagcagtttcttttggaagtgaaaactgtgcagcttgggattaggagaggggggatgtcagcactcccttacccatccccagctgctgtctcagtaggttgcacctcccaccccagtctactgtctctgggcccagttcagcaccaggactcacataaaagttacagtacttgtagccaacactgcctttcaggtttatttaccatcccagagccctatagtccacagtgatgaggcttgtagaaactcggttccaaccactggtatcagagattcacctctggccagggctggtttaaatgctccctctgtgagtgggcatcagctgattttgggcctgttttcctttctgccttaacagaactgcactaattttatgctctataattgctgtgctctccctccctcagtactcagaaatactctctgaaccatgccactgctgccaggggaagagaggatgtcagtaattcaatagtattttttctatctcttcatttcctctttcagtgatatatatttaaatcaaggtgcatgctcatctgattttggttcttatgaaggtacattttgtgtagatagctgttaaactgatgtctttgcttggggaataatcaatgaagcattcaattctgtcatcttgctccactctcccatttgtatatcttcttttgagaaatttctgttcatgttgtttgcccactttctaatgggattattcggatttttttcttgctgttttgagtttcttgtagactctggaaaatagtcctttgttgaaggtatattttgcaaatattttctcccattctgtaggttgtatgtttactctgcttgtcatttcttttactgtgcagaagctctttagtttaattaggtcccattgtcaactgtttttgttgaaattgcttttaaacattgagtcataaatccttagcctacaccaatgctcagaagagttttttataggttttttctagaatttttatgatttcaagtctcatatttaagtctttagtccatcttgagttaatttttgtatgtggtgagatataagaatcatatttcattcttctacatgttcccctgggtaatatcagccaagcacaaatcccgcagctaccagcgtaggtggctctttcctgcaagaaccacctcctagctggaagccaataggcacagcctattacaacatctgctggcaaaataacatagcatttgggaaggagaaaacttttatcgtatctcagctaacaccatacccacatcaccccagctaatcggaaggtcttgagtgtgttcacaaacccaatacattgctagtacagctggcatttgagaaaattaccacactaaacctatttataaccaagtaaatcttacaaagtctatgtcactctcttgccacctcgatcagaggtggtgcttgcacctgctgctaggagaccagaggacagttaggcccagttaagccccattcaacattgccctcctttgtagcaaagagtggaacccaagcactgtacatctctcaaacctttccacagcctgaggcatcagagatttccagttggctgacaaagatgtcaatgttcaattatcctcagaaggaagagccaatattacaggtgaataatcataagccaaatggactgttaaagagagagcaatggagcttattggtcaattcataagaagaaagaatctacaactcacaaacacgcacacacacatacacacaaataaagtaaaaagaagctggcagaggtgaaaccctgagagacttagtaatccatggaaagggcaggtaggagtgttctcagcctccctacccaatttggcagactgctgggatctgaactcaaggtgaccttccttgccttcatgagcacaagtactggagtaggctgtggttttgagacttctcgaggatattaccttgttcacacaaggtccctttccttttccttggatctgagctgtttttaactattttggtagaattcactagtgaagtaatcttgagctggaactttttttgaggggggtggagttcttgattactaattcaaataattttcttattgtaggtgtattcacactttcaatttatgagaactttattcgattagtcccttggccttggcatttgcattgcccctactcttctttatccaatataggcagttaatgcctcaagtttttgtattaataattgccatttctcttcactttgtattttcctatttattcctgaacttattcctaagaataagttgcctgttgcctatctggattacaactttgttagacctgtcttgtctttgtgaactcattctctttcactatatttcattcttggttttgttgacatatttgttttacacatttcagctttgtaatgaatatgtaggtgatactgagtctttgtaaatttttgacagaagaaaattgcaaactcttgattcaagagtgtaacacttttcatgatatagccctaatttacctatatctataaactaaaattgtgttcacttacaaataataaaaaaatcataaaaatgaatgtgttaggctgttcttgcatttctataaagaaatatctgaggccagataatttataagaacatgaggcccaattggctcacggttctgcaggctgtacaagcatgatgcttgcatctgctcagcttttggagagtcctcagggagtatttgctcatagcagaaggcaaagcaggaacaggcacgtcacatggcaagaggagaagcaagttggggaaacagttttaaaaaaccagatcttatgtgaactcacttattatcaggataacatcaagggaaataatgctcatgagaaatctacccccatgacccaatcacctctcaccagattccacctataacaatggggattaagtttcaacaaaagatttgggagagataaatatttattatccaaactatatcaagagcttaatcaaatagttggcttatatatctcaaatacaagaagtcttatagtgggctagactagaaataatatggtagccctgaagcatgagagagtcaagtgccttcttttttttttttttttttttaccatatttagtatagaagtcttcattactatgatcaaatgctcatgtcccaagatgatgtcaatcctacctcccccttcacatttgtgttttgagtaatgaggagaaaagagaagaagattcatgttctggtttgaatgtgtcctctacagttcatgtgctaaaagtgaatgcccaatgcaacagtgtttgtgggtgcagcctaacaaaacatgactaggtcatcagtgttctgacctcataaatatactcatgttgttattgcaagagtggggtagttcttgatagcttgttataaatgtgagtgtgccccccccaattgctctcactcttaccctttcttgcccttctactttttgccatgcaatgaaataggatgaaggccattgccagaagccagtgccatgctcttggacttcccagccttcagaatcatcagaaataaatttcttttctttataaattaccaagtctatagtattctgttttataacacaaattgaagtaagacagggcatcagtatacttctgcttttatttctggggaaagaaatattctgtgtgactaacctaagcagcgaatgatttcatgaatggaacttgtaggtctgtcaggaaataaagtttgagtcaactgatctgcagtttctgccataccacacagttgctttttctaatactgtactgtccagtatctcttttggctaactttaaaaaatagtatgttttttaaaatttagtgtatttagatatactggcacataatttgtcagataattgcatgaaatcacttctaggaaaaggacaaccaaaagtcagaattcaatattgaaaacttggttggcactgtagctgatctatttgttgctggaacagagacaacaagcaccactctgagatatggactcctgctcctgctgaagcacccagaggtcacaggtaggaccacagatgatgaacaaagtgaatttcagaacaatgctgagaagatggtgccagtatcctccaccttgtttctctcagagaaggctcattctttaaatttctgtgtcatcagctgtaatctgtctaaatttgatgacacaatttaaaatgacatctttgtacaatggaggaggatgacagagatcagtaaaaacagtatggcagtagcaaaataagtaaagcactgatgaagtgtctggatttcagcaaaggtaatttgtggtaaggagagccagcataaattgccctagtattgaatgttggttttattatgaaaagtccactttgaacagtaggttcatttctcattttaaaaattccatgctctaatgctgtggtggggagatgaaaacaatctttattgaagcataagtggaaattctagaattgtactgaggcatcctgacataaattccagtctgggaagtaatctaaaagttagtctcttacaaaggtgtttctatttaagcagaggccatacctaaaggaattttattattctaggagtgtgtttcataaaaatgctatttgaccaaatagggatatttggaagggggtttaataattgcatctttcacatacaacttttctttagaatttacaatttacctttagagtaaactctacatttccttagaatttacatttaaatagttcctgctttgcagcagataacatacctttttccctgtgtcaggatcccactgaaatttcaataactaaattacaaattaaaattatcctgctgaagtgaaaagagaggagaatagaaaatagccaataagtctttggcaaatttctaaaacatggagagacaatggagggctgacaattgacacagcatagaggatggagttgtaagtattagcagaggaagatttatcaagaggagaagctaatctgtgtcactgtgattctcataaggttcagtatttggaggcaccaagagccaaagacagtagggaatgagactgaaaagggaggctctcctgcccaagtttcctccataactccttttatcaggtacctgattttttcccactgggaaagggaagcatactctccagagaaactgagcctaagaacccctgtactcggcgacactttacagggccaggaaactgtgagatgtgaagacagaaaaaaaaaaggtttgagaaagatctattcctcagattcaaagactcagcatttttcttcatcttgcttcctgacattcagcagccagctagatactctccagagaagaaacaagtctggagaaaagacctccgtattttgccaacttaatagaaagttatctataaatgtccagcagagtgaatgaaattaaaacatccatcacaggacacaaagtcatggaatttcagagcaccagaagtaaagggaaaattaaaatctttcagagagttatatcaggtcatatataaaatatcagcattcaaacagcatcagaattctcaagcatactatcttgtgtattcatagaaaaaaagtatttgggacctacatggttgctacaaattttaccctctatactaagtttctccaatactgggggttgtgctccatctcatgtctgaaactaagtcagaagaaataatgggtgccaggaatcaggagacctcatgtaagagaatgagagtgtcagagaggctgctgtgctcctaggaaacaaccacttcagaagggaccaggtgaataatacatgtagaggagacttcaagaatcaaagagatgtgattgatagtctgagatttccctataattgggaaattattactaggagtttcaaacatgtgcaaatactctaacttgaagaatagaaaattgtgatttaactaaagaaccaaggaagaatgtgtatgtgtgtatatgtgtgtgtgtgtgtgtgtgtgtgtgcttctgtgagtatatttagaatgatgtaaacaatgaatagtgatataaccagaaattgtggtctaaatatattctggtaagtagaaggaggagaattgtgtgtgtgtacgtgtgtgggtgtgtctgtgtgtacacatataactttgtgggcgtgtgtctatatatggaatagagatggagatgaaaattctcatctctcataccagaaaatcattaaatattgtctaaaaattgttaagtaaaaaatagaaagaaatagtggttatttagaaatacaaatataaatttcagaagaaactgctagcatgctcaaagtggccacaattggaaatggaagaatgaagacagtaccattgctaattgcatcactgcccctgctccaccaccgcacacacaaatatatttataaaaccattacaatttaacattataccccatatattattttgataatacatatttgattgtttttctgtttgcaagcactgtaatttattgacttattatgttctgtttattttttaaataatgtattacttaaatttgtattgtcatatatgctaatttatagaaatgtacttatgcactgtaatgactagtttgtaggagagtggtatgtatctatattatggtaattctttttatatggctggttgtacttctggacatgtaactcatgtttgtaatgttgctgggatttttatatcatgttaatgtggccatgaattgctatgacaaatgttccatatatcttcgtttccatcagttctttcttgtgtcttgtcagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaaggtaagcttgtttctcttacactatatttctgtacttctgaaatttccaaagtgctggtttggttccaaccctctaacaacacaagatgagagaagtgcaaaactcatacatgtggcagcttgatggactttctgctattttgtttggggctataaagatttataaagctaggtctccttaataggctgctcttaggtgttacactttcaaataattgttgaaaatatcagtgtgtcaatttcccaaaacactcttctgagatttttatcaaagtgacattcattgtgtagttcgatatggaaagacttaacatgttcatgcattgaattttttaattcatgaatatggttatgctcccaacttattgagctttattctattttctcagtaatgtcttattttcagtgcagtggtttacaactcttttattaggtttttcctagataattaatattttgttgtgttataattttttaattttttttatttctttgtaattggtataagtaattgtattcaattatactattctgatgaccttatatctaacaactttcctaaatttactgatcattgctgataatttatctgtagatatacttggaatttctatgtatattattttgctatctgggttaatatgtattttatatcttattttccaatgattttgtcttcaatttatctttattgcattattgtgctggataggattttcaggttagcattgaacagaattggtgatagagggcatccttatttcatttctgatctgctggggggtagagtataagaatattaatatttcactactgagaatgatgttttaagtattttttttaaataattgacttttatttaacttcatttataaaagaattttcacgaatatagtttgaaatgatactctacatttgttatgaaacagatagttggtattttcataaaatcccagcccccagaaggctcatgtcattccaagtgatcagactcctgtaccttccctaaataaggctagcaaactggggatggcagggagcagagcccagagcaccttggtagttttgcacagatttttttttttttttttttttttgagacggagtctcgctctgtcgcccaggctggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggactacaggcgtgagccaccgcgcccggccttgcacagattttttaaaagccagtaacttccttctggctgttctaaaagacaaacactttggagaaaagttgtgcagtaagggaaactatcaaaaatcattctcatagaacagtaaggcagtgaggcaaacacgatctccctcatgattttaaagtctgtaatagaaattaacagtgtcatctgcagcccaattatgcactttaagatcccaaaaaattgctgctgttttaagtattttagtagatattctttatcagaaatctttaagattttagtagatatcctttatcagattagggaagttttttctcttctctcatttttatataaatttgtgtcatgaatgtgtgtgcaattttatcaaattgattctctgcatctatttatatgattgtatatactggcctcacatccctcactaaatatacataagtatacacaaacagctggatttgttctgttacttattgttcaggacttctgtattcataagatattttggtctgcaatttttcttcctcaaaattttcttttcagagctttgataacaagataatgctggctgcataaaactaggtgagaaacgttccctaatgtgggtctgtttttattgctttcccttccttccacttttcttcgtgtgactgcttagttgtatccttgaaatgcctaaaaacctatggctcagtaccagatattatatatgaaaaaatgcagaatttcagagaacatttatctttttccagaatgtattcattcccctctcataggcaattataatgacaacacctcctgtcctgattcagaattgaatatgacatgaacacagtcaaaaattgactgtaggtatgagcttacctctctgaagttcttccgtcactggggccaattattgtctttataatctggaggccaattttggtctttgcagctttacaatgctgtctatcacatggtttctgtattcatccagatgttttagttgctatgctataaactacacaattccacttattatttttcaattaaaaataataaaggttatatcttcatgaaggaaaacaatgagactgataaggtttcaattactaatgtcatcctctggagaagacagaattgataacttatcaagatgtgatggggttttccctaattatcactgatttttttacaaggattaggactacaatccacagttttcatcaaagcacacaaccagaagaggtttttctttctcaatacaagggtctatctacacctcaatactgcagtatgtaatgccccaaaacaaagatttttcttttacacaataatagtcacactcagtagctattgttcaaataataatacagcctaaatttaaattttcacaatttttctagaatatttttatggcttttttctcctgcagtttactatacaggcaaggaacaagcatatagttcatttatgttgaccttttcacctcctgtaatcaaggaaagttcctttcctggtttgtttcttttcaatcagttgacctttttgagaccagcagtcatttaaaatgttcctcaggctggttttctatgactgttttctagaggcagattccagctacaattttggcaagaaaactacataggtgctttaaatatcctgctgaatcacattgatgaggtgggagcatgaaatgtcacatatgtcattattggtcatgctaagttccccacataataaggttgtatcctccagatcttaccattgtaggggttctgctttttatatgcaactagtaaaaatctatgggagtgcattaagattatccgaaactcctgcttccagaatcacacacccaacggttctagctttaattgatgatccttacctgacctgatgatcctgacttgaattgttgcaaagtgataatctttgtaatttcatcatcttttcagtgttttaagctaaaattaatctgtagcatggcagtaataaacacacaatagtttttacttcttattgcacttgtggttgtcatcccagatgacatcatattaaaatagattacatgtttatttacaaaagttctatgaacagatactctggacatttcaagtgtcaacagagacttccattttaaaccataatctacataatcaaaatacaagatgtgtcaaatttgaagtgatgaaatagagcggcaaatgaggccagaaaagggcatccaaacttgatgatctggagaacacattcagaaggttgcacacaagtatccaagatgtaagacttcaaatgtgattggaaagctctttagcaagcttccaccactggccttaagctcatccatgtaaattactgtgtctggctggacctgagtttcctcatctatagatcaacgttatggcgctacgtgatgtccactacttctcctcacttctggacttctttataaatcagattatctgttttgttacttccagggcacaaccataatggcattactgacttccgtgctacatgatgacaaagaatttcctaatccaaatatctttgaccctggccactttctagataagaatggcaactttaagaaaagtgactacttcatgcctttctcagcaggtaatagaaactcgtttccatttgtatttaaaggaaagagagaactttttggaattagttggaatttacatggcacctcctctggggctggtagaattgctatttgtccatgatcaagagcaccactcttaacacccatgtgctccaccctcacaatacaccatcattattgggccagatagcggggcttgcaggagttaactctgttgttcccaattgagaaaatgaacatcttggtttgactgaactctgccactagatacatcactaaggcacccaagagctcctcctagaaggtaaaattcatctgatctttccttacctgccttgacaaatgtatctaagtccacaactgcattgagtgtcttctacatggtgtctgtcacctcccaggctgagctccaagggcacaactttcaatgagaacagaggctcactcttgagttagggaagaagagtaaacaggtcattgtaatttagtcagaccaggactgtgagagaggaaagcacaggcccttgggtagcggctagagggggactctgcatgcttcttgctctctcatataacacagtgaggcataaaatggagtaagcaactcagaggatgtttcatgtgcttcaaaggaggtgataaaatttaagggaagctaagaggttacataagctaagaggttattttgcagtgattccagagcaccctgtcttcttccaatcatgatcatatatcctggatacttgcttttcacacctgtgttttgtgtgctaagtctctggccatggaatctccttcctttattctttgatcttttatgtctgctttatatttggcactgtagataccaacatgacaaggacagagaccttccttcaagaattcacattttaccacaatagataaataaatacagaattacgattcctggtaatctgtgctttaatgaaagcatgagtatgctgttgaggaaaaccagagagcataggatttgattacttgaggggattgtaaagagtgtgaagatgaaatgaaattgaacctatgtcctgaatgtagcctaataaagatgtatcttagccaaaatgaacaacaggatatgaaacttgaaacttcatggtgtgttcaagattgatgaagagagtgtatgaccagagctgagaacagattatgtgaaaagtggaaggaaaaatcatggaatatcaggcttggaacaggaaacaagaatgtgcatgtatttccataatgacagatggaaactcaaaatggcaaaagagctgttttaatgtgggaataaataaagaaatgactgttatggagctgataatcaatgaatatttgttgaatgaagggtgcctattgagattagatgttagacagatagcaaatatatctctttttgtacatttgtttgtcccaccatccattaatcaatccatcatgtcatccatccattcatccacatgttcattcatctacccaatcattaatcaattatttactgcatattctgtttgtgcaagtcacaaatgactgtttgtcacagtcacagttaaacacaaggagtaactacttcctttctttgttatcttcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcagttctcagactttccctcttttgtgcataatgcaagaaataaagaaaagagagtgccaggaggccaggcttgtcctcataataataagcagatagtgacaaaggagaagagggtgaggaaggtctctggatgtttgtcatctagagttactgaaggtttggctttataacagagaaagtctgtccaagggaagaaacaaccttcagggaaatattgagaaaatcagttcagttgtgtattatttggagataaaatgaggctaattacttcagggccatagaatcaaattaccaatgcatttatgttaagtgtaaaacaagaaatataaattagaaaaataatgtaatctgttgagactttccaaggattttgttcttgtttggagacagaagaataaaacccagaacatatgattagcaatatgaaagtatatattcatacttgactctaagttgaaaacataaagtgaaaaaaattcaaatattattagtgttcacaataataccaaaacagaggcatgaatttagacacttaatctccatttctacttcactgatccactcatctttaaccccataggcgaaaaaatggagcagggacatgagggcactcaagcacaaagcctctataaacagtcagaaccagtacagcaggttcagtggtcctcttatcagaataaagttactgaaatcagtctcttgtccaatgaaagctgtagctatggcttgtggaacagtgggaaggggtgagcatctggtggaggcccgtgcttgtatagttgctagagaaaaattaaaaccttgtgccagttagaacacagtttattctttaagtgtagaggtgaatgacctaactcttgcctgccatgaccttaggtcctatttataagttggtatcttattgccacaaaaagtccaccccatcagtcttacgacctctattttaacactaatgttgatgagttgttttgtgtaaaccacaaaagagagggggtctaaagaggcgtgtctgacctcccatcctctcgtggccaggaatagtttttaaggtttttgctgaggttcccttgtccaagcaggcttaggatttatttttagtttacaataattacaaaatttcaaagaatctacccacagaatacatctaagttacatagttgagaagaacctagttacaatggagaagacagccacaaactatctaaacctagtaatcaaatgacatcattctgatgaaacacattgaaattgtctatcactcaaaaatgaaaagtatcctctgtgatattcctagcagagattcctctgctgaatttagtcatcaaaaaacatcagacaggcctaaattgagggacattttataagtattcagcctatactctcaaagagtggcaatgtcttggaagtcaaataataactgaagaactgctccacactgaagttgatgaaagagacatgacagctagttgtggcatgcgattctggattctgaactaaattatgagagggacaaaaagcatatattttgggacttttggtaaaacaccaacaggaacaagaattagaaagttccagtgcattaacattaattttctgatcctgatggttttactatagttatataagagaagcacaagcacattgttttgagtaaatacatactaaaatacctcaagtatctggaatcaggttagtatttactttcaaaaggttccatgtgaaacaattatttgcatgaacaagcagttcttctatataccagtgattgtttttttaaaaaataaagccaacagtgcgcttatgtatgcaaaataaactaggctttcacaaatgaaggatcactgttgacaatgcaaacttgaattgctcagcatcattaagctttatggaaatacaaactaaaacttcaattagatattattatataattcatcagaatggttcaaatgaaaaaaggacacattatgttgtctgttgatgagaaagcgaaacaatcacagtctca

SEQ ID NO: 16404 - DNA, 36821 bp, Human; identical to SEQ ID NO: 16403

SEQ ID NO: 16405 - DNA, 51547 bp, Human
aaatgattattataaagacagcaaccgagcttattttacccaaaataaggtagtatatttctgttagagtttagagtttcatgagtcagggaccaagttattgcttttctttgccctgtataaaggcttctccaaggcctttgacttacctaagtactaaatgttataaaaccaaactcttctgacctctcaatctagtcaactggggctgtaattattaatgaaattaatgtttattttgaaaataatttactagactgaattacgaaatcctgaatcattgtacactatcagtaaatattggtggacccaactgaactgaatgttttgcttgaaatgaaacctttgagatgcagggcttatgggttctagtcccagctctagcactagcagacagcatgttcttggctaagatactgaatcttcaaggctcagcttcctcattccggaaatgggtcaattttattgtaagcagaggtaattgagagattcaaaagggacatgaggtgtaacaattctctgtaaattgttagaatccctgttaaaaatgaccagtaaagctttgtgcaactgtgtcttgacataactttatttttcttaataaaagaaatggaaataacctcactagggaatttagaacaaatatgatgatatctttaaagaaaatggctttgcacaagtattgacattaatgatctagtaaagtgtatctttctagttgtatttagatcctcaactcagtatgtcagctcctgttaaggtctatacattgtggtggttctgtgctgtgggtccatttagtgatttccctacctcccatcttttattgcatccacaactgtggttctgtccataatttcctttgctttctgtgcattattacatcatatctgaaaatgagaaaccaaaaacaatagaaagcagccatgtctggaggtgactggggggtcgagaagccctagtttctcaaacccttagcaccaaatttttccctcagttacactgagcgtttcacttctgcagtgatggagaagggagatcccttatttcttctcatgagcatctctggtgctgtttcccttagagacaaataaggggttctatttaatgtgaagcctgttttatgaacagaataaatgtggtgtatattcagaataactaatgtttggaagtttgttttattttgctaaaattgttctcaaggcagctctggtgtaagagataatacaccacgatgggcatcagaagacctcagctcaaatcccagttctgccagctatgagctgtgtggcaccaacaggtgtcctgttctcccagggtctcccttttcccatttgaaaaataaaaaataacaattcctgccttcaggaattttttttagggggtttaatggtaaaggtgtttatatctgctaaggtaatttacttgatatatgtttggttatttaagatatatgagttatgttagctatttcatgtttaggctgctgtatttttagtaggctatattaaatatttgaaaggatttcattataaagaacaaagtctcctaatctttgatatagcattgacatactttttaaatatacaaggcatagaatatggccatttctgttaaatcatatattcccaactggttattaatctaagaattcagaattttgagtaattgcttttgcatcagattatttacttcagtgctctcaattatgatggtgcattagaaccatctgggttaacatttgttttttattaccaatacctaggctccaaccaagtacagtgaaactggaatgtacagagtggacaatggaacgaaggagaacaagaccaaaggacattttatttttatctgtatcagtgggtcaaagtcctttcagaaggagcatatagtggacctaggtgattggtcaatttatccatcaaagaggcacacaccgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatgtaagtatgctccttcagtggcttgcaaaaggtaagtaaattcacctgtattttttaaataaagtgtatccctagaggtacatgttacaagaggtaatggtaaagtaaaatactttgaaaggcttttgttgccttttccagtctgtcagtgtcagaaatagtggaatgaaaccatgtattttgtgagtagagaaagatttgggtctttgcatgttagattcaaaataacaagtgtcaatagtttgaaaagctgtgttccttcttcatttcataaccatttgctataatttttggctgaaggtaaatggtaaggtattgtgggatctggtcagcagcccacaaagcaactgggctctctcttttttcccaggtggatcggcaggttgagaaataatagacacacaagatagtgaaagctgggtccaggggggtcaccgccttctggtcccatggtgccaagaatgcactggatataccagcatttattattaagtttagtgagggcaggggtaggttagtgagggatttagggtcatttgattatgaggtgagatggtcacatggggatgaagtaattctttaacataacatttgtatgtagaagtacagtacatttgtatgtagaagtacagtatacggagataagaatttacaatatagtgtgtgcgtcagtaatttctaacagagccttaaaacagaaacacaatctttccataacctatgattagcaagatattaatcagcagtaacaattgcaacaaaagctggttacaaacaatccatggaaataggatgtgaagctagacaaccagttagaccagaaattctcagaagggagtatgccttaaccctaaagaggcctagaagagccatggcaagatgagggcatttatagccctatcttatccatatggacaggtgccccccatgcgtccatttataggttctccacaaaggtcgcattccattcccagagctatgaacatctgcttttctgggataggaatcttggtgatgtgaaacctctctgactgcacgtccattcataggctctctgcagggggaagcacatcacgcgctgttggctcattctggcagtccagcctggcactgtccttacacaatcctgcatgcaattttgtatttacaataatcgggagcatttcatcttttattccgtagcaatagtttcagggggggtctccctacagtaaggaacatgtttgttattagagattttattaaataagtcctctactatattagccatgtgttttattcagaatagccatgaaaattaaacttctctgaagaattaatttatgcctgttgtaaaggaaataactgtgggttcaggaccagcaaaagcagataagtggtagaaaagaagttatagacttccatttttagatccacaaagtactgttttaattatactatagctacaatatataaaccccaaaatgaccttagcatttagtaatggtaggaagaaggtcagaagatgtataagtattagggttttttctcaagtgaaagatggtttagcagtgttaatatgatatgtgaacacccctcgttgtgtaataattaccatatacagagagtaaagggctgcaattagtatattaagtcttataagcatgatggtatgattagatcaagagaatgacgctgtagttatgaagactactcctactagattgatggtagggggcagggcaaggttggcaagactagctaggagtcatcacatggctatcagggagagaagtgtttgaaggccttgtgttagtagtatggtttggctgtgaactcgtttgtagtttgagtttgcaaggcagaataatagggatgaggttagtctgtgggcagttattagggaagttgcactggtaaaacttcagggggtttgaatgagaaaagctatgataacaagtgccatgtggcttatggaaaagtaatgagtgattttagatcagtttggcacagacaaaaggagcttgttatgattatttctcaaaaggatagtaagaaggaggaataagctataaactctgttagggggttaagaattaaggtgatttgtataatcctatagccatctaattttaggagtactgctgtgaggactattgacctggcaattgcggcctctatgtgggcttttgggagtcctaggtggagtccatagagagatatttttagtataaatgctatgatgcatgctaatcataaaaggctattaaaccaggaaattgttagttcttgaagctgggtattggtcttaaggtagactcgaaagtgctgataaatttctcaagcatcagtgtttgaataagcggagtttcaaattttggtctgctgtacattagctgtgagacactgaaaatgaatttgtcattctctgagctcagttttttttttttttttttttttttttgagacagagtcttactctgtagctcaggctggagtgcagtggtacaatcttggctcactgcaacctccatctcccaggtccccattcaagaaattctcctgcctcagtcccccaagtagctagcattacaggcatgcaccaccatgctcagctaatttttgtatttttagtagagacgtggtatcaccttgttggccaggctggtcttgaactcctgaccttgtgatccacctgccttggcctcccaaagtgttgggattacaggcaggagccaccacacctggccgtttgtttaaaatagagtaaatagacctgctgaatatgttgatgtgagtattaattgtaatctgcatagcaattgtctgaccattgccttgaacatcacaggccatctgagtggcaagtataatcatcatcatgtttctatttaaaattcagaaatatttgaagcctgtgtggctgaataaaagcatacaaatacaatgaaaatatcatgctaaatcaggcttagcaaatggacaaaatagtaacttcgtttgctgttatctctgtctactttcctagctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggtaggtgtgcatgtgcctgtttcagcatctgtcttggggatggggaggatggaaaacagagacttacagagctcctcgggcagagcttggcccatccacatggctgcccagtgtcagcttcctctttcttgcctgggatctccctcctagtttcgtttctcttcctgttaggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaagggtgggtgaccctactccatatcactgaccttactggactactatcttctctactgacattcttggaaacatttcaggggtggccatatctttcattatgagtcctggttgttagctcatgtgaagcgggggtttgaagctgagagccaagggaatttgcacatatttgtgctgtgtgtgtacaggcatgattgtgcgtacagtgtgggtataaaaggttcatttaatcccatgttctcctgaactttgcttttttgctttcaaataagaaatgatgaatatagattttgagttcattttttgaaagagttaaagagcagtgtttttcccattacctattccagaacatgtcaccagagaatacttgacaagtcaacatggtgggaatggccctatcatacccatatggagcatgaaccaaatggcatgtgcttttatttaattggactgtgtttgtatggtcagcctcactgacttctctggggtttcttttaggcccgtgcttgccattctggccagtaatgacattctacagtttttattgcttaggcatatcttagtgcagttctcatcaattattatttctctgtaaacacagcattattttaaaaatagtattaattatttcttgttactgtattgatttatatattttcagtaaatacatcctgtagcataattctgtgaaatacccaaatgtcaatttataaaatgatttatttaacaagattttacttattagtaataactctgtaatctgcattccctatgtatgatttggctctgtttcagttttgcttatctctttccaaccatatttatgaaattttggcttagaaatttatgttaattattttttttccatggccaactctactcatctatgaagttttacaatgaatctgtttatcagcttggataccaaattaccttgtttttaaattctgttttcccaatgaagttaaagactgaaaatcagatttatctgtgaatgacacacacaaactaacagatttccaactgttcaatgcctggccattcattcagagtacttttgattaaagtcactatttagggcctatagatatcaggggaaattcagcccctgatatttcaatgtgaatccttttctattctccctaagtgttggctggtctgagaaataaagggaaagagtacaaaagagagaaattttaaagctgggtgtccaggggagacatcacatgtcggcaggttccgtgatgccccctaaaccacaaaaccagcaagttttcattagtgattttcaaaagcggaaggaatgtgtgaatagggtgtgagtcacagagatcacatgcttcacaaggtaataaaatatcacaaggcaaatggaggcagggtgagatcacaggaccggagtgaaattaaaattgctaatgaagtttcaggcactcattgtcattgataacatctcatcaggagacagggtttgagagaagacaaccagtctgaccaaaatttattaggcaggaatttcctcttcctaataagcctgggagcactatgggagaccaggccttatttcatcccttatctacaactgtaaaagacagacgttctcaaaacagccattttagagaccaccccttgggaatgcattcttctcagggatgttccttgctgagaaaaagaattcagtgatatttctcctacttgcttttgaaagaagtgaaatatggctctgttctgctcagcccacaggcagccagacttcaaggttatctcacttgttccctgaacatcgctgttatcctgttttttttttcaaggtgcagatttcatattgtttaaacaatttgtgcagttaacacaatcatcacagggtcctgaggtgacattcgtcctcagcttaggaagatgatggtattaagagattaaagtaaagacaggcataggaaatcacaagagtattgattggggaagtggtaagtgtccatgaaattttcacaatttatgttcagagattgcagtaaagacaggtgtaagaaattataaaagaatgaatttggggaactaataaatgtctgtgaaatcttcacaatttatcttcttctgccatggcttcagctggtccctccgttcggggtccctgacttcctgaaacatatagatgtgaatttgggagctctttaactataaagtttaatatctcaaaataataagagctatttatgacaaacccatagccaatatcatattgaatgggcaaaagctggaagcattccctttgaaaaccagcacaagacaaggatgccctctctcaccactcttattcaacatagtattggaagtcctggccagagcaatcagtcaagggggtattcaaatgggaagagaagaagtcaaattgtctctgtttgcaggtgacatgactgtatacttagaaaccccatcatctcagccccaaaactgtttaagctgataagcaatttcagcaaggcctcaggatacaaaatcaatgtgcaaaaataacaagcattcctataaaccaataatagacaagcagagagccaaatcatgagtggactcccattcacaattgctacaaagggaataaaatgcctacttacacaacttacaagcgatgtgaaggacctcttcaaggagaactacaaaccacttctcaaggaaataagaggtgacacaaatggaaaaaaattccgtgctcatgaatagaaagaatcaatactgtgaaaatagccatactgcccaaagtaattcatagattcaatgctatacccgtcaaactatcattgactttcttcacagaactagaaaagaataatttaaatttcatatgaagcaaaaaaagagcctgtatagccaagacaatcctaagcaaaaacaaagctggaggcatcattctacctgacttcaaacaatactacaaggctacagtaaccaaacagcatggtactgggaaaactggctagccatatgcagaaaacagaaactggaccctttccttacaccttatacaaaaattaactcaagatggattaaacacttaaacataaaaccaaaaaccataaaaaccccagaagaaaacctaggcaataccattcaggacataggcatgggccaagagtttgtgactaaaacacaaaaagcaatggcaacaaaagccaaaattgacaaatgggatctaattaaactacagtgcttctgcacagccaaagaaactgcatcagagtcaacaggcaacctacagaatgggagaaattttttgcaatctatccatctgacaaagggctaatatccagaatccacaaagaacttaaatttacaagaaaaaaagaaatatccccatcaaaaatggacaaaggatatgaacagatgcttctcaaaagaagacatttatgcagccaacaaacatatggaaaaaagcttatcaacactggtcattagagaatgcaaatcaaaactacaatgagataccatctcatgtcagttagaatggtgatccttactaagtcaggaaacaacaggtgttggtgagaatgttgagaaatatgaaccctcttacactgttggtaggagtgtaaattagttcaaccattgtggaagacagtgtggtgattccttaaggatctagaactagaaattccacttgactcagcaatcccattactgggtatatgcccaaaggattataaaccattctactataatgacacacgcccatgtatgtttatgtggcaccgttcacaatagcaaagacttggaaccaacccaaatgcccatcaatgatgtactggataaagaaaatgtggcacatatacaccatggaatactacacagccataaaaaaggatgagttcatgtcctttgcaggaacatggatgaagctggaaatcatcatcctcagcaactaacacaggaacagaaaaccaaactccacatgtttgcactcataaatgggagttgaacaatgagaacacatggacacagggaggggaacatcacacatgggacctgttggggcacggggggccagcagggggacagcattaggacaaatacctaatgcgtgtggggcttaaaacctagatgacaggttcataggtgcagcaaaccaccatggcacatgtatacctctgtaacaaacctgcacgctctgcacatgtatcctggaacttaaagtaaaataaaagaaaatttaaaaaatataaagtttatcgatcacttgattataacaacttcatttcagagatcctccaccaaacaagaaaacttttcctataatttaattcatttagctattaaatgatacgctgggcctaatcaatatcaaattaaataggttaaatttgcaggatgattagagatgagggcatttagttcctaaagaagaaaattcattttaaaaaaggtacagaagaaaaaaactccacttatcaatttacactttcttgtttgccttacctgggatttatatttaaaataaaagtttttggccaggcgcggtggctcatgcctgtaatcccacaactttgggaggccaaggctggtggatcatctgaggttgggagttcgagaccagcctgaccaacatggaggaacctgtctctactaaatatacaaaattagctggatgtggtggcacatgcctgtaatcccagctacctgggaagctcaggtggagaatcacttgaacctaggaagcagaggttgtggtgagctgagatcgtgccattacactccagcccaggcaacaagagtgaaactccatctcaaaacaaacaaataaacaaaaaacaacaacaacaaaaaacaacaacaaagttttcatttaattttttaacaaactaatctatgttaatttgatattagtttgttaacataacaaactaataatatgttaggcatattattcatttatatttgttttccttctcataaaacacattctgctcttacatttattttcttaaatacatgaattcaccaacagtctctttggttcctctctactggttcaacacatgactctttcagctattcattatatataaaaagctttgaaatctccaactattcttgccctttccatctcagtgccttgctgtctactgactttgcagactgatgtgattccctctgaaacatgaattattaggtttttagaaaatgcctttttgttctttccaaagtaaaagacaaataggctgggaatgtaaatttagcatttgaacaaccattatttaaccagctaggttgtaatggtcaactcaggattaatgtaaaagtgaagtgttgattttatgcatgccgaactcttttttgctgttaagggaatttgtaggtaagataatttctaaactactattatctgttaacaaatacagtgttttatatctaaagtttaatagtattttaaattgtttctaattatttagcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccaggtaaggccaagatttttgcttcctgagaaaccacttattctcttttttttctgacaaatccaaaattctacatggatcaagctctgaagtgcatttttgaatactacagtcttgcccagacagccttggggtgaatatctgggaaagacggccaagccctttattttatgcatgggaaataaatgcctcaatataggcctgatttctaagcccattagctccctcatcaatgttttttctgctaaactccaaagccctgtttctgtaaagtactttgttgacagccctaaagcgtgctcatagcactccatggatatccaggcactttggaggctcccattactcacaagacttgtccttcaattaacactttgtcgtattatgtggcagaaatatcctaatttaaaagacattatctccttctagtagggagaatatttgggaccatagaagctgccaagaaacactgaatagggcaggggtgtttgatatctcagttgggatcctagctgatgagatagctgggttaggaatgacaaaattattggttttatggtgtatgaaccataaacagacatcacacttataccctgtgctgagctggcatgttttattctctgcctaaataataattgtgtgattttatagaagtcatttaactgctctggtgcacagttggaatttgaagtatctttgagcccctcccacttctaaaatactaattccatttcagaggctgcttgatagaaatcaatatagtagggactagctttgtactatcaatcaggttgtccaaattcttttaacctatgctgtcatctacaaaacgtgaatgtagtaattcatgccatcttatatttcaagattatagagaagaattgtaaaaagtaacagaattaacataaagatgcttttatactataaaaaggaggtctgagtctaggaaatgattatcatctggttagaattgatcctctggtcagaattttctttctcaaatcttttataatcagagaattactacatatgtacaataaaaatttccccatcaagatatacaatatattttatttatatttatagctgtaatttacaaccagagcttggtatatggtatgtatgcttttattaaaatcttttaatttaataaattattgttttctcttagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggtaaaatgtaaacaaaagcttagttatgtgactgcttgtgaatttgtgatttgttgactagttctgtgtttactaaggatgtttaactggtcaatcagtaatgcttgagaagcactttaagtttttattgtatgaatgaataacaaaatagaccactagctagactaataaagaagaaaaaagagaagaatcaaatagacacaataaaaatgataaaggggagatcaccactgagcccacagaaatataaactaccatcagagaatagtataaacacctctatgctaataaactagaaaatctagaagaaatggataaattcatggacacatacactctcccaagactaaacaaggaagaagtcaaatccctgaatagaccaataacaagttctgaagttgaggcggtagttaatagcctaacaaccaaaaaaagtccaggaccagatggattcacagccaaattctaccaggggcacaaagaggagctgacactattccttctgaaactattccaaataatagaaaaagagggactcctccttaactcattttatgaggctagcatcatcctgatacccaaaccgggcagagacataacagaaaaagaacatttcaggccaatatccctgatgaacaccaatgcaaaaatccacaacaaaatactgccaaaccaaatccagcagcacatcaaaaagcttatccaccatgatcaagtagccttcatccctgagatgcaaggctgtttcaatatttgcaaatcaataaatgtaatccatcacataaaaagaaccaatgacaaaaaccacatgattgtctcaatagatgcagaaaaggcctttgataaagttcaatacccttcatgctaagaattctcaataaactaagtaatgatggaacatatctcaaaatagtaagagctgtttatgacaaacccacagccaatatcatactgaatgggcagaagctggaaggattccctttgaaaaccagcacaagacaaggatgccctctctcaccactcctattcaacatagtattggaagctctggccagggcagtcaggcaagagaaagaaatgaagtattgaaataggaagagagaaagtcaaactgtctctattcgcagatgacatgattgtatatttagaaaacccctttgtctcagcccaaaatctcaagttgataagcaacttcagtatagtctcaggttataaaatcaatgtgcaaaaatcacaaccatttctatacaccaataatagacagacagccaaataatgagtgaactcccactcacaattgctacaaagagaatataatacctaggacacaaacaaatggaaaaacattccatgctcatggataggaagaatcaatatcatgaaaatggccactgcccaaagtaatttatagattcaattctatccccatcaagctatcattgcctttcttcacagaactagaaaaatctactttacattttatatggaacgaaagaagagcccacatagccaagaaaatctaagcaaaaagaacaaaaagttcataatcactgggacattggagaaatgcaaatcaaagtcccaatgaggtaccatctcatgccagttagaatggtgatcattaaaaagtcaggaaacaacagatgctggagaagatgtggagaaataggaatgcttttacaccgttagtgggagtgtaaattagttcaaccattatggaagacagtgtgctgattcctcaaggatctggaacaagaaataccatttgacccagtaatcctgttactgggtatatacccaaaggattataaatcattctactataaagacacatgtgcacgtatgtttattgcagtactattcacaatagcaaagacttgggaccaacccaaatgctgatgaatgacagtctggataaagaaaatgtggcacatatacaccatggaatacagtgctgccataaaaaaggatgagttcatgtcctctgcagggatatgggtgaagctggaaaccatcatcctcagcaaactaacacaggaacagaaaaccaaacattgtatgttctaactcattaatgggagttgaacaatgagaacacatggacacatggaggggaacatcaacaccggggcctgtcagggggtgggggacttggggagggatagcattagaagaaatacctaatgtggatgacaggttgatgggtgcagcaaaccaccatggcgcgtgtatacctacgtaaaaaacctgcatgttctgcacatgtatcccagaacttaaagtataaatatataaatctacccaaggagaaacagaatgcacattccaggtgaaatggaatcaattactgacaaatatgaaaacataaaatatgccctgtgatgaagatgggtgtcattattgcacacagtttatttgagaatgggaaagaatgacttaacctaggtgggtttcctgcattcctgcaaattgaaataggccataaaatatttgcagtgagagtcagaggaggggtttcagataggttggaatgctctacatggaggtgcagaggtgggtgatgggaaagagtaggtggatggaagagggaaaggaagcctttattgagtgagaacaaaaatgatttgtacagataacagttggaatttagtgtctatcagataaggcgtaaacatcaatgccgttgtcatcgcaccattgttgaaaacgctattttttcccctattgaattgccttggcaaccttgtcaaaatccaattgactataaatgtgtgaaaggtttttttctgtgtgctctcaattgtactccattgatctatatgtctgtcgtaatccctatagtacaccatcttaattactgtagtattgtattaatatcaagttattatatcaaatcaaggagtgtgagtctttgttgttctttttcaatacgttttcactattctgggtcccttgaatcttcatatgaaatttagaatacacttgtcaattttctcaaaggagccaatggggattttgacacgattgcattaaatcagtagatcagggaattatgccatttttaaaattgaagtgaaattcacacaatatacaattaaccattttaaagtgtagacttgagtggtatttagtgtattcacaatgttgtacaaccaccagctttctctggtttcaaaatgtttttattacttcacaaaaacatatcatattcattaaataatcactccattcctccaacccatcatgtaattacctctaatcttctttctgtttctatggatttgcctgttatggatatataaaggactcacagcatatgtaacctgttatgtctgagtcctttcacttataatgttttggaggctcatctaagttgcaacatgtatcagtacttcattcttttttgtcgctgaaatatattttatttttccatgcacatatatcacaatttgttattcatctgtttatggacatttgcattgtttccaacctttggctcttatagataatcttgctttgatcatttgtgtatgtttctttatgggcatattttcatcattcttgggtatattctcaggagttgaattgctgggtcaaatggtaattttatgcttatcttcttgtatataagagccaatcttttctacagtgaatgtggcattttatattccttccagcaatgtagaaggatttctattttccacatagttgctaatacttgtaactttctgtatttattgaagccatcctagtgaatatagagtgttatctcattgtggttttatttatttattcatttatttagagacagagtcttactctgtcacccaggctggagtgcagtggcatgatctcagctccctgcaacttccacctcctgggtttacacaatcctcctgcctcagcccccagagtagctgggattacaggcatgtgtcaccatacctggttaattgttatatttttggtagagacgggttttctccactttggccaggctggtctcgaactcttgacctcaggtgatctgcccatcttggcctccctaagtgctgggattacaggtgtgagccactgcgcccagctctcattgtggttttaacttgtgtttaatggccaatgattttgaacttcttttaatatattattacccatttgtatatcttctttggataaatgccattcaagtacattttctgtttaaattaagttgactttatttttctttttaagctgttagaatgatttatgtattcaaaacattaaactcctacatatacataatatgaagatatttcctcccattctgttggttgtcatttcacattctcaattatattcttgctgcacaaagtttaattttgatgaagtttggtttatctatctttccttttgccactctggtatcaaatttataaatctattgccaaatatgaagtcatgaagatttacccctacattttattctaagagttttatcgttttagctcttatatttaagtttttccatccattttcagttatatttttcatttggagtgaagtaagggagatctcagcttcattcttctgcatttcgctgtcctgttgtctcatcaccatttgttgaagagactctttcctcagattgaatggtctaggcacccttgatgaaagtaaatttgccatagatctttaggtttatttcgtgatttcagttttattccatttgtcttgatgtctatctttatgctagtaccacactgttttgattattacagtttgtagtaagtttgaagttggaaactgagtactcactgatacagaaattaagtagaaattacttaggcaaatagtaagcatttgggagtcctcagtaaggtttttctttatactggaaagcagccccaaatcattttctaacaaagagcagcttgtaaaatcgagctgcagacatacacaaggaagctggaaacttgcacgagtgaaagctggtagtaaagaactacctgtgaccaggcaagttcaaaatggcggctccttccccacccactatgtaaatgtcacacctgattaaaccaatctctgggccatacgtaaatcagacactgcttcctccagcctccctatgcaatctgctgtggtccacctccttcccccttttccgatgtccctctctttcacaagaagctgcttttttctctcctttcttctattaaactttctgctacataacccactcagatgtgtccgtgtcctaaatttttctggggcatgatgacaaacctgagggtgtatatcccagacaacgtagctgcttcatcaccatgtagttgcatattaattgaacaatcaactttcccatttctggaaaaaagaccattggtattgtggtagggattgcctgagtttttagatcactttgaggagtactgccatcttaacgatattaagtcttccaatccctgaacatgagatagttttcaatttatgtaggtattagatattcttttttcttctgttgcaagggtctggtttagtttaaaaggcaagtttatcttaaatttttttatttagttatgaccattgaggattttaaaatgataccatatgaaatgccttcttttaaaaaaaatttcaacttttatttatttatttatttatttatttttattatactttaagttttagggtacatgtgcactatgtgcaggtctgttacatatgtatacatgtgtcatgttggtgtgctgcatccatgaactcgtcatttacattaggtatatctcctaatgctatccctccccactctgccaccccacaacaggccccagtgtgatgttccccttcctgtgaccatgtgttctcattgttcaattcccacctatgagtgagaacatgcggtgtttggttttttgtccttgagatagtttgctgagagtgatggtttccagcttcatccatgtccctacaaaggacatgaactcatcattttttatggctgcatagtattccatggtgtatatgtgccacattttcttaatccagtctatcattgttggacatttggcttggttccaagtcgttgctattggaatagtgccacaataaacatatgtgtgcatgtgtctttacagcagcatggtttataatcctttgggtatatacccagtaatgggatggctgggtcaaatggtatttctagttctagatccctgaggaatcaccacaccgacttccacaatggttgaactagtttacagtcccaccaacagtgtaaaagtgttcctatttctccacatcctctccagcaccttttgtttcctgactttttaatgatcgccattctaactggtgtgagatggtatctcattgtggttttgatttgcatttctctgatggccagtgatgatgagcattttttcatgtgttttttggctgcataaatgtcttcttttgagcagtgtctgttcatatcttttgcccactttttgatggggttgtttgttttttatcttgtaaatttgtttgagttctctgtagatcctggatattagccctttgtcagacaagagggttgcaaaaattttctcccattctgtaggttgcttgttcactctgatggtagtttcttttgctgtgcagaagctctttagtttaactagatcccatttgtcattttggcttttgttgccattgcttttggtgtatgagacaagaagtccttgcccatgcctatgtcctgaatagtattgcctaggttttcttctagggtttttatggttttaagtctaacatgtaagtcttgaatccatcttgaattaatttttgtataaggtgtaaggaagggatccagtttcagctttctacatatggctagccagttttcccagcaccacttattaaatagtgaatcctttccccatttcttgtttttgtcaggtttgtcaaagatcagatagttgtagatatgtggccttatttctgagggctctgttctgttccattggtctacatctctgttttggtaccagtaccatgctgttttggttactgtagccttctagtatagtttgaagtcaggtagctttgttcttttggcttaggattgacttgacaatgcgggctcttttttggttccatatgaactttaaagtagttttttccaaatctgtgaagaaagtcattggtagcttgatggggatggtattgaatctataaattaccttgggcagtatggccattttcacgatattgattcttcctacccatgagcatggaatgttcttccatttgtttgtatcctcttttatttcattgaacagtggtctctagttgtccttgaagaggtcattcacatcccttgtaagttggattcctaggtattttattctctttgaagcaattatgaatgggagttcactcatgatttggctctctgtttgtctgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaatttgacttcctcttttccttattgaataccctttatttctttctcttgcctgactgccctggccagaacttccaacactgtgttgaataggagtggtgagagagggcatccctgacttgtgccagttttcaaagggattacttccagtttttgtccattcagtatgatattggctgtgggtttgtcataaatagatcttattattttgagatacgtcccatcaatacctaatttattgagagtttttagcatgaagagctgttgaattttctcaaaggccttttctgtatctattgagataatcatgtggttcttgtcattgattctgtttatatgctggattacatttattgatttgcctatgttgtaccagccttgcatcccagggatgaagcccacttgatcatggtggataagctttttgatgtgctgctggattcggtttgccagtattttattgaggatttttgcattgatgttcatcagggatattggtctaaaattctctttttttgttgtgtctctgcccggctttggtatcaggatgatgctggcctcataaaatgagttagggaggattccctttttctattgattggaatagtttcagaaggaatggtaccagctcctccttgtacctctggtagaattcggctgtgaatccgtgtggttctggactttttttggttggtaagctattaattattgcctcaatttcagagcctgttattggtctattcagagattcaacttcttccttgtttaatcttgggagagtgtatttgtcgaggaatttatccatttcttccagattttctagtttatttttgtacaggtgtttatagtattctctgatggtagtttgtatttctgtgggatcggtgatgatatccccttcatcattttttattgcgtgtgttggattcttctctcttttattctttattagtcttgctaacagtctaccaattttgttgatcttttaaaaaacctgctcctaaattcattgattttttgaagggttttttgtttccatgtaattgagtttccattgtttccatggaatgcaaaaattccatgttttgagtgagtttcttaatcctgagttctagtttgattgtgctatggtctgagagacagcttgttataatttctgttcttttacatttgctgaggtgtgctttacttccaactatgtggtcaattttggaataggtgtggtgtggcgaaaagaatgtatattctgttgatttggggtggagacttctgcagatgtctattaggtctgcttggtgcagaactgagttcaattcctggatatccttgttaactttctctctcgttgatctgtctaatgttgacagtggggtgttaatgtctcccattattattgtgtgggagtctaagtctctttgtaggtctctaagcacttgctttattaatctgggtgctccgttattgggtgcatatatatttaggatagttagctgttcttgttgaattgatccctttacctttatgtaatggccttctttgtcccttttgttctttgttggtttaaagtctgttttatcatagagtaggattgcaacctctgcctttttttgttttccatttgcttggtagatctttctccatccctttattgtgagcctatgtgagtctctgcatgtgagatgggttttctgtgtacagcacaccgatgggtcttgactctttatccaatttgccactctgtgtcttttaattggagcatttaacccatttacatttaacattaatattgttatgtgtgaatttggtcctgtcattattatgttagctggttattttgctcattagttgatgcagtttcttcctagccttgatgatcttacaatttggcatgcttttgccatgggtggtaccagttgttcctttccatgtttaatgcttccttcaggagctcttttagggcaggtctggtggtgacaaaatctctcagcatttgcttgtgggtaaaggattttgtttctccttcacttatgaagcttagtttggctggatatgaaattctgggttgaaaattcttttctttaagaatgttgaatattggcccccactctcttctggcttgtagagtttctgccgagagatcagctgttaatctgatcggcttccctttgtgggtaacccggcctttctctctggctgcccttaacattttttccttcatttcaactttggtgaatctgacaattatgtgtcttggagctgctcttctcgaggagtatctttgtggtgttctctgtatttcctgaatttgaatgttggcctgccttgctagattggggaagttctcctggatagtatcctgcagagtgttttccaacttggttccattctcctcgtcactttcaggtacaccaatcagatgtagatttggtcttttcacataggcccatatttcttggaggctgtgttcgtttctttttattcttttttctctaaacttctcttctcacttcatttcattcatttcatcttccatcacttataccctttcttccagttgatcaaatcggctatggaggcttatgcattcatcacgtagttcttgtgccatgattttcagctccatcaggtcctttaaggacttctctgcattggttattctagttagccattcatataatcttttttcaaggttttttacttctttgccataggttcaaacttcctcctttagctcagactagtttgattgtctgaagacttctctcaactcatcaaagtcattctccatccaactctgttccattgctggtgaggagctgtgttcctttggaggaggagaggcactctgatttttagaatgttcagtttttctgctgttttttccctgtctttgtggtttcatctgcctttggtctttgatgatggtgacatacagatgggattttggtgtggatgtcctttctgtttgttagctttccttctaacagtcaggaccctcagctgcagtctgttggagtttgccagaggtccactgcagaccttgtttgcctgggtatcagcagcggaggctgcagaacagcggatattggtgaacagcaaatgttgctgcctgatcgttcctctggaagttttgtctcagaagagtacccagccttgtgaggtgtcagtctgcccctaatggggggtgcctcccagttaggctacaagggggtcagggacccacttgaggaggcagtctgtccattctcaggtctcaagctttgtgctgggagaaccactattctctccaaagctgtcagactgggacaattaagtctgcagaattttctgctgccttttgtttggctataccctgaccccagaggtggagtctacagaggcaggcaggcctccttgagctgcggtgggctccacccggttcgagcttcccagccgctttgtttacctactcaagctttggcaatggggggcacccctcacccagcctcgctgctgccttgctgtttgatctcagactgctgtgttaggaatgagtgagcctcagtgggcataagaccctctgagccaggcacgggatataatctcctggtttgccatttgctaagaccatcagaaaagcacagtattagggtggaagtgaccttattttccagatgccttctgtccttggctaagaaagggaattctctgaccccttgcacttcccaggtgaggtgattcctcaccctgcttcagctcaggctccatgcactgcacccactgtcctgtacccactgtctcacaatccccagtgagatgaacccagtacctcagttggaaatgcaaaaatcattcatcttctgcatcgctcatgctgggagctgtagactggagctgttcctattcagccatcttggctccaaatgttctcaacttttattttgaagtgcacgttcatgtgtcttacataggtatattgtgtgatgctgaagtttagggtacaaataatgccatcacacaggtagtgagactagtacccaataggtagtttttcagcccttgcctttatatctctctaccctctatagtaattccttgtgtattttttccatctttgtgtcccacttttatatgagaacatgtggtatttggatttctgttgctgcattaattccctcaagataatggcttccagctacatctatgttgctgcaaagacatgattttttttaatggctgcatagcatttcatggtgtatatacaccacattttgtttatgtgacacatgattggttggttctatgtctttactattgtgaatagtgcaggaatggacatactagcacgtgtcgttttggtagaacaatttgttttcctctgggtacatactcagtagtggaattgctgcatcgaatggtagttctgcttttagttctttgagaaatctcaaaactggtttccatagtggctgaactaacttacattcccaccagtagtatataagtgttctcttttctctgcagtctcaccaacatctgttattttttggctttttaatcatatccattttgattggcatgagatgatatctcattgtggttttgatttgcatttctctgatgattagtgatgttgagtgttttctcatatgcttgttggccatgtgtgtgtcttctttggaaggacatatgtcctttgcccactttttaatggggttacttgttttttaacttgttgaattgtctaacttccttatagattctcgctattgaaacattgttggattcacagtttgcaaatattttgtcccattctgtaggttgtctgtttattctgttgatagtttctcttgctgtgcagaagctctttaattaggtcccacttgtcaatattcattttggttacaattgcttttgaggagttattcataagttctttgctaaagcctgtatccagaatgttattttatagatatttttccatcagattcttatagtttgaggtcttaaatttagatcattaatccatttcgagttaattattgtatatggttcaaggaagtgtttcagtttcattctgcatatggctagtcagttatcctcattcaatttactaaatagagaattctttcctcattgattattttttgtcaactttgttgaagatcagatggctataggtgtgtggctttatttctggcttctctacttctgttcaatttgtgttttgtaccagttacatgctctcttggttactgtagcttacagtatagtttgaagtcaatgtgaagcttcccactgttctttttgtttaggattgctttggatttgggctcttctttggttccatatgaattttagaataaaataatattggtagtttgataggaatagcattgaatctgtagatagctttgggcagtctagccattttaatgatattgattgtttcaatccataagcctgaactgtttttccatttgtttgtgtcatctatgattttgttcatcagtattttgtagctctccttgtagagacctttttgccccctttgttagttgtattcctaggttttttcttgtggctattgtaaatgggattgagttcttgattggctttcaggatgaacatttttggtgtttaaaaatgctacagatttttgcatatttattttgtgtactgaaatctcactgaagttgtatgtcagttccaggagtttttggaaagttctttagggttttctaggtctgaattgggtcttctaggtctgagatgggtcttctacttctactagtaggagatgggccttgcaatcttgaagacagtagaaggatgggtcttatttttaatccaacttcctactctttgccttttatgtggagcatttagactttatcttcaatgttaacactgatatatgaggttttgattctattgtgaagttgttagctggttgttttgtagtttctattgtgtgattgctttatagagtctgtgggctatatacttaagtgtgttttgtggtagcaggtattgttctttcacttccatatttagaactcccttaatgatctcttataaggctggtctaatggtaacagattttcctggtagttacttgtttggacaagattgtatttcttccttgattttgaagcatagtttggcaaaatataaaattcttttttgtaatttttattaaaatgaatgttgaaaataggctgagcatccttttagcttgacaaggttctctttgtatgtgatctgatttttttctctagctgcctttaaaattattttttagccttgactttggacagcctggtgagtaaatgccttggtgatgttaattttgtatagtgtctcacatatattccctgggtttattgtatttggatgtctacctttctagcaagtttgggaaaattttctcaacttattagcccaaatgtattttctagattgtttactttttcttctctctcaggaatgccaataattcctaggtttactccttttaaataatcagatatttcttgaagactgttcatttattaaaattattttttctttatttttgtctgacttggttagttcaaaagactggtgttcaagctctgaaattggtccagtctattgataaacgcttcaattgaattctgaaattccttaagtgactctttcaattccagaagctttgattgatttctttttaagatgtttacttctcgctccatttcctggactgctttagtagtttgtttgcattaattttcaaccctgccttggatcactgagcttacttgcagtccatattttgaatagtttatctgtcatttctgagttgccagtttggttagggttcattgctggggagttcatgtgatcctttggaggttttacgacattcagacatttcatggtgccagaagtcttatgctggtttcttcttatttggagaggctgccgcttctgatttttgaaattatttttgtgcagatagaattgtttttctctccctatttttgttctttcctttttctcttccccttcctatgggatgtgactataaagtatgttgggtagggcctttgacttggattctatagctgtgttcacttctgtgggtagttttatattggcctgtgcagtttgacatacatgtcagtagatggcacttatgagcaaaagccagctgtgactaggacaacttgatatagcacagcttgatccttgttttctgggggaacttctctgtttcctcagataatctgttcatctgtggaattcagagtagtctgggctccctgctgagccccagggggataaagatcggtgtcactggactgggcagtcctgtctacaggtcccctaatggcaggcactagcaccagcactgagagacaactgatttttgcattgatcttgtaccctgaaattatgctgaaatcatttattagctctacttattttctatctgtattgcatgagatttttctatatagagagaatcatgtttcagtcaaatacacatgatttgaatttttcctttcctatttgaatgtgttttatttcatttcttgcctaattgctctggctagaacttccaatactatgtttaatagtagtaaaaatggacatccttgttttttttcttttctttctgattttaagttacaagttttagtctttcacaatttagtatgctttagctttgcagttttcataaatatgctttattatgataaaggagttttatttcatttatagttttctgagtgtttttgttatgatgggtattaaaagttgtcaatttttttttctgcatctaatgagatgaacatgattttctcttttattctgatatggtgtagtgcactgattgactttcttgttgaaccacttttgaatttctgggataaatctcacttgcttattgtgagatttatttttataatgtttattattataattttttaattttgtaaaaaattgttgcaaaatacacataacataaaagtttctgtattaatcattttaagtgcatagtattttggtattaattacattcacattgttgtgcaaatgtcactgccatacatctgtagaattcttttcatcttgcaaaacagaaactttatacccatttaataataactcttggccgggcattgtagatcatgtctgtaatcccagcactttgggaggttgaggtgggcagattggatgagctcaggagttcgagactagcctgggtaacatggcaaaaccctgtctctaccaacaaagcaatcaacaaacaaaatgaaagtaacataatttcctcaactgtgcaaactaattcatattaataattccatgaaatgtgtccatagtaacacaagagcagaagatgggccttgtaaaggtggcccaccacattatttgaggtctttgtcagtcttatctgccagatactgtgtggactaactgcagttaaaattcccattcccttatcacttgccctgaaatttatctgaaatcaaagggaatgggttgcccaaagagaagtgtccagagacgtggatgatgcgacaagaaatgttgtagaaccacacccccacctcaaatgataactctacatttctcccttccaccaccccatggcaaccaacattctactttgtgtctctataaaatcgagtatgctgggtacctcataaaagtggaatcattacatatttgccttttgtgactggtttatttcacttagcctaatgttatgttctcagggttcattcatgtttttgcatgtgtcagatttttcttcctttctaagggtgaataatattccgttgtatgtataaaccaagtttgcttacccatttatctgttgatgggcacttggattacttttcaccttttgactttttgagtaatgctattatgaatatgggtaaaaaaatatctctttgatgtgctgctttcaattcttttgggtataaataacccaaaagaataacccaccacgcctggttaattttttgtatctttagtagaaactgagtttcaccatgttggccaggctggtctcaaactcctgaccctgtgatccacccacctcagcctcccaaagtgctggaattataggtgtgagccacgtcgcccggcctacatttattgatttgcatatgttgaaccaggcttgcatcccagggatgaagccaacttgatcgtggtggataagctttttgatgtgctgctggattcagtttaccagtattttgttgaggattttcgcatggatgttcatcagggatattggcctgaaattttcttttttttgttttatgtctgccaagttttggtatcaggatgattcttcccttataaaatgagttaggaaagagtgcgtctttttctactgtttggagtagtttcagaaggaatggtaccagctcctctttgtacctctggtagaattcggctgtgaatccttcaggtcctgggctttttttttgcttggtgggctattccttgctgcctcaatttcagaacttgttattggtctcttcacggattcgacttcttcctggtttggtcttgggagggtgtatgtgtctaggaatttatccatttcttctagattttctagtttatttgcatagaggtgtttatagtattctctgatggtagtttgtattcctgtaggatcagtggtgatatcccctttatcatttttttgttctctctatttgattcttctttcttttcttctttattagtctggctagcagcctattttgttaatcttttcagaaaattagctcctgtattctttgatattttgaagggattttcctgtctctatctccttcaattctgctctgatcttagttattttttgtcttctgctaggttttgaatttgtttgctcttggttttctagttcttttaaatgtgttgttagggtgttgattttagatctttcctgctttctcctctggacatttagtgctataattttccctctaaacactgctttagctgtgtcttggagattctggtacactgtgtccttgttctcattggtttcaaagaacatctttattttgccttcattttgttatttacccagtagtcattcagagcaggttgttcagtttccatgtagttgtgcagttttgagtgagtttcttaatcccgagttttaatttgatggcactgtggtctaataggttgtttgctttaatttctgttcttttgtatttgctgatgggtgttttacttccaattatgtggtcaattttagaataagtgtgaagtggtgctgagaagaatgtatattctgttgatttagggtggagagttctttagatatctattatgcccgcttggtccagagcttagttcaagtcctggagatccttgttaaatttctgtctcattgatctgtctaatattgacagtggggtgttaaagcctccatctattattgtgtgggagcctaagcctctttgtaggtctttaagaacttgctttatgaatctgggtgctcctgtattgggtgtgtatctatttaggatagttagctgttctcgttgcattgatccctttaacattatatgataccacccctttttttaatctttgttggtttaaagtgcgttttatcagagactaggattgcaacccctgctttgttttgctttccatttgcttggtaaatattcctccatccctttattttgagcctatgtgtgtcttttcacgtgagatgggtctcctgaatacagcacattgatgggtcttgactctatccaatttgccagtctgtgtcttttaattggggcatttagcctgtttacatttaaggttaatattgtgtgtggatttaatcctgccattatgatgctagctgattattttgccttttagttgatgcagttttttttatagtgttgacggtctttacaaaatttggtatgtttttgcagtggctgttcccagttgatcctttccatatttagtgtttccttcaggagctcttgtaaggcaggcttggtgatgacaaaatccccttgtggtgatgggcttccctttgtggtaacccgacctttctttctggcttcccttaacatttttcctttcttttaaccttggtgaatctgacaattatgtgtcttggggttgcccttcttgaggagtatcattgtgggtgttttctgtatttcctgaatttgaatgttggtctgtcttgctagattgtggaagttctcctggataatatcctgaagaatgttttacaacttggttccattctccccatcactttcaggtacaccaatcaaacgtagatttggtcttttcacatagcgccacatttcttggaggctatgttcatttctttttattcttattttttaacttttttcttcacattttatttcattaagttgaccttgaatctctgatatcctttcttctgctttatcaatttggctattgatatttatttatgcttcacaaagttctcattctgtgttcttcagctccatcaggtcactcatgttcttctctagttagcaattcgtctaacattttttcaaggttcttagcttctttgcaatgggttagaacatgctcctttagctcagtggagtttgttattacacaccttctgaagcctacttctgtcaattcatcaaattctttctctgtccagttttgtccccttgctggcaaggagttgtgatcctttggaggagaagagatgttctggtttttgaaattttcagcctttttgtgctgttttttttttctcatatttgtggatttatctacctcttgtctttgatgttggtgacctttgaatgggttttttgcgtggacatcctttttgttgatgttgatgctattcctttctgtttgctagtttttttcctaacagtcaggcccttctgctgcaggtctgctggagtttgcttgaggtccactccaaaccttgtttgactgggtatcaccagaggaggccacagaacagcaaagattgctgtgtgtttattcctctggaagcttcgtcctagagggacacttgccagatgccagccaaagctcttttgtatgaggtgtctgttgacccctgctgggaggtctgctgttctctttagagccagcaggcaggaacatttaagtctgccgaagctgcacccactgccaccccttcttccaggttctcagtacagtgagatgggagttttatctataagcccctgactgggactgttgcctgtctttcacagatgcaactgctcagagagtaggaatctagaggggcagtatggctacagtggctttgcggagctgaagtggactccacctagtcctagcttcctggaggctttgtttacactgtgaggggaaaaccacctactcaagcctcaacaatggcagactcccctcaacaccccccccaagctcgaacatccccagtcaacttcagactgctgtgctggcaaacagaagttcaagccagtggatcttagcttgctgggctccatgggggtgagatcccctgagctagatctcttggctccctggcttcagtcctctttccaggggactgaatggttctgacttgctggtgttacagcaccactggggcataaaaaaacccctccagctatcttggtgtctgcccagatgaccacccagttttgtgcttgaaacccagggccctggtggtgtaggctctgaagggaatcttctggtctgtgggttgtgaagaccatggaaaaactgcagtatttgggccagagtgcaccgttcttcacagcacattccctcaaggctttccttggctatgggagggagttcaccaatcccttgggcttccaaggtgagacaacattcctccctgcttcagtttagcctccatgcactgcacctactgtctaaacattcccagtgagatgagccaggtacctcagttggaaatgtagaaatcacctaccttcttcattgatctcgctgggagctgctgactggagcttttcttattcagtcatcttgccagccaccctcctgattgagtttctttaaggtaattattttgaattccttttttgaatatttgtggattttttttcattgaggtctgttatttgagagttattatgtccctttggtggtgccatatttctttatttttcatgttgtgtctctgaatttatgtctatgcatgtgatggaacaattgctattccaaaatctctagagtgaatttcatagagaaagacttttatctgaagttgagtgtttgtgtgcaggtgacgaagagtgggtaactcagtttttgatagatgcattgtgatagtatctgtgtagtttctctagctatggccaatatcagcaataattttgggtgcctcagtggcctaggctgtagaagtttgcagcagtatcaggagcagtgtaggttgttaatgtccttagtgtcaaagtatttgggcgtcctcctatttttattttcctaaaattggggtgacttagcctaagggattccttttggtgtcatctctgacatggcattaactcagcggcattggtgctgggttacaagtacagatccttgaagttgtcatagaagcatcattctagactcagggtcttttaatcatgtattgtgacacctgggtcttgcggtgcaggttcactctctgtggcagtgttgaatgcagattacccacagaaccaaggtctatgactctagcacaccttagcagctgaagcccacagactgagttgtggctgtgaatctgtttctgagggtgaggtgcaggaaaatgccgtggcctgcctctgatgtagaaggggtgctctttagatttgagcccagcaagtagaatatggctactatcattaataagataggatatactaccttattaatgctaagtaaccaagctcaagtcaagagatggaaatgttaatactggtttgtgactgcactgttcttcttacttaagagtaattttcaacatggcaagcttagaaaactgtgtgaagctgatgttaccaagggagaggactgtctttgtctacacatgttgagagaatctagtctatttcagtggtgttgattacacaatattcaacatgacacacatcacttggagactctaaaagcatcattaatttattgctgctggccttggggctggttaaaaagtaatacgttttttatattgatgatctctttcaactaagtattccttatccattgctttctttctcccaacttccaaattatgagaactccagtctctaagccttggcatatgcagtatccttactctctcctttatcccctgtggcaattaatccctttattctccatcttcatcattgttctttctcttcactttgtatatttttgtttattcctgcactactgcaccctagaacaagttgtctgttgcctcccatctagattataatagtgtgggcccatcttgtcattgtaaacccattctcttcctctataatttatcttaggttttgctgtcatattgcttttttaatatttgtttttacaaaatttcaactttataatgaatctgggggcaatattgagtccatgtacctttctgacagaaaaatataattgcagactcttgattcaggctcacagtgtctaatgatatggccccaatttacgttttctattaatttagattgtggttgtctacaggtaataatggctttaacacataatgtctttatttatctcaaatacagggattctcttggtggggcaatctaggataatacagcagccccaaagcagcagagagtcaagtgccttcctttttcccactaaatttagtatacagaccttcattttgatgattaaatcccaggatggggtctactctacctcctacttcacatttgtgttttgagtatgaaagaggaaatagaggaaatggacctagagaccttctgcttatatattttagcaaaaaaaaatatgctgtgtgactcagctagctgcaaagagcctgatgaatggaatttttaggcaagcatggaataagggagtaggaaataaagtttgggcaagttggtctacagcctctgctatacaagcagtattttttttctagtactgtactttccagtttctatgttggtaactatataactatgtgaataattttgaattcactgtaatcaaatatgctggtaaataatttgtcagataattgcatcaaatcattcctaggaaaagcacaaccaaccatctgaatttactattgaaagcttggaaaacactgcagttgacttgtttggagctgggacagagacgacaagcacaaccctgagatatgctctccttctcctgctgaagcacccagaggtcacaggtatgatcagagatgataagttaattaattttcagaaaagattttgggaaggtgttgctagtgtcctccttcctgtttctcttagagaagcttcattatttaaacttttgtgcttccagctgtaatctgtttcaaactaatggtgattacaatgggatatcttggcctggcatggtggctcacacctgtaatcccagcactttgggaggctgaggtgggtggatcacttgaggctaggagttcaagaccagcctggccaacatggccaaatcccatctgtagtaaaaatacaaaacttagccaggcatggtggcacatggctgtaatcccagctactcgaggggctgaggcactggaatcaattgaacccaggtggtggaggttgtagtgagccaagattttgccactatactccagtctgggcaacagagtgagactctgtctcagaaagaaaaaaaaagaaaaaaagaaaaagaaaagataaaaggggcatctttgcacagtagaggaagataactgagagaaatgaagacagcatggcagtagcaaaagcagtagaactctggtccaatgtgtctggatttatggcaggaagagacaagataaattggcctgggattgcatgttggttttattatgagaaggccattttaaatagcaagtatattcttcaagataacttttctcattctcaaaatttcaggttcgaatgctggagtagggaaacttgaaactctccttattgaaggataaatggtaatcctaaaaatgtagtgatctgcctgagaaaattcctagtccaataagtactctaaaaagttagattcataagaaaggtgattctgtttactagaagaggtatataaagaatgttccatttaggcagaatatgtacctgagacagtttccatgaaactgttgttgggcaaaataagatttttttgaggaagtcaataattttatcttttatgaacaactttactttagaaatttacttttaaggacttttggttatgctgcagataagaaatattctttttttctcctatgtcagtatcccccattgaaatgacaataacctaattataaataagaattaggcttttttttgaacagttactagcctatagagttctagaagattttttgtcaaattttattatagattaaagggtacaaatacaggtttgttacataggtaagttgtgtaacactgaggcttggggtcccagctattccatcacactgacagtaaacatattacccaacagatggttcttcagcccacatctcttctctccctcccccatctagtgatcctcagtgtctattgttcccatctttatgttcttgtgtattcaatgcttacctcccacttataagcaagaacatgtggtatttggttttctgttcttgtattagattgcttaggataatggcctcctgcttcatctataatgctgcaaaagacataacttttgttctttcttatggctgcataacattccattatgtatgtactagtctgttctcacgctgctaataaagacatacctgagacagggtaactcataaaggaaagaggtttaatggactgtcaattccacacggctggaaaggcctcacaataagtctctgatagagacttattcactatcacaagaatggcatgggaaagtcaggcctccatgattaaattacctcacattgagtacctcccgtgacgtgtgggaattatgggagctacaattcaagatgagattttggtggggacacagcctaaccatatcagtgtatatttggtacattttccttatacaatccactgtcgatgggcacataagttgattccatttctttgctatcgtgaatagcactacatattggggtgaacatattggggtgtgtgtcttattgatagaatgaatattttgggggcatatactccatagtgggattgctgggtcaactggtagttctattttaagttctttcagaaatatccaaactggtttccacagtggctgaactagtttgcatacccaccaacagtgtaaaagcatttccatttctctgcaacctcaccagcatctgttgtttttggactttttaatattaataattgctattctgactggtgtgagatggtacctcattgtgattttgatttgcatttctctgatgattagtgatgttgagcattttttcataagtttgttggctgcttgtatgtcatctattgagaagtggctgttcatgtcttttgcccaattttaattgattttttttgttttttttttttttttgcttgttgatttgtttaagttttttatagattttgtctgttgatacatatttagattttggatattagacatttaggtcctttaaggtaggaagagtacaggaaatagtcaagaagactttaacaaatttctaaaaacagagagcatatagaggaatgatatatctgtacagagagggtaaacttataaccaaaaggtcagaagagaaaaatttatcaaggatgaaaagttaatcagtgtcccttaaatcctcccaatattggtatttggaagtaccgagggtcaaagatggtggagaatgaggctgaaaaaggaggctctccctgcctacgtttcctccacaactcttttcatcaggtaactgatttccttccacaagaagaaggaggctcactctctagagaaactgagcttaagaagccctgtactcagagacacacagcagtgccagaaaaggcatgaggtgtaggctagaaagacagattaggtacacatccactccttgaattcagagactcttagctcttttattcatcttccttcctaaaattcagcagctagctctatcctacagaaagggaactgatctagagaaatggcatttttcttttgccatcttaacagacaattctcttcaatgtccaacagagtgaatgaaatgaaaacatatactgctagatacagggttatggaatttcaggacatgagaattaaagggaaaatcacaaaaactttcagagctgtaccaggttatattgaaagaattagaattcagaattctcaagaagaactattaatattatcttgtatattaataaaaatagtgttttcagatgtgcatgtttgccaaaaatttttaccattttccctttctcagaaaaatactgaagaatgttcttcattcaaatgcctgaaaccttgttagagaaagtcctgagctccagcaatcaggaaacctcgtgtaggagaatgagagtgtcagggaggctgcctagcaccagacctagaaaacaactacttcagaacagacctgggggataattcagaagtgagatgagacagcaagaacaaaagagatgtgacagattttatgagagtttccaataactaaaaaggagtttcaaacatctgctggaacatttgtaaataattctaacttgggaaatggaaaattacaaattgaaataaagagacattgttaagcccaggaaagtacaaaaataaaatttaatcatagttgtcttaccagagaaccatatttgtgtagtcagaatgatgtaagcaatgaatactgatatcataaaaattgtcatctaaatatattctggaaaaagcagtgtggaaaagtgagtgtgtctatctgagggtgtgttcaaatatgaggggaagatggagattaaaattctcatctctcttaataaaaaattattaaatataatctacaaaaagataagtaagaattagaaacagagtatttaaaaatgtgaatgtatgttcagaagaagctgctagaatgttcaaaatggtagatttggaaagtgtgagaatgaagagaataccattgtgatttgtgacccctcccacacacagatgcaccaatacagtcatatatatgcataaatctgatagtataatttaacgtttaagcaacatatgttattttgatatgaaattaatctgtttttcaaagacagtaatttcatgactaaattatatgcttactttatgttttcaaacattttattatttttatttgtattaattatcatatatactaatgtatatgtatatacatatcttttaattttttttaatttttatgggtacaaagtaggtatatatcaatatgtttgggggtacatgagatgttttgatacaggcatgcaatgtgaaataagcatgtcatggagaatggggtatctattccctcaagcatttattctttgagttacaaacaattcaattacactctttaagttattttaaaacgtacaattaagttattattgactatagtcacccttttgtgctatcatatagtagatcttattcatctccacctcccctccccccacactaccctttcgagtctctggtaaccatctttctacactttatgtccattagttcaattcttttatttttagatcccacaaataagtgagaacatgctatgttcgtctttctgtgcctggcttatttcacttaacgtaatgatctccagttcccttcatgttgttgcaaatgactgaatctcattctttttatggctgaatagaactacattgcgtatatgtactacattttctttatacatttgtctgttgatgcatatttaggttgtttcaaagtcttagctattgtaaacagtgctgcaacaaacaagagtgcagatacctcttcgatatacctatttcctttcttttgggtatataccaagcagtagggttgttggatcatatggtcgctttatttttaggattttgaggaacatttaaacagctctccatagaggtcacactaatttgcattcccaccaacactgtacgagggtccacttatctccacatcctcactagcatttgttattgcctgtcttttggatataagccattttaactggagtgagatgacatctcattgtagttttgatttatatttctctgaggatcagtggtgttgaccacctttttgtatgcctgtaacccatttatatatcttcttttgagaaacatctattcaaatcttttgcccacttttggattggattattagattttttttctatagagttgcttgaatttcttatatattctgattactaatctcttgtcagatgaatagtttgcaaatatttctctccattctgtggattgtcttttccctttgttgattgtatctttggctgtgcagaagctttttaacttgatgtgatcccatttgttcatgtttgctttgaatgcctgtgcttgtagggtattgctcgaaaaatttttgcctagaccaatgtcctggagattttccctagtgttttcctatagtagtttcacagtttgaggtcttagatttaagtctttaatccattttgagttgatttttgtatatggcaagggatatgagtccagtttcattcttctctgtaggatattaaattttcccagcacatttattgaagagactgtctttcccccagtgtacgttcttggcacctgtgttagtctgttctcatgcctctaataaagccatacacaagactgggtaatttataaaggaaagaagtttaatggactcacagttccacatggctggagaggcctcacaatcatggcagaagatgaatgaggagaaaagtcatgtcttacgtggtagcaggcagatagctttgcaggggaactcacatttataaaaccatcagatgttgtgagatttagtcactatcatgagaaaaatatggaggaaaccacccccatgattcaatgatccctacctggcctcccccttgacttgtggggattatttcaattcaagatgagatttggggtggggacacagccaaaccatatcagcccctttgtcaaaaatgagttaactctagatacgtgaacttgtttctgaattctctattctgttccattggtccatgtgtttgtttttatgtcagtaccatgctgttttagttagtatagctctgtagtttaatttgaagtgagataatgtgattcctccagttttgttccttttgcttaggatagttttgactattctgggtcttttgtgggtccatatacattttaggatttattttttctatttctgtgaagaatgccattgatattttgataggaattttattgaacctgtagattgttttgatagtatgggcactttaacaatattgatttttccaatccatgaacatgaaatatttttctgtttgttgggtcctcttaaatttctttcctcagtgttttatagttttcattatagagatctttcaattctttggttaaattaatcctaggtatttaaaattatgtatggctattttcaatgggattattttttaaatttctttttcttttttttcactgttggcatataacaacactactgatttttatgttgattgtgtatccttcaactttactgaatttgttcatcagttctaataattatcttgtagaatctttagtttttcctactataaggttatatcatctgcacacaaggatattttgacttcttcctttccaattttgatagcctttatatctttctcttgtctgattgctcttgctaggtcatccagtactatgatgaataacaatggtgacaatgggcatccttgttgtgttcctgatcttacaggaaagacttcctattttctccattcaggatagtactagttgtgggtctgtcatatagcttttttatgttgaggtatgttccttctatctcaagttttttttatgaattttcatcaagaagggatgttaaattttatcaaatactttttcagcatcaactgaaatgatcatatggcttttatccttcattctgttgatatgatgtatcacactgcttgatttgcacatgttgaaccattcttgcatccaagggataaatcccacttggtcattgtgaatgacctttttattgtattgttgaatttggtttgctagtgttttgttgaagatttttgcattagtgttcatcaggtgtattggcctgtagtttttttttttttttttttttttgatgtgtcttagtctgattttggtatcagggtaatactggcctcatagaatgagtttggaagtattctcttctcctttattttttggaatagtttgagtagggtcggtattagttcttctttaaatgtttggtaaaattcagcagtgaagctagccagtcttgggattttctctactgggatgattttatttctcgtttgatctttgtgctggttattgcatgttcagattttggatttcttcctggttcaatcttgatgggtcatatttgtgtagggatttgtccatttcttctagattttccaatttattggcatatagttgctcatagtaaccaataattattctttgaatttctgcagtatcagttctaatgcctcctttttaattttttatttatctgaatctactctttttttttttcttagtctggctaacggtttgtcaattttgtttaacttctcaaaaaagcaactttttgtttcattgatcttttgttttgttttcttcacttaaattttatttatttctgctctgatctttattattccttttcttctactaattttggttttaatttgcttttgcttttctaattctttaggatgcatcattaaattgtttgtttgtcaattttctccatttttgatataagctcttgtagctataaacttccctcttagtactggtcttgctgtaacccctaggttttggtatgttgtgtttccattatcatttgtttcaagaaatttttcaattttctttttaatctcttcatgggtccactgttcatttatgagcatatttttaaatttccatttatttgtgtagtttccaaaattcctcttgttattggttgctggttttattacattgtggtcagagaagatgcttgatattatttcagtttctttgaatattttaagacttgttttgtgacctaacatacggtcaattcttgataacaatccatgtgctgtggaaaagaatgtgtattctgtagcagttggataaaatatcctgcaaatatctatgagatccatttgatctatagtgcagatgaatttcaatgtttccttgttgattttctatctggatgacctgtccaatgctgaaagtggggtgttgaagtctccaggtattattatattggggcctatctctctctagttctaattatatgtcttttatatatctgggtgctgcattattggttgcatatatatttaaacttgttccatcttcttgccaagctgaccactttatcaccaatagtgatcttctttgtgtctccttatggtttttgttttgaaatctactttgtctgttttaaatatagtaactcatgctctttttttcatttccattggcaggtactgtctcattcaattcctttattttcagcctatgtgtgtctttataagtgaagtgtgtttcttttaggcaacagattaataggtcttgtttttccatccaggtcagtaacaggtcagtatgtcttttgattggagattttattccatttacattcagtgttattattgataagtaaggacttacccatgcccctttgttatttgttttctggttgttttgtggacttctcttccttctttcatttcttcctgtcttcctttattgaagagaattttctccacttatatgtgtacagatttttcttaatatctggtttatggcagttacacatttgtgcatctgtaaccatcctctctttaagtttgcatatacttccagcactataatttaaatttataatgatgtttggataccttcatgattcatatacccctgaattgctacaacaaatgtgccatttttctccttttccatcagtttttacttgtgtcttatcagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaaggtaagtttgtttctcctacactgcaactccatgttttcgaagtccccaaattcatagtatcatttttaaacctctaccatcaccgggtgagagaagtgcataactcatatgtatggcagtttaactggactttctcttgtttccagtttggggctataaaggtttgtaacaggtcctagtgtctggcagtgtgtgttctccagatttattatctttcttcaagattggtttggctactcttaggtgcttatatttccaaataatttttaaaggtattagtttgtcaatttcccaaaaccttgggctggaatttctggcagggtgacactaaatttataggctagtttggaaagaactgaatcttgacacgttgaggctttccattcctgaatataattatgcttccaatttgtttggggtttcttttatttaaccaggaatgttgtgaatttgttgtcatggctttcgagtctttggttttccctagataattaatatttttgttgtagaacataaatagtttttatcattctgatgatgttaatctgtcaactttgctaaatttactagtcactattcgtaatttatttctggattcattgtaatttctgtgtatattatactgtatctgagttaatattgttttatttcttattttccatttctcatgggcttaatgtctctttatcgcattcattattgcattagctagaatttctaggagagcattgaatagaattggtgacagtggggatccttgtttctcatttctaatctgcaggaagcagtggaagttttccatttcaatattgagaatgatgcttgaagtagattttggtagatattttttatcagattagagaagtttgctgtcatatatatatatgtcataattgtgtgtaaaatcttgtcaaatcaacactctgcatctatttatataattgtgtgttagtccatttccattgctataaaggaatatctttgactgggtaatttataaataaaagagtttcattttggctcatggctctgcaggctgtgcaagaggcataatgtgggcaggcatctactcctagtaaggacttcaggtagctttcaatcttcggagaaggtgaaggggaagcaagcatgtcacatggcaagagagggagtaagagaaaaaggagtagaagtgactttaaacaaccagctagtgtgtgaactaacagaatatgaactcacttattatcatgggaagaggtttaagccactcatgaagaattcacccccatgtcctaaatacttctcacaccagaacccacctccaacattgagaatcacatttcaacatgagatttggaggggacaaatatccacacaacatcagattatatatattgggcttacatttctcactaaatagaaataagtatgcacatagagatgaactggccttcttcatattgtttaggacttcagtgtttacattcacaagagatttggtttatagttttatttctcagaattttcaagatttttgatattaagattatgccagccttataaaactatgcaagaaatgtttcctaatgtgagactgtttttattgccgttccctctccccacttttcttcttgtgatcacttagttgtatctttgaaatgcctgataacttttggttaaataccagatggtatatgtaagaaattgcagaattgcagaggaggtttatattcttcaaagaaagattcattcctctcccatcggcagtcataatgacatgatacctgttgtcatgattcagaattggacataatgtgaatccagttgaaaattgagtgtcagtgttagcttagctctctgaggttctcctacctttggaagcttgagaccaatttttgtcttgacagctttgcagtgccttctatcacatggtttctgtatttatccagacactccatttgccatctcaaacctactcttttccaatcaaaaccaatatatattattagtaaaataaaaaataatataactgaaagttgtattttcaaggggaaaaagcaatgagacttggtaaggttgcaattactaatgtcatcttttgaagaagacagaattgataatttacttagagattatggggcttaccctagtggtcactgagttagtacaagagaaaagacttcaatgcactctgttttcacaaacacaggagataaccaggagactttcgcttctcaaaattagggtctgagggtaatggtaatgaaacttacttcttctcctataactaattaaatgagaaatatactgaagaatcaggcacgagttgccagtctccccagttcactgcatcagctttggtgacctcctggaggggaacgctgcatctgatgagctcatgctgtgcctgatgtcttttgagccctgagaagccagagcccaaggggattacccattgaatcccttcttcgtggaatagcccagtgcagaaaaaagcagcactgtgtggccaattctaccctctttacaaatcagatacatgtgttcttctgctacaggctggatccacttatctagctggagatgatagtctgagacaggagttggcaaactgtctctgtaatgggccagatagtaaatattttagacttttcaggcaatgtggtttctgttgcaattcttgacatctgctattgtagcatgatagcagtcacaaacaatctgcaaatgaatgaggattgatatgttccaatttttatagaaacaaatgtaaatttcctataaaatgtttgtttcaaaaatattgtttcttgtttgcatttgttcaatgtaagtacttttagctcacatactatacaaaaacaggtggcagggtggacttgtgcagggagtattttttattgatgcctaatataagacatccctgtccagtagaattttctgcaaagatgtgcgattgatttgtgcttttatgtcatatttaaagaatatttgtcagcacaagattccaaagactggctttcaactttcccagaatttttttgttttagctcttatatctagatcaatgacatatttcaaattaatttttatttcataatatgaagtaatagtggtcatgcttcaatgtctataaatttctacttattcaagtaacatttgttgaaataaatctgctttggtatcaataacattttaatatagtacttgtttataaatattcaagggaatatttttaaaaaacaaaattatagactatttatatgaaaatttagggggtagaatttttcctaacatttttattataaaattttttaaaataaataacattacacacacatatgtatatgtacatatggcagtgtgtatacatatctactctgatatctgtccatccatctatttacacctcaatacttcagtatgtatagcacaataacaatggttttctcctacataataatagcattcatactgtggagttattaatacaataatattatttactatacagcttttatttaaaatttcccaactttaaaataatattttaatcacttttttcttgcaattcactctccagtcaagaaataagcacatagtttcagtatcctgttactttccatctcctgtaatcaagaagagtccatttcctctgtttcctttcagtatgttgatctctgtgaagagttgagcaattagtcatttaaattttcctggggctcgttttgggtaattgttttctaaatattatattccagttatgactttggcaagaaaactacatagtattttgaatattctgctgaatcacagtggtgaggcaggggcacataatgtcacatatgccattattggttatgctaagatcctcacctaataagttggaatctgccagatctttccattgaaggggttctgctttttatgcgtgaatgatgaaaatctatggcatggtacttcaaggcagaacaccctgtttcccaagtcacacatccaatagttttatctttcattaatgatcctcatctgacctgatgatcttgacctgaatggttacaaataggtgatttttctaatttcatcattccttccgtatttttaagctaggattaatctgtaatgaatatctctcccatatctttaaatgaagacaaacaaactgcatggcaatgacaagaactcaatagttttatccttgccactacacttgttaccatcccagaagatgtcatttgaaattcaatcatatgtttattcacaaatgccctgtgaacagatactgtggccatttcccatgtcaacagagacttcaacttttagttatactctacacataaggttggtgaaaactgaagtgatggaatagagaagcaagtgtggacagccactagtttccaagcttgatgaaaaggaggacagattcagaaggttgcatccaagtatccaagtactcaggacttcaaatgtgattgcagggcactttagcaagattattgtcatgggccttaagttcatgactcttattacttggtctatccatctggaaatggtactgcccttctttggaacgggatttcctcatctgcacatcaaaagatttaactacatgattaccactgtttcttcaaccttcatggcttctttacagctcagttcatctatgtctcttgtttctagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggtaatataaatttatttccatttgtgtttcagggtacaagataacttttttgatccattggaacttacatgtgcctcctctgcagtggtacaattactctttgtacatgatcaagagcactgttctgaatgcctgtgtacaccctgctcatgatacatcctaattattgggccagattagtggactttggggagttaatccaattcttccaaattgagaaagctgaaatataggttggttgaattctgcctctaggtacaccagtgaggtacccaagaactcctcctggaagataaaactaattacattttcctcactagccatgaggaagttatctcactccagaacttcactgagtgtcttccacatggtgtccctcaccccctaggctgggcttgtaggataaaattatccacaaacacagaatagggtcttaaaaggctcacttctgagtttggaaagcagagtaaacagatcattgtagttcaataggactgaggctgtgatatggaaagaacaggctgttgggggttgggaggtagacggaaaagctgtctgcttcttgtactcttataccccaaagtgaggcataagtaatattttaatagcagtaaagacatttgagctacctcaaaggaggcagagaggatgaaaagaagagaagacagggctattaaaggagataatgagccacaggagcaggacattggctctaaataaaggatattagaacctttgccaaatgaccatggatgggatgagggggacattgggaatgtagcaggatactctgcagtgatgcagagcaccatgctgttcccctagtcatggccatgtatattggatgttggatctccatacttgaaatgtgtgtgctgagcatctggtgatagaatctccttcctttattctatgacctttaatgtctgctttatatctgccactgtagataccaagacaacaagaaaagaaaccttccttcaagcattcacatttagcacatgtattagtccactcttacattgccttaaagaactacctgagattgggtaatttatgaagaaaagaggtttaattcactcacagatccacaggctgtacaggaagcatggctgggagacctcaagaaacttgcaatcatggtgggaggcagagcggaagcaagcacatctttccatggcagagcagaagagagagaacaatgaggaaaggctacatacctttaaacaaccagatctcatgagaactcactcactatcatgagaacagaaagggggaaattatcccccatgattcaatcacctctcaccaggtatctcccccaacattgggaattacagtttgacatgagatttgagtaaggacacagagcccaaccatatcgcacactaataaataaataaataaatcagtaattattattctaggtgatccatgctgtctgtttcttctgccataacaaaatatccaagactaggcaattgataaataatggaaatttatttctcacagttctgaaggctgggagttccaagatcgatgtgtcagcaagttcagtgtctgatgtgggcctgttccttacagataatgccccctctgtatccttatatggcagaagggcaaaaaggcaaaaggggagaaatggctcccttgcatctcttgatgttattattttagcaaggacagagccctcctgacttattcacttcctaaaaggagccatctctttagtaatgttgcattgggattatgtgtcaacatatgaaattgggggaggcatattcagaccatagcacatttttcaatggaaatataatgttgaggaaacccagagaaggcaacattttcttgctcaaggagatgagaaagagggtaaaaaaggagataaaatttgacctatgtcctgactgtggtaatagaaaagttcatcttggctaaaaggagcagcatgatataaaatttgaaacctcatggtgtgttggagactgatgatgagtggctatgcctagagttgacagtatcggatttgaagagtgtaaggagtg

SEQ ID NO: 16406 - DNA, 68778 bp, Human
  misc_feature (1)...(68778): n = A,T,C or G
gcggaactgaaagaaggcagaggaactattaggtagtcaactagagtatgagtgtcaccatataaagatgaacttcatttatacattaatccagaatatctaggttccactcaaggttcaaacgaaaagataaggatttcctacttcctacgagcctctgaattgacgaattcagtgttcctttttagatctcaaccaagttgacccctttgcacaacttgacaatgacgcttatatcccatcttcctagaaataactctgcccttggcatgccattcttttctagtgctaaggagtgtggcctctgtagtcagattgtattagttcaaatcctggttcagccacttacaaactgtataatctagagcaagttcactaatctcttcaaacctcagtttctcaatgataaaaggaaaaacaatactagtacctacctctatgagtccctttaaggacccatatacatgcttacagtgcctgaaacacagcaaatgttagcaatgatcatattaacttccgttatgactgtttcgaaagtctcctgatatctcttcttccgctcatacctcaaaaacagctttgttttcttggtctcatccattcctatgacttcagcagctgaaaacccacaaaatatatttcattcaatgccaggcctcacgctggagcttcagggtccttctacactttgtgcctttacacgcatttttccttccatctggaaggcttctaccatctgccaaggtaacactgcgaggtctcaccacaaactgaattgatagtctcaggctgagtttgcagagaaccaaagtcactcctctaccatcagagtactcccctatcaccacatacattatcatccactgtagttgtcttatctgtacctggtaaatacagcagctaacgctcacgagtgctcaccacaggtcaagattatctcacttatcttcacaagacagtagagagcggccacacgactgacagaattccaattccagccgtatgattccagagcccaagctcttaaccgcgaggctgaagttgaaatatcaataaatgctcgctgactaaaagtactaaatacgagagagagatcaaaagatgactagtcaagtcgcgtagttaaatctgaaccctaaggtgacacaaaaagaggatgcgcaggaggcagggttcaattcagggcgtttaaaaggaggaggttattggccaagtccgctaagcacccggagagaggccaggaaagatggagtgaggagagggaggagtcaagggccactctggaggggtgcatgagattggcggtctggggagaggacagactgggtcgcacacgactgaatttcccagcgcagaagccgctgcgttgcctccgcgcccctaccactgcactcggaaggtcaaagtagtatcaaccgcggcggtggctgcagcgcagatcccgactcctctcgcctcctcccgcggccacggcttcttttctccgttagccacgcagctacctactcccgcttccggttcaaaccctgcgtgactgcccagcgcccacttctggaggaagaagcaacgccaagcagccgcagagcacggtatgcccatgcgcatccagtatcacgcggtctccgcgctcaaaacactgccccaaaacattcggcccgtcggagcaaacgcgcctgcgccatgtccaccaatggccagcgacttagcgtttgcggctcgcccttcggctcgggctccggggctctcacccaccctcttcgccctcgtcgtcctccccgccctcctcatccccgcccctccaagtctgaggacggaagtgacgacagttccgaaggcgaacggaggcgggtttcatttcggcgcctttctttctctggcggaagcgattggctgccgtgaagcgaaagaggcgggacaaattgccgcgagttcagtgccgccactggaaccaggagatgcggcgcaggagctgtcgctgtgtttgctttaacctgagtcttgttccttattgtggttcctgctgtggttttgatcatgttgttaccctcggacgtagcccggcttgtattgggtaagcgcggacgcgggatggagggttattggacccggctatgctggacagaaggacctttgaggccaaaggttttcccttggtagggaagctttggggttttgcctcccagcttacgagttgagactggcggtgattcttcgtcattcggaggttctgggcagtttaagcctctttgtatgtagatgctcctctcttcagaggctgcgtggcgaggggaagcccgaggggaagctcggggtggaacacctggggcggattcggaaggaaagtcaggcctccacacttaattaggacccctgaaagagcatttgtctgcatgacggacggattgcgtgtgcttcaaccttgggcgcaatttccttggttcagtgttgggaccaaaatagggcaaatagggagttccccggccccccatctttgtagagagaccttcctggcgcccttctaataacccgcccttataactacgaatttgggagtaggggtgatcttccttctccatcctccacgcaatacgtcgtccagtgtagaggtgtgaaatgccagttgcatattttaaaacagcaattcctgttcctttgatcagcgaaaaatttcagagggttaattgccttaaattagttgaacgttttctagccctagttttaccttcatttgaggagggattgtttgtgggtcacttgtctgtcagggtgtattgtctgtgtgagagacgggttttgttgttgtttgtcccctgaaagaataaagaggattgtactacaggggacgagagccaggtaaagctcaaaacccgagccagtaatttacggacgtcgtatgcgacgtccctaaaagtaaatggcaagcatctgtgatgaaacctcccatagtattcacagccattactactattattttattgttcggaaaacccatttgtcttgtgcctcttttaaatgcccagcgctgtccacaaaaatgttatttgcgcagggctcttgataagcacattttgcaggaaacgttaaacggaaatggttccaccatccatttttgaagaaacttaatgacaagtttaatgttttgttaatgtctgattaatcttttgcttaagaattctgagttttggcagtttggtaatctagttgagtttcggtaactatagtcttaaacatggtttctcagcctcagtactgttaacattttgggcctcataattctttattgtggggagctatcctgtgctcaaacattgtaggatgtttagcagcattcctggcttctattcactagattacagtaggacacccgttccccaccctacccttacccagttgtgatcagtgaaaatgtctctagatattgctagtatgtcccctggagggcagaatcacccctagttaagaaagccctaagaaagcagtatcattttctaattgaaataattcacatcgatgtgtgagtattctttctccacaaaccagctactctgctgacttcctgcttttcatttaatggacaaaaaacgccagccatggttttcttatcttaaaaatctttgtcattcacattccattttcactgccaccaatcccgcaatgtgcctgccattacttctcttttggacttctgtcatggcttcccagacagttgtcctcgcaattcattttatttactgttgttacaaatctccctgaagctttcacactataccttttagtctgaaagttgagataattctattcttactaaaaatttcagatgggcaggagtatacaatacaaaaaagcctccccatgcctaatgctcttacttttgtcgtttatcattttacatcttaaatagatacatatcgtgtatatctttctcatatgaggtttattatttactcatgattcttttcctatcagtaccccctcgccatcttcagctcctcttgttattggtcccttcataatgttttttttctagcaaatctttgggtgcctagtatgttccaaacactgtgccaattgctgaacatagagaagttaagttttctccccttagtgttcagataattaggttttttttaaattcttaaacatacacacaaaaaaacacttttctggaccccactagacattagacacccattaaacagaacattctgtcttatgttctgtgtcaccctttcacaagtcaaatttattcaaagaacaatgaattccacttagttgctgttcttcacctaccttttatccttcaggatactgcactctgacttttgcatctcactactccacttaagtagcccttattgccttgctgggattttacaaaatgttgtgtgggccagaatacatcaaagtgtttgttgcctctgggccatcagttcagtttttatctatttattcaaggtgctctgtggaactgatcctacctacctctccaacttgatctcaacttcctaacatctgttttatgctgcagacatgccaaacgaattgaagtttctttgaaaattcttgtatgtattctacttctctttgtcttcctagtacacttctattcaaggttcaggtcatgcctgatctctgaaacttcattcagcaagtacagtcagtacttcttaaatgttgccatagcattgtacttctgttacaaccttatcatgtctcattgtagatgtgtgtttacttttttttgataaaatatactaacaaaattcaacacttaaaaatgtatagttcttaaagcccaaaacaatgagtttgttgttgttgttgttgttgttgttgtttgtttttaatgtacagatcagtagtgttaactatattgacatttttctgcaaccatcactaccatcagtttctggaactttttcatcttcccaatttgaaacttacttggttttttgttttattagtagtcttagtcatggatgaatggacaagcttcaagagttctgggagtccccaaaactatcatctgtgaaggttttcttgaatagatttgttaccttctgtatgagacagcatgcagtaaaaaaagtagaaaccattctgagtatttaacatggaaagatttaatgagagaattcgtttacactggtgagagaaaagctaagacgcccagcagcttacaactaaggcatctcagtggttagcaacagtaggaagccactatgctaatgagaaggataaggagagaggaagcaatcaagaggctggtttgactgcggaacgtggaagacttgtctgatgagggagtggtagtcttagaggagactctactgaggcagaaagggaatgggggaaaaatatggctgcttcctcctgccctccagcctcccaccagtgcttcctatttactgagcccagccagtagcaggccgacagaagagcttggggaacattgcctatatagagtcaagctttatgtcatacagtagagagcgacagaagggtcaagaacgtgtttgaggtcaaacaggaccaaaactgacacacccctaacaggtcaagagctgctggttctattcacctttatatcaccaaaacatagatatttaataaaacatttgcaaaagtatggctctgattatgacactcctttgtttatttaataatatatgtactcattgctgtctaaaacttttcatgatccttacccattttgtcttttctgttgtatctccaactgttacccttcataaaccttgtgctgcatccaaactggacatgttccccaaatatgattgcatatatactttctgtcagcttctttgggattcccaaccatccttcagtactcatctgcaccttcaaacatcacataatttccaagcttagtagtggtttctccagcccctcccttcccatgaagtgagtcagctctattttcttaccatttttgctttgcattacagttatttgtgtatatatcttctatctccaagtaaattgtaactttatagacagaaaccttgtccctgttatttgtggatctagtaatataagacaacataaggtacggcttcctaagaattatttgcatgcttaacgaacattaaattactaatctttctaggaaataataaaatatgtgaaggagatgttttcacatagcgtgctttactatctcttgcttgctttaaacctctctttttatctttccctctctacaagtaggaagaaaaaatacccttcatatagttaggatcttatcctttcttctctttttcggttgtttccccttcaattcatttagttactcattaccacctccacttataataaaagtaggctgaagataatattatgttaagaaggaaactcaggcatactttcttacctattcggggacctttgtcagtaagtttacacaaaaaaatacacttcttttattcttaagttgtttttaggaataaaaggaaaaaacagtaataactaatattagttgtagaataacgatttgtattatactgataagagatgattagtgcctagtttgtattttctattttatttatttatttcttgagacagaattgcactcttgtcatccaggctgggtgcagcagtgagatcttggcttactgcaacctctgcctcccaggttcaagtgattctcctgcctcagcctctgaagtagctgggattacaggcgctcaccaccacgcccggctaatttttgtatttttagtagagactgggtttcaccatattggccaggctgttctggaactcctgacctcaagtgatccatgcgcctcggcctcccaaagtgctgggattatagccatgagccactgtgcccagccagtattttcatcatatttggattttcattcatctaacaccagagatttagaattaatttgtgcctaaaatttcctgttacctgactgagaattggttatagtcagatacttaatgatgataaataaacattttgtaggcagatactaatcatatatatatagtaaggcctaatttaataggttcaataggttcttgaaaactgcaactttaagcaaaatgatatataatcaaactaattttaccataggctaactgatatatacaagaatttcttcagcatatttttggtcacaaaaatatcaccacacttgtaaataaagtccaaaacacttctaatattaaacattgaaatacatgtaagctatatatacatttaagatggattaataaaaacaagataattacttacccagttagtccagttcaaggttgcaggtagctagagcctatcccagcagcttagggtgcaaggcaggaactaaccctgggcaggatgtcattctgttgaagggagcactcacacgcccacgtacactcactcatgctcacactgtaataatttagacacaccagttaacaacgtgcacatctttggagtttgggaagaaacgtgtacctggagaaaacccatgcaggcatggggaaaatgtgtaaactccacacatacagtgtcctcagccagaaattgatttttttctctcatcagcagtataacaaaaacattgaacaaaatgatggtattcgaggacttgctatataatgatcagtgaacatgagagtagtcaactatttactacattattttggaacttttgggacaaaagtaaaccagaatacatcaaatctaatctaaaatgagaactcaagattgccaaagttggggcatgttgttaagagcagaagataatgtatcctagatattactattttgagatacattataacttaaacacttattatagaggtaatctagcttttaacagccccatctcatgtgtgtgctatacagaggtataatgttttatgaaatgccatgaattatctgtaatgattccaggttatgctagcacaaatgacaatatttttctgaaaaaggtttactgtgtatcactgtattctgtctggggcattgtttctcaacctttatttcattacacaactttaaggaatcttcttaggctttttttttttccctgaccctcctctcctccccacacgaaagtttaatgttttagtgtcatgaatatattgtatatgtttatatatcatgtgtatctgtgatttatgcataaaaagagggagattttcttcattcctccctgccccagaaccaattttcagcctcttagggcagtatgactccttttgagaatgcatggtctaggggaaagcaaatctactttaagatagataaaaatctactgcaaatctatagtagattttaataccaccgtctatcagaagtccccaagtgactgaaggcatctagggtgataagtacttgaaactccaccatgaaaaggaagtatatttgaggtgttcaatctaaatcttgaagcatatgaggaaaaagctccaactgtcctaattttaaggtgattctaatagtctgtagaagttttaaatttttgtgtttacaaaaagctagtaacagctaactcacctattccaaatattataacggtcggaaagccagccatcataaaaattacttttcagccagctagttttcacaaaaagagaagaaaacattgcagtgtatctttgatctaattaatttcacatctgtggtttgatgttcaatgataggaagattgaagtcatgttatctgagataaagctttcttcagatatccaaatgctttctccaaaacacaatgcctttggtttttgatttgtatatttgtttgtttcttcttattagttagcaagaggttggaaaacagattcatcaacaagtagagagtggtgagttgattcccaaatcacagctagggcattgcctgtaacgagatgaccatatccttgccctttcctttttaaaaccttagtgtataatgactttgtaggcaaccttattaggtttttcacctgttggacctggttaacgatacagttccaggtgaagagagtagaacgttataaagttggaagagacgttagacataatttcttttttttatcttttaaattcaggggtacatgtgcaggtttgttatataggtaaacttgtgtcataggggtttgttgtacgtattatttcatcacccaggtgttaagcctagaacccattagttatttttcctgatcctctacctcctcccacccttcacctccaataggccccagtgtgtgttgttccctttatgtgcccgtgtgttctcatcctttagctcccacttataatttcagtagctaacaaatacttactgactattatgccagcactgagataagtgtacttcaaaggaaaatataagggaatacttataagtattaagtaatacctataagggaatatttaatagtagggaatagggagtaattatactaaactgtgaagaatgagttgaagatagctaggttaagaaaagattagctgcccaagcaaaggaaatagaataaacaatggccttgaaatataatcaatgtgtatctgtgggactgaaagaccagtttggctggaagcgatggaatggtaaaacataggctgaagaggaaattagggtacaaagcaagtagaacctcatacgacacattaaaaatttgaaatcataggccgggtgcagtggctcacgcgtgtaatcccagcactttgggaggccgaggcgggcaaatcacctgaggtcaggagttccagaccagcctggccaacatggcaaaaccccatctctactaaaaatataaaaattagccaggcatggtggcaggcgtctgtaatcccagctacttgggaggctgaggcaggagaatcgcttgaacctgggaggcagaggttgcagtgagccgagattgcatcattgcactccagcacaggtgacaagagcgggactccatctcaaaaaaaaaaaaaaaaaattggaatcatatttttttattgagatatgatgcacatactacaaaatgtaaacttcgttgtttttcagggtatgaaaatccaggatatttatggattcataatgtgcagatatcaccagtaatttcaatatttccatcactccaaagagaatccttatactattaagtcacttccaattcccccttgccccgtcctctgccaaccacaaatctactttctgtatctatacatgtgccttgcctggacattgcacataaatgaaatagaatatttcgctttttgtgtctgactttcacatagcataatgttttcagccttattccatgttgtagcaggtattagtacttcattcctttttatagctgaatatttcattatatgaatatgccatattttgtttgtccattcattaatggacactgttatgaaaaatgcaggccagctgtaatggctcaccctgtaatcccaacactttgggaggccaaggcaggaggattgcttgaagccaggggagcgagaccagcctgggcagcatactgagacaccccatctgtaccaataagtaagtaattagctgggcatttatttggtggtacatgcctctagtcctagctactgggttggctgaagtgggaggatcacttcagcccaggagttcaaggttatagtgagctatgattgagccactctacttcagcctgggtgacagagcaagactctgtctctgaaaaaaaataaactgaccataaatgtctggattccatgcttcagagttgactagataaataagaaaggtctggattttttattttgttccactaatttctgtgtctaacctcatgcccgtacatcgtctggattactgtagctttacagtaagttttgaaattggtaagtgtaagtgcttcaactttttcttcattttcaagattattttggctattccagcccccttgtattaccttaggagttttaggatgtttgtcaatttctgcacaaaaggcagttgagattatgataggaattgtgttgaatgtatcggtgaattttgggagtattgagtttttaacaatattgaacctttcagtccatgaacacagtatgtctttgcgtggatttaggtctttaatttcctccagtgacgttttccagtttttagtatgcaagtcctttacttttgttaaacttattcctaagtattttatttcttttgatgctattgtaactagcattgcattcttaatttttggtagttcattgagatttattgacttttatatattcactgtgtatcctgcaaccttgtcgaagtcatttattagctctaatagtttttgttttgtttcgttttgtttttgggacagagtttcgctcttgttgcccaggctggagtgcaatggcgcaatcttggctcaccacaacctctgcctcccgggttcaagcgattctcctgcctcagcctctggaatagctgggattacaggcatgcatcaccttgcccagctaactttgtatttttagtagcaccagggtttctccatgttggtcaggctggtctcgaactcccgacctcaggtgatttgctggccttggcctcccaaagtgctggattataggcatgagccaccatgccccgcccagggaggtttcttaactccttttttttttttttttttttttttttgagacagagtcttgctctgttgcccaggctggagtgcaatggcaccatctcggctcattgcaacctccacctccctggttcaagtgattcccctgcctcagcctccctagcagctgggattaaggtggacaccaccatgcctggctcatttttttgtatttttagtagagacggggtttcaccatgttggccagactggtctcgaactcctgacctcaggcaatctgcctgccttggcctcccagagtgctgggattataggtatgagccgtggtgcctggcctctaatagtttttttgttgttgttgttgttgttttttatggcttccttaggattttctatataagacatgtcatctgcaaataggggtaatcttgattttttcctttccaatctggatgctttttttttttttcttttgagacggagtctctctctgttgcccaggctagagtgcagtggccctatctcagctcactgcaacctccacctcccggattcaagcaattctcctgcctctgcctcctgagtagttggcattacaggcatgcaccaccacacctggctaatttttgtatttttagtagagacggggtttcaccatgttgagcaggctggtctggaactcctgacctcaaatgatccgcccagctcggcctcccaaagtgctgggattacaggtgtgagccactgcacccggcctggatgctttttatttcaagttttttcctaattgccctggctagaggatacatgcaatgttgaatagaaatgacaagaacagaccttcttaccttttccctgatcttatggggaaaggtttgaattttaaaccattgaagatgatgttacttggctttttttttttttaatagataactctatgaggttgaggaaatttctttttatttctagtgtttttatcatgaaagggtgttggattttgttttttttggtttctttggtagagttttgttttgttttgttttgcttttgaaacaggttcttactctgtcatccaggctggactgcagtggcatgattatggcccactgcagcctcagcctcccagactaaaactatccttctacctcaccctcccaagtaactggaactataggcacatgccaccatacccagctaaatttttaattttttgcagagatgggggtctcactatattgcccagattggttggattttgttcagttctttttccatgataatgtgactttcgtcttttacgttagggatatagtatattacactgatttatttttattcaaccaaccttgcattactgcattaaatcccacttggtcatggtgcatcactgtttttatatgttgctggacttgatttgctagtattttgttaaggatttttttttttttttttcctgaagacagggtctcactctgtcacctattctggagtgcagtggcccaatcatggctcactgcagccttgacttcccaggctcaagtgatcctctcatttcagcctcccaagtagctgggaccacaggtgcacaccaccatgtccagctaacttttgtattttttgtagagatggcattttgccattatgcccaggctggtctggaactcctgagctcaagcaatcctcctgcctcggcctcccacagtgctgggattacaggcgtgagccactgtgcccaccctgttgaggacttttatgttcactttgtttcttttctttttttttttagacggtgtctcactctgttgccaagctggaatgcagtggcgcgatctcggctcactgcaacctctgactccctggttcaagcgattctgtcccagcctcccgagtagctgggattacaggcacacaccaccaggcgcagctaatttttgtatttgtagtagagatgggttttcaccatgttggccaggatggtctcaatctcctgacctcatgatccacccacctcggcctcccaaaatgctgggattataggcatgagccattgaccctggctcccatgtccagtttcataaggattattggcgtgtagttttgtgatgtctttctcttgttttggtatcagggcaatattggtctaaaagaatgggttgagaagtcctctcctactatttcaaaaagagtttgtaaaggattggtgtttcattcaatgttttgtagaattcaccagtgagggcatttgatcccagttgggcttttcctcgtgagaggtttctttattacaaattccatttcttgttataggtctgttcagattttctgtttcttcttgagtcagttctcatagtttgggtctattagtctgttcttgtgtttctatgaagaaacacctgagagtgggtaacttataaagaaaagaggttttaattggctcacagttctttaggttttgcaggaagcatggtgctggcatctgcttgccttctggaggccttgggaagcttaacaatcatggcagaaggtgaagggggaagctggcctctcacatggcaggagtgagagcaagagagaaagaggtgtcacacacttttaaatgaccaggtcttgtgagaactgactatctcaaggatagcaccagggcatgaggaatctgcccctgtggccaaaacacctcccaccaggccccacctccaacattggggattacaattcaaggtgagatttagcaggagcaacatctaaactacatgagggtctttctaagaattactcatttcatctagattctctaaattgttgagataacaactgttcatactgttcctttacattcccatttatttctataatattgatagtaatatcccctcttacttttctgatctagtataatttgagtattctcttttttttttcggttggtctagctacagaattgtcaacattgttgacgttttcagagaactagcttttgtttttattcatttttctctatttttgtttcatttatgtatactctgcttatttccttctgctttgctctttttctagtttcttaaggtagatgatgtggttattgaatttttttttttttttttttttttttgagatgaagtctcactctgttccccaggctggagtgcagcggcatgatctccgctcactgcaagctctgcctcccaggttcatgccattctcctgcctcagcctcccgaggagctgggactacaggcgactgccaccacacccagctaattttttgtatttttagtagaaaggaggtttcaccatgttagccaggatggtctcgatctcctgacctcgtgatctgcctgccttggcctcccaaagtgctgggattacaggcgtgagccaccgtgcctggcccaatgtggtaattgattttaaattttaaggtttttgtttacttgtttgtttgttttgagacaagatctcagtctgttgcccatgctagagtgcagtggcgcgatcatagttcactacagccttgaactcctgaactactgggactacaggcacgtgccagcacacctacctaatttaaagagatgtttttagacacaggctcttgaattcctcacctcatggtactctcctgcctcagcctgccaaataggtgggattataggcatatgccaccatgcttggcttatctttttatttatttatttattttatttagttatttatttttgacatggagtcttgccctgtcacccaggctggagtgcagtggcatggtcttggctcactgcagcctccgcctctcaggatcacgcagttctcctgcctcagcctcctgagtatctgggattacaggcgcctgccaccatacccagttaattttttatattgttagtagagacggagtttaccatgttggccaggctggcctcaaactcttgacctcaggtgatctgcctgcctcagcctcccaacgtgctgggattacaggcgtgagccaccatgcctggcatctcttttttaaatacaggtgtttatagctgtaaattttccactgtgcactgctttagttgcatctcataaatttattgacacttatttcatgtcctaatatatggtcggccctggaaaatgttccatgtacacttgagaaaaatgtgtattatgctgtttttgactggaatgttctatagctatctggtaggtctagttgctttacagtttaaattttctgtttgtttattgatcttctgcctagttgttctatgtattactgaaagtgtggtatagaagccttcaacttttattgttgaattatctgtttctcctttcccttctgtgagtttgctttatactttgggctcagttaggtgtatttatgtttataagtgttatttctctctctctctttttttttttttaaagacagggtctcaccctgttgcccaggctcgagtgcagtggtgcagtcatggttcgctgcagcctcgacctcctgggctcaagctatcctcccacctccacctccagagcagctggaactacaggtgcacaccaccaagcccagctaatttctaaaaaccatagaggtgggttctcactaggtttcccgggatggtcttgaaccctaggctcaagcgattctaccacctcagcctccccaaagtgagctacttcacccagccatgttatctttttgtggattgaccttttttgtcattatctttgtctctagtaacaatatttgtcttaatacctactttgagacaggttgagtatccctaatgcaaaaattcagaatgctccaaaaccaaaactgtttgtataccaacatgaccctcaaaggaaatgttcattggagcatttcagattttcagattagcgatgctcaaccagtaagtataatgcaaatgttccaaaatctgaaagggagaacaatctgaaacacttctggtcccaagcatttcagataagggatatactcaacctgtattaacataacaactttaagtcttacttgattactggatggtgtaatccagtcatctttcctatccttttactttcaccctgtttgtgtctttgaatcagtccagcacctggtgccaagacgccggctgcagcacgggaggtgtggccagggctgtgtgctccacagggcagcaggagctgggaacagatgggtgccctgtccccttccaagttggatgggcaggagccctgccctcccaggtgcagctgcagctgtggagcaggcatccctgcactctcgggggccagggaagcccccctttccctgcaggcttggaagcgcctactcccgctgcctggcctctccctgctcccggtgcccactccgatttcaaagtaaagttgaggctgagcctgctgctgtcgggacctggctgggtgtgtgcacactaggggcagcaccaacacaccagcctcatgctgcctcggtccccctctggactttgagctctgatgagcacatgagggaggccaagggtgaggctgagggcaactcggcatgggcctgccccttggcatgaacagcctaagcaccgtgggcaccttggatgtcaggttgatggtggcaggaggcagatggtctcctaggtggaaaggggcaggcccctggtgaagccacaccttcaagccagagacagctaaagcctgggggccagactgcagatccatggcccagagtgagaatttatggtgctttttctgcacccacccatggctgtccatggacccatcagcacatacttactcccatttgaggtccataaaaaccccagactcagccagactcacagagatgttgggactaccagctgtgagaaggagctactcactgtgggtctcatctccaccgagaactggtcacttgttgggacaacctgcctgcagaaaggagctacccactgcagctctattcactgagagttggacactcgtcaggatgacttgcctgcagaaaggagctacccactgtgggtctcctctctgttgagagctggacactcatcaggatgacctgcctgcacagaaaggcactgcagaaaggagcttcccactgtgggtatcctctccactgagagctggatactcgtggggacgacctgcctacggaaaggagctacccactgcaggtctcctgagggctgttctgtcactcagtgaagctcctctccgccttgagcaccttccagttgaccgtgaacctcattcttcctggacgcaggataataacatgggacccactgaaaggcgggactgaaagatctgtaaaacagggctgaaacatgcccccttgctcaccacgttgcagacaatgagaaggaaagaagagctgaggccctttggggagcccagacctaagagctccccaaaccagggttgtgacaccctctttggggctctgggattcttgatgtctccaagcttcagggtgccactacgttccccagtacccacagtggaagccactgtggtatgtctgatccagatgcaacctcacagggagccagtgcctggatatgcccgccctactgcatccaacatgcctgactatgctcggtggctgagctcactcatacacccctcactgcttcatgcctggctcaccaccagcaggcatgggattaggcccagtagcatgagccaaacacagcctgcttggccaagtgggcggaacaaacccagcaggccctagcaaaactcaggcaaaggcaccaccagccacagaggtttcgaactggaaaagcgacaccctaaggatcctgtgacaacagcatatagttggatcatgtttttaaggtcatataaattacaccttcatacattatatgcccatattgttgtgtacagttatctttttaagcagagttggggaagaaagtttacgtacaacaaacacttatactattttatttttatttatttatttatgtatttttgagacagggtctcgctctgtcacccaggctggaatgccttggcatgatctcgcctcactgcagcctctgcctccccagttcaagagattctcatgtctcagcttcccaagtagctgagattacaggcgagtcccaccacacctagctaatttttttgtatttttagtagagatggggttttgctgtgttggccaggttggtctcaaactcctggcctcaagtgatccacccgtctaaacctctcaaagtgctgggattacaggcatgagccactgcacctaacctatactgctttatattatgttgttatcaagttactctccagtatcatctcattttagcctgaaggagtccccctttagtatttcttacagggaaaatctgctagcaactaattcttttagttgtttatttgataacatacaatttttaaagttttagtttggagtcttgttagatatagaattcttccttgaggctggctgtggtggcttactcctgtaatcccagcactttgtgggggccaaggtgggaggatcgcttgaggctaggagttcaagacctatctaggcaacatatagtgagacaccatctctattaaaaattttttcatttaattagccaggcatagttgtgagttcctgtcatcccagctacctgggagactgaggtgggaggatcgattgagccccagcattcaaagctacagtgagctataatggttcctctgctcttcagcctgggcaacagagtgaaacgctgtctcaaaaagaaaagaaaattcttggttgacctttttttgctatcagttttttatcttttttcttcaacaatcaaagtaaatatcaagtctttgaatatcatctcactacttctggtttctggtgagaaatcagctgtcagtcttactgagaaacccttgtatgtgatgagttgtttctcactgctttcacgattttgtttgtctttgtattttcagtttgattatggtctgtctaggtatggatctcttttagtttatcctacttagagactgttgagctaccttcatgtgtagattaagttttttctcaaatttgcacgtttctagacattatttcttcaaatattctttctggcatttctgtcgttctaggatttccattatgcttttgttggtaaaattgatggcatcccttaggtctctgagactctgttcacttttcatcattctggatttgtttccattcctcagatcaaaggactgttacaactctgtctccttcgtgccatccacaaggcagcgaatgatagggggatgtgtttcagctcatttgtgttaacagctcattcaggcccactgccccactctggcttgcggctcctgggcctgcttggccctgccactgcttcctgtcatgtggggcggctgtccgctcctggcagaaggcaggagggctacaatgttatagcccctttcccaccggcaggttctgcaggttcggcaggttcggcaggttccagggttttgtcccgcatctgagaagaatgagattacatggacatgagagactgagcaaggtggaaaaggatttttattgagcaacagaacagctctcaacatgagagggtacccaaagtggataaccctctgtgtgataggggtcccaaaggtaggtaaccccacgtgttgctgagtccagggtttttatgggctcagaatgtgggagtgcatgttgagtggtctgtgggcgggcattggattggccttaggcatcgaggaagttttcattctagttgtggactctgtccggaactggcatgcagttttcaggcttcaggccacctttgacttgaatgttgggtttcaccatggacccacccctgtctgcctgggaatttgtctcttgctgctatcaatcctccctctgaagaagtacatctaactgccattaggataaggacaatgaccacaattgctgctttctgctgacggggtgctgttttgcaaaaacagcagtctgatctctctcagaggcctaagagttcccagtaaaagggagccatcgtctgaggctccatttgcatgaccatatggagtttaatgatctctaattgagaagaaacaaattttacaaggaggttaaatatacatggaccaaatatgtgtattatacaaagaggagctagaagggaaaaatgtagtcccaaagataacagaaataaggagcaaaatagactaaacatgctgaaacaatgttatggctagagctgtttcaccctagtgaaagaaattaaatcttgtatggggacagttaaactttagaagaaaaataactgtttaggggagtatataatcccttgggggttcaggattaaggggtccttggcaaagatgccttgtgaggaacagaacaagggtgagaagagcaagcctaggagagactataaagaggatgtccatggtaggttaatgacacttaaccttttgtcatttagcttgaggtctctgattttttcacactggtacttcgggtactgttacaggtcaacagagataattccgtcagttttcccaggcctttactcgagtatgatgaatctaagaatattttccagtgacatttactgccataggagtagaaagaagtatggtataaggtcactcccagtgccgacctagagagggagagagggtaggaagtgcctttacccagtactatgtcccctgggttgaatagagatggccctagttcacagaattgggcctctgacagttgtttcagttcctattggaaatgggccaaagatgttatacatgtaatctaatcagaggtttcttggtctagcaagaaatcattggtgagaaaaggtcgtctgtacatcatttcaaagggaattaaacccagctttgaaggggtgtttctgacatgtagtagggctatgggaagaaaagtaatacagggcagatgagtctctcaagacagttttctgcggtaccttttgataatatcatctgtcttttctccctttcctgaagattgtggtctcctagcacaatgaagatagtattgtatgcctactgcctttgagacccccgggtgacagcctccttgaagtaaggcccattatcactctggaggtgtttaggaagtgcaaaacgaataattacatcattaattagtacttttatcacctcagaggctttctgtgtccaacatggaaatgcttctacccagttagtgaagatatctacccacactaggaggtagtggatgcctctcgtcttctgcataggggtgaaatctatctgccagtcttcccctgggtaacctcccattatttgggttccagaagggagaagatgttgcttgaggggattatttctaaggcaagtctcacaagcattagtgacctttttgaccatttttagcagatttttacctgaaaaccacatttgggccaattgataggttttatgcttacctaggtggagggcttgctgaaggattttaagaacttttaagaactacctggctggtagctggtagatgaagtttgctgtcctctgattgcagccatcccgagggctgaaaggtgtgtccctgagaggtggcccattctatttccacaggagaatattgaggttttatttctcttggagccctcccagatcagaggggcctcaagtggatcagaaatctggggccctcttgctgccgacttagctgcttggtctgccaccttagttccctcagctatttcatctgttcacttttggtggcctttacaatgtaatattgccacttcccatggaaggaaaactgaggataatgatatcttaatttcctggtggtatgagagacctattagctgtgaggaagtccctttctttccagatagtggcatgggcagggaggactaggaaagtatacttagaatcagtataaatgttaactgctttccctttgctttattcaagcacctttgtgagggcagttacctcagctagttgatcacttgtgcctgaggagagaggcatgctatcaataatatcatttagggtgactattgcataccctgctttatggatcccttattccacaaaagaacttccatctgtaaagagagtccagtctgggttctctaaggaggtttcttcaaggtcctctctgaccgcataggtttgcactactatctgttcatagtcatgttcaagctccccagctttctctgggaggaaagttgctgggtttagggaaggacagattcttaactgcagatctctctaatagcacagcttaatatttgaggagatggtcatccactacccagagcctccccttagagaacagcagtcctgccacattatgtggagtataaatggttacgttataccccatggtcaccttagtggcctctggtactgacaaggttactgctgtgactgcccggaggcaggctggccatcctttagctaccaaattcagctccttgcttaggtaacctacaggtttctgggctggaccttgggcctgagttggaactccctgggccattcctttcctttctgatacataaagattgaatgtcttccctatgggaagactaagggctggtgcctcaagcaaggcttgtttcagttggtcaaaggtccttttagcctctggttcccaaattagggagtgagtcttagttgcctgagtctcctttattatgtgatataagggacaaactatttcaccatacccaggtatccatagtcctgtaatccccaagaatcctctcagttgcttgagggttttggggagaggaaaagaggagatggacttaattctttcttcacctagttccctggtcccctctgacaagactagacctaggtacttcactgaagtctgacagagctgagccttagattttgagaccttatatcctctgttagccagaaaattaagacaagccttactgtcctcctgagacttcctcaattggaacgcaaaggagaatgtcatctacatattgtaaaactttcacctgaggataaaggaactgcccaaacagctgggggctgtcttagaatccctgcggtaacaccatccaggttagctttgtggtctggttggatggatctttgaatgcaaataaatactggcagttggggtgtaatggtatgcagaaaaagatgtcttttaggttcaggactgtgaaccatttagttccctcaagtatttgagttagtagggtatagggattgggaaccaccatatggattggaaccacagcctcattaatgaggcagaggtcttggaccagtctccttcctttgttgggtttttgtacatccaatatcagagtattacaagggctgttgcagggtttaaggaagccctgcatccttgagttatcagtgatggcttctagccctttcctaacttctggttttaggggatattgtctctggttagagaaggaggtgggatccttaaggtggacctagaccagtatggcagttgtggctgcaccaattttcctttcagttgcccagacttctgggttaattaatattggtctgcactagggtgagacaaagagtctgtcctggagccataaggatgatgggtcccgtaccagctaaaatagccctgcctagcagaggagttgggctttcaggcatgatttaaaaggcatgggtaaacaaaaggtcccctcaactataactaaggggttgggaaaaatatcagattaaaggctttcctgagacatccctcacagtcacactaagaaaggaaggggaggcctggcctaataagttgcctcccaagagggaaaaaaatcagtctcttacatagcaaagctccctgtagtcataggactgtgctgactcctgacatgattgcgggggcggaaacaacttaaacgcaggtaggggaagttgcctgagggaaataacctcttgcccaatgcaaatggattccttcaacaggggaaagaaaactctcagtcattgcatccttcttgcttctaagaacagacaaaaaccaagttgttctgaattacactgctgatgactaagcaaaatgctcattccactcaataatattatcactgtggtttgcagcaacacccttaacgttgtgtatgaagaagagataggagccaggaagagagaaagaaaatgctataggaaagactggaggtcttgactgacacccgaacgggctgttggggattggggccagtccaggagccttcaggtaacactgaggtgtagcctcagccagatgccttcagttgcccgaggaccttattccgatcctatgcattggctagacctctgtgaagggagactggattgaaacaaagccaacattcccagtacccgagggtgatggcagaggcttgacaaaatcttccccagcaagcctgtcctttgcagctgtgccattcgctcttaactggctgacagaggcccagtgcttcatccgtttttggaaaaaaaatgtgaaggcaagaagcctcagaaatgaaagtgtaagaggtccactcttacccttgcacagatcccagacaagcctccagaaatgacacaggatccattcagtgccgctatgctgtccagcatctctgtggcctgtggcgcgcctgcctgggcctcgctcgcctctaggctcattgctgggccctctctgcccacttgacccagcagactgcttctggcccggattccatgcccactgcagctctgcattaagccccgcagctggtccagttgtgccatgattgtcttccaccttgggagccggcgtctgggtgagggtgacacagcagcgcccaaaaacttggagataccagcaaccacagagccccagctgttgcccagggagttctgaggtctgagcccccaaggaccgttacaactctgtctccttcccaccgcccacagcatggcaaacggaggtggcaggggagcgcatgtttcagctcgtttgtgttacagctcattccgtccctctaccctgcttcagtctgcttcagtcctgggctggcccagccccactcctgcttcctgttgggtagctgcccagtgccagcggagggctgaagggctacaatgttaagagttcctttcacacccaccattcagcaggttctgagatcttgtcctgcgtttaagaagaatgaggttatgtggacactggggagtgagcaaggtggaagagggttttcttgagcaacaaaacagctctcgacacgagaggggacccaacgtgagtagagctccatgtgagaggggattccaaaggcaggtagtccccatgtgtggttgagtctgaggttttcatgggctcagaatggaggtttttatgggctcagagtgcaggctgattggtccatgggtgaacctggaaaaagcaccatttgattggctaaaagacatctaggaagttctcactctggtcatgggctctacacagaactggcagtccagttttcaggcttcagactgtctttggcttgaaagttgtcgggtttcaccgggtaccctacccgtctgcttgggagtttgtctcctgctcttatcaactgtatttctttattcatattttctatgttgtgagagattattctcataattttctagacgtggattcctttagtttttccaacttatttaaaattgcttatttaaagtctcaagtctaatgtctggatttccctaggcagatttttggttttttgactctgtatgatccatacttccttatttctctgcatatctcataatattttgtggaaaataggatgttttaaataatataatgtgacaactcttgggattagatttttcttcttccatgtttgttgttgtcttagctgttgctgtttgtctagtgagtttgctgaactaattttatgcagtctatattctgtgaagagttgatactctgattggatgatgatttccttaactactgggagcaaattaatatcccattgtttgccaagggggtctgtgtgtgctttggggcatgctttagttcagccaagcagttgacccactctgccttagccttccttcactagttaaggttgatgttcttgttggaattgataatgctttgattcccaaagggcataaattaagaattaagggagttcctgtctcaactttcatgcagagtaggtcttctgttcattctttttataaatcatttggcaaataaatgaagtatacaaatacatagcagtgttgtgagaacatagttttctgataacgcagtaagtgaatttataccatcaactgacttggtctttatggaagttatgcagtagagggacatagttatttatcattaatttattggttctcctgtaagtactgtgaagtaattatactttgttaaacactttattttactagtttagctagaattgtttcttgtgaaagggccacctgttctatgaactgtactttgtattgcagcacaacctggtgtttctgttcaaggctgccaaacactagagcattccacctaaggtttcaattgtgacatcagtacatgctacagcattttcaatagcagttttaaccaaaagtacagaatttagtataagtacctaaacttttattttttatttaggttacttacagcaagaaaacctcatttctacctgccagacttttattttggaaagttcagatttaaaagaatatgcagaacattgtacagatgaagggtttattccagcctgcttactggtgagttatttgttccttaagggaaatatttcatcaacacaagagactaaaaacatagtcataaaatcagcttatcagaaaaaaaaaattgaaattggcagaaatttggtggtttatattcatgcatgactggtaagacccaaagaagaccagcttttctttttacaaatttatgccaaaactattaaatgaattacaactttgactccgagagttagtttcaaaatgacaccctcgtttctgattagtttcgctgctgctgtctccaagcctttttttttcttcctgacctgtatctggctgctccttttagacaaatataaaacagatattttgatatattattgtcatctcttttgttaaatatcactagaccaacaaaccatcatttggtacatagtggataccttccagaactacatcatttcacatggtgtttgccattttattttaatcatggctccttaaaggctatcacagataacatgaatgtctgcttaggaaactgaaaatgatgcaaaactaaagttaagcagggtcatagaatacagaatatacacaaatccattatattccgtatgcctgcaatgaacaattggattttgaaaatacccgtttataatagcaacaaacaaacaaacaaaatgcttagagataatctaacaaaatatgtgtgaaatccaaatgctcaaaattgcctgagatctaaggcctgaataaaaggagaattgtattgtgtgtacaaattgagagactcaatattgttaaggtgttagttcctcccaatttaattatagatttttcacagtcaaaatgcctgcaagcatttttatagataacacaaagctgaattctaagttttaaatggaaaagaaactagaatagcctaaacagtttctgaaaaagaacaacttggaggactcacattaccagacttcaagacttactaaaaaactatgataatcgagatgaaggggcatttttgatagtttaggcatgtggaaccacatacaagtccatgtagagacccacacatctgattttgacaaaggattaaagacaattcattgcagaaaggatggtcttatcaacaaatgttgctggaacactcagacatccatatgtagaaaaagaacctctacaaatacctcataccttatgcaaaaattaaccaaaatggatcagaatgtaaaacacaggaccgtaagacttctaaatgaaaacataagaaaaaaattgtgcaaagttggatttgacagtgagttttatatatgacaccaaaagcatgggctataaaggcaaaaattaggcaaattcaactttataaaaaattaaaaacttgctctacaagaggcacgttagaagaaataggctgggccagacccaatggctcatgcctataatcccagcactttgggaggcccaggcaagaggattgcttgaactcaggagttctgtaccagcctgggcaacatagtgagacctcatctctagaaaacaatttttaaaaattagccaggtatagtggtgcacttagtcccagctgcttgggaggatgaggctggaggattgcatgagcccaggaggtcagggctgttgtgagccacaactgcacggctgcacttcagcctgggtgacagagtaaaaccctgtcccaaaaaaaaaaggctgggtgaaaatatttatatcttacatgtctgataaagggtttgtacccagaacatatgtatagaattcttaaaacttaacaacaaaaaccaaacaattttttaagtggataagagatctgaagatactttaccaaagaaaatatacagatggcaataagcatatgaaaagatcttccatatcattagtcattaagaaaatgcaaattaataccccagtgagatactaattcctgttagaatggctaaaataagaaaacaggtttaaaaactggcaagtccttcaccacaaatatgcagagcagcaggaactcttgtttcttactggtaagaattaaaagtcatacagtggcttttgaaaacagtttgacatgattatgacatgattatatgattatgcatgtactcctcatgtgaaccaacactcacattacccaaatcaattggaaaacttgttctcacagaaaaacctagacactggtgtttgcttatagtggctaaaaactgaaaacaggctaagtgtggtggctcacacctgtaatcccagcactttgggaggccaaggcgagtggatagcgaggtcaagagttcaagaccatcctggccaagatagtgaaaccccatctctactaaaaatacaaaaattagctgggcatgatggcgtgcgcctgtagtcccagctactcgggaggctgagacaggagaatcgcttgaacccaggagacagaggttttggtgagccgagattgtgccactgcactccagcctgggcaacagagcaagactccatctcaaaaaaaaaaaaaaaatactgaaaacaggccaggcgtgatggctcacacctttaatcccagcactgtgggaggctgaggtaggaacatggcttgaagccaggagttcgaggctatagtaagctgtgagcagccactgtactccagcctgtgtgacagagcaagaccctgtctctaaaaaataaaaataaattttaaaaactggtgacaacgaagatgtctttcaaaaattgacaaactctgatgtgttcataacagcaatactccactactcagcaatagaaagcaacatgctattgattcacacaataacgtggatgaatattaaataaatccttctgatttcttctaaattaacaattctgaacaaataacaaattgtagatagtgggagccagatttctcactgtgtgaggaagaagatacaaataaacataataatgaaaccagtggtgttgggttatagtctgagatattggtatgacactgtagttattttaatatatatatatacagctagatgatacaaatgcttgtgtatatgcatttgtacatgtatgtatagctgtctgctgagagggtctggaagcagtgatacccaagtagctataatgtcctagtcaaacaggcaagattctttagaagcttggatgcaaaccctaatttcagtggctattttcattttcgattacctgcttctttaccctttcctcatcgctactctgcagtcagatcttttattaagttgaatggtagaatcttttcttgtgagaaattattggtagtattatacaattttggtaatatttgatctttttcttttcagtccttatttggaaaaaacttgacaacaattttaaatgagtatgtagctatgaaaacaaaaggtaagagttctgatttggagtttttttgctgatgtatacaatatttatctacttgatttagttaaaaatgatttctaaaggttattaatgtctcataaaagccttgaaaaaacttgtccctgttgtaatgagataaatttttctgggacacatctaatttgtttgtgggttttggttttttgttttgttttgtttttttggttgttgttttttgtttttttggttttttttgagacggagtttcaatcttgttgcccaggctggagtgcagtggcgtaatctcagctcactgcaacctccagctcctggattcaagcgattctcctcagtcagcctcccaagtagctgagaatacaggcatgcgccaccatgcccggctaattttgtatttttagtagagccagggtttctccatgttggtcaggctggtctcgaactcccgacctcaggtgatccacccacctcggcctcccaaagtgctgggattacaggtgtgagccactgcccccagccatttgtttgtgtttacattgagtggtacataaattgcaacaatctttatgttagcaaaaataacccaaaaactacctttaaaaaatatgtaaaataaaactcttacctctgtgttatctacactgataaacagacatcactatgtgttaaaaagttttaaactgacattttaattttaattctatgtagtctaagtctgaacacagaagccagtcatacactggcttatagttactagaatataaaattctacttgcctaaattaaggatgttttagagggaaagttttgactgcttattctctaatattgattattttcaatagcttacaacattaacaaaacaattagcactaaagaattcgcataagatgataacaaaggaaaagaagcttgacattttttgacattgtctgtgtataagcattgtgctacgtgctttcatatgttttttttctcatttagtcttttctttgtttgttttttttttgagacgggagtctcgctctgttgcccaggctggagtgcaatggcgcgatctcggctcaccgcaacctccgtctcccgggttcaagcagttctcctgtctcagtctcccgagtagctgggactataggcgcacgccaccatgcccagctaatttttgtgtttttagtagagacagggtttcactatgttggccaggttggtctcaaactcctgacctcatgatctgcccacctcagcctcccaaagtgctgggattacaggcgtgagccaccatgcccggcctctcatttagtctttagaataacccagtgagagagattgtttaaagccatttttaaatatgagaaaattgaggattaaatttccacacttataaggaatttgcataacctttatgataattattataagacagattactttaattcactttcatatgtcacatgatatcagatagaacaaagatcaaaaaattgtttctcctttttttaataaaatgaaggtgtaaaattattggccaaaaaatgcttcagagattttacagatgtccatttctactcatattgtatctgatactcagtggctttagaagagaaagcaaccgcattatagctttgcaagctattttacaacatagatttatttctcattttccaacatactgtcaataattgagagacaaggttttttgtgtgtctttgttcagaatgaatgatgaaatttcttcagctgggtttattaagaaccttttctcctatgatttagaaacatcaaataatgtcccagcaataatgtcatctctatggaagaaattggaccatacactttctcagatcaggtaataagctattagaatgtgcctaatgattttggaatgcaaatacactttgggtttaaatcttcttaagacctacacagtgtacttatataacactcatccagttttgaaattactctagaggttgctggtactgtggaggttactgactgacataatttgaaataaatagcatacttttaataaaatatttagaaaactaagatatgtagtagtttaatgacatttccaagtttccatagcaatttaaaggcagatatattgttagaatacaaatcacctaatcccaggccactgtgaattcccttaggcaactgtctctttattacatattcacagaattgatgcgttgaacccatgcccacttggtttcttaacttgtaaagaaaaaagcttgaagaataatgctaattctgaaatcttctgttatcaattttatgaaaatctcatatttgactatagaatttgttatgaaaaccatagtctcttaacctttctttcagagctataagtgactaccccacctaacttcagcatgggtttcattttcttcctctgcttaacctgctaaaatggctccaaatgctttcttcttaactctggaccacatcttacttggtagtcttatctttatatttctctttcctgactcgagttttgtggatcttgttggagacttacttgacatattttttatgataatggcaccgtgtctgtgactttatcgaataaaggggtgggccactctaattcatactaaaagaattaacttgtactgtgaatttttccatgtttgttggcatcttctttagaggtacaataaaataatttcatagtcataaattttataaaagctggatgtcctctgacatcaacttggggattctgaagtatttatatatggagtcatgtgaaatcagaatttctctgtgggaaggcatctctataattgtgaaagataataaaaaatgtatactttgtatattcttactcaaaaatgttaatatgtagagtttctaaagttaaattatcttctgttcatttttttaagaggtagggtctcactctgttacccaagctggaatgcggtggtgtgatcatagctcttgtagccttgaacgcctgagctcaaaagtttctcccacctcagcctcccaagtacctaggactactggcacatgccacctggctaatttttatttcattttatagagacagagtcttgctatgttgctcaggctgttcatgaactctcggcctcaagtgatcctctcacctcagccccccagggtgctgggattgcaggcatgaaccaccatacccagcccagattgcattcttaacgtaatgtcaaggcactctaatgcattattacattggatagaaacttcttaatgaaaattatgtgtgttgtgagtgtgtctacatgccactatttttctcctaaagcaaatcacagttgcttacccaaaaaatgtgtgtgtttgtcttttttgtctgagagagattttttgccttttacctcataactaacttgaggtctgactgtaactaaatcatagtggatgtcagcaacaaacattttttgatggataactactttgttttctttgttaggagcatgcaaagttccccaaggtttgctggcagtcagagaggttggtatccaactttaaacaatgttcacaattacttcaaacttaaactatcagatgaacattttaattcattgtacacatgtgctaagtatatattttccttaaactactgtttttctttcttttttttttttttttttttttttgagacagtgtctcgctctgtcgcccaggctgaagtgcagtggcacgatctcagctcactgcaacctccacctcccgggttcaagcgattctcctgcctcagactcccaagtagctgggactacaggcgtgtgccaccacacccagctaattttttttgtatttttagtagagatggggttttgccatgttagccagaatggtctcaatctcctgaccccatggtccgcctgcctcagcctcccaaagtgctgggattacaggcgtgagccaccgcacctggccaaactaccgtttttctaagtacagttatgttaattaatattttcatttatcattaaaatattttgtaaatactccctacatttcacattgactcatgtagaatgttttaattctcatttcataagttcaggtttcttgttttttgtttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaagttcaggtttcttaattcatggtgttatcaatattaattactgcagaacaaatataatcttggatttataaagcttgattgtattcattttagtttcttctgaaagtcgcataaatttagttgatatatttaggaatcattcttcaatctgtggatgtaacacgttgttatataataggttgcatcatattgacttcttacaattcccaaactaccctgacgttgaatttgttttttaaatgcttatatgtttcagcccgaacgagaactggaattgcagaaatcaaacggcagagaaagcttgcatctcaaacagctccagccagtgcagagttgctcactttaccttacctttcaggacagtttaccactcctccttccacaggtacacaggttactcgaccaagtggccaaatttcagatccatcgaggtcatattttgtagtggtcaaccactcacagtcacaagatactgtaaccagtaagtttacattttgttctcttaaattttgttgttaatcaaattgtatgaatgagataatatactaatgtctttatactcatagtgtaaaattatggccccccccataaaagatgagagagactaaaagtggaacagacttctagatttgctataagcatataaaatctttaaggcattttaatctagggttcttcctatttctacgctaattgaagtcttcaactctctaattctcaatttttggcattaagagaaaaagaagctgttgtatttgattttaaatggaatgtacattatattttctacttccttgcctttgttgatgtcagtctgtcctcctggaatgaggaatgcctttctacttctctatctttacatgttagaaatcctacatatgcctggctgaaccttagagttaggaatatccttagagagtgtgtggtatatcttatttgttgcatacttgaaacttctgaaaacacatggtagttaagggataagaagctagttaataacagagttgggattagaattcaggagttagcactctcagttcacaaaccaattatctttctgtgcagctaaaatttgttgccatcaagatctccctcattttcaccttttccaaatccttttctacacccagaatgcttagtttatacttcttagactttttccattctactgtattattttttgttgagactatattgtactttggattttattgtaaaaccttaaggcataaagactgtattttattaatcttagtgtcttttaccatgctttacacatggtaggcactcagtacatgttaattgaatttaatataaaataataatcactaatgctttttatcccattacaagtttagaaaactattcagtttctttggcttactgttatgttttcttgaaatacagctggagaagctttaaatgtcattcctggtgctcaggaaaagaaagcacatgccagtttaatgtctcccggtagacgcaaaaggtaaatgctttttaaaagagacaagttacccgtatccattaaaaaaaaaaaaaaagaattacatcaggatacttacattgtgaataaactaataggaccagattatgttctgatctatattagaactattccaaaatacattgtctttcttcacattttaacctgcctgaaattgggttgcatctctcaattaatggcatatcactgtttcatgggaaatatgtttattctgtaatggtatataaaataatggtatatcttacaaatgatgttatctgagattttttgcaatccatgttttttaactgaatgtaaataatacagttatgttctatgctccacacacatttaaagtcctaagatcaattgatggaatttttccaggcacaatctttgagaaaagtgtttttctcaaaacacttttgagaaaagtgtgtctttgtttgaaggatattttttgaaagagataatagttttaaaatgtttattctagtttcttagctcccaagccctgggtatttttgttagagtttttacttttggttgtctttcattcaagactgaccttagttagcctcctttattggagcctttctcacttcaccatataaaataacaaacagcaatatccatttttttatttttagagatagggccttgctgtcttgaccaggttagagtatagtggtacaatcataactcactgcagcctcgaacttgtgggctcagaagatcctcccaccttagcctccccagtagccagcagcacaggcacatgccgccacacccagctaatttttttattttttgtagagatgggggtctcactttgttgcccaggctggtctgaaactcctggcttcaagtgatcttcccaccttggcctccaaaattgctgggattacagatgtgagccaccatgcccagccataaaagagcaacattaatatttaacatttataggaaccctgactttttaaataaagtctttatatatactttatttcattccattctttagtaaacccaataatgcagttggtcattataaagtaggttagagagtcagagcttgctgtgcttcagaccataggtagtaagtggtaaagctagacttcaaactcatttttttgaattcaagactactaatactttttgtacttccctttgttcctaacacaaatagagaaaatatagttgaccttgaataacatgggtttcaactgcatgggttcatttatactcaagtttttttcaaccgaacacagattaaaaatttagtagtaaaacctgcctatatgcagtgtgctgactttttgaatacatgggcttcctagtgcagactgtaggacttgagtacatgtggattttgatatccttgggggtcctgaaaccagccccctgcagatacagggacaactgtatctgttctgttatggtgatcttaaaatttatgtctgtatatgtatttatctttaaatctgttaaatatagtggttaaaagaaaagcttttaaaatgtgtttcagtgaatctcagagaaaaagtaccactttgtctggccctcattcaacaatacggaatttccaagatccaaacgcttttgcagtagaaaaagtaagtgactctgccaaactttgcaacttaaaatattcctgagtttaaaaatacagatatatacacaaatgtatgtatgtgtgtatgtatcaaataaagaaacaggagtaagtttatagatatctgtaaatacattgttgttgttggatcatttaataaaatactggccaggtgctatggcaaacacctgtaatcccagcactttgggaagctgaggtgggcagattgcttgagctcaggaattcaagaccaacctgggcaacatggtaaaaccccctctctacaaaaaatacaaatattagctaggtgtggtagcacgtgcctgtagtcctagctgcttgggaggctgagatgggaggactgcttgagcctgggaggtcaaggctgcagtgagccatgatcataccactacactcaagcctgggtgacagagtcagaccctgtctcaaaaaaaaaaactggccggcgagtagtggcttgtacctgtaatcccagcactttgagaggccaaagccagcggatctcttgaggccaggaattcaagaccagcctggacaactgtctctactaaaaatacaaaaattagctgggtgtgatggcacacgcccgtaatcccagctactattcaggaggctaaggcacaagaattgcttgaactgcgaggtggaggttgcagtgaactgagattgtgccactgtactccaggctgggctatagagcgacactgtaaaaatagggcatttactggggtttgatgatgagtgtggaactgtataagaaagagttggtgaaagatctgtgaaaacatttgcaaattatgaagtgttgtattcaggtattaatatggagggagccatcacaacttctgagtttccatttaggtttattaaaactatccagctcttatcggtttgttcttttcttataaatattaaatagcagaatactctttattgtccttttgctaacagtggctttcttttccagcaaatggttattgaaaatgcacgagaaaaaatactaagcaacaaatctcttcaagaaaagctagcagaaaacataaataaatttttaactaggtaagctatatatgtttaaaatgcctaattgtttttgcctaattgcataactataataaagatttttctttctttattaacagtgataacaatattgcccaagtacctaagcaaacagataacaaccctacggagccagagacttcaattgatgaattcctaggacttccggtatgggtggttggggtgtgcatgggtgcgtgtgtgttacttatacttaagattgatggtaattttggtttcatttcaaaaccattgccaacataagatgttatgatttgccatctaattagataaaatgatttacaatagtaagataaaacttttcttcattcattgaatgcagtctgttcctgaaaaacacattggatgatgacttaaaatagaatctatattgcatccacagtcatggattcctaagtattcaatacttaaacatttattagtgggtatatttgtgtgtaataaacagtaatacagtgtttatataaattacatttcttctacactgctacaaattgtataataatttagagaaacaatgaaatgatacaataaagatatgtaatggggccaggcatggtggctcaatgcctgtaatcccagcactttggcaggccaaggagggcagatcacttaaggccaggaattcgagaccagcttggccaacatggtgaaatcccatctctaccaaaaatacaaaaattatatgggcatcatgacacatgcttgttatcccagcagctcgggtggctgaagcaggagaatccttgaatctgggagggcggaggttgcagtaagcggggatcgcaccactgctctccagcctgggtgacagagcaagaccctgtctcaaaaaaataagaaaaaatatgtaatgaatccaagtaatagttaacaaaataaaatgaacaagactttttttttttttgagatggagtctcactttgtcgcccaggctggagtgcagtggcacaatgtcaggtcactgcaagctctgcctcccaggttcatgccattcttctgcctcagcctcctgagtagctgggactacaggcgcccaccaccatgcccggctaatttttttgtatttttagtagagacggggtttcaccatgttagccaggatggtctccctctcctgacctcgttatctgcccgcctcggcttcccaaagtgctcgattacaggtgtgagccaccgtgcccggccaataaaatgagcaagacctttttaaaaagaaagattgctaaccaaatgacaacttgcctgtgaggcttaatactaagagaagaaagatggggacaatggtcactgttgctattggtagtaaatacaaaagagagtgagctagtaagggaggaatataacagtctatgttttaagatttgttcatgtgcaactatcctttaatttacttttttttttttgagacagggtctcactttgttgcccgggcttgagtgcagtggctcaatcacggctcacagcagccttgatctcccccagctcaagtgatactcccatctcagccttctgagtagctgggactacaggcacatgccaccatgctcagctaatttttggtttttgtttggttttgttttttgaggtggtgtctcgctgtgtcacccaggctggagtgcagtggcacgatcttggctcactgcaactcctgagttcaaacgattctcctgcctcagcttcccaagtagctgggattataggcatgcacctccacgcctggctaatttttgtatttttagtagagactaggtttcaccatgttggccaggatggtcttgaactcctggcctcaagtgatctgcctaactcggcctcccaaagtgctgggattacaggcatgagctatctcacctgacccaagtaccctttttgaagagcagctgcaattgtgattttaggacatctttttacttggaccattggacaatagaaatatttttattggcatgcccatgtgagtgtattagagcaggttttctttcaattgaattctgagtaaagccattgagcccttgaattgtttttctctatgtcagttctaccagtacttctttcaaaaacctctcttatcttaccacttaataaatatgggccaggcacagtggctcatacctttaatcccagcactttgagaggccaaggcaggaggactgcttgagcccagaggttcaagaccagcctggacaacataatgagacctcatctatacaaaaaaaattttttttttaattagccaggtgttattgcatgtacctgttgtcccaactactcgggaggctgaaatgggaggatcacttgagcctgggtgctcaaggctgctgtgagctctgatttcaccactatactccagcctggacaacagagcaagacactgtttcaaaaccaaaaaacaaatatgtatgctctgttctaagtttttgtgttctccaactttttgcttattgtttctttataaatacatcaggtgcttaccataatcagggtactctgttaaacactgtgaaggattgtaagaaagtaaagacacaacctactgttcttggttgttcataatactgtattcgtagaaagttaagaattaagatttagctgggtgtggtggctcacgcctgtaatcccagcagtttgggaggctgaggcaggtggatcacctgagttcaggggttggagaccagccttgcccacatggcgaaaccccatctctaccaaaaattaggtaggtgtggtggcatgcacctataatcccagctacacagaaggctgaggcaagagaatcgcttgaacccgggaggcggagtttgcagtgaggcgagatcgcgccactgcactccagcgtaggcgacagagtgagactccgtttcagaactaaaaagaaaagatttaaataacagtttttaagacagtatagggaattttgtaacacagaaatcccaaaaggctcgagaagtagcaccaggacgtctgaaagtccctctgaaagctgaggctacaaacaggataataaggtgtaaaattccaggggtcatgatgcttcagcctacccagggtgtgcagggagagagctctcactcttctttgacacttagaagtcctgtgtcaatagtaccaattctatgagtggggctgtcacatatgcagactcctttctgacccccataccaaggaagatgccaaggtgacaaggggaaaaagcacactggcctggtagtgctgccctttaagaatctggctcagcctcagcctggtgaccctaaacagcaatggcagggtctgggtcagcaagacacagctctctctatgcaatgctggaatgagtgtctccagtctcttattgctgatgggaaccttgtaaaaggacctgcatatcctggacaaactgagacacaggtggcagcacaggccccaccccttgaaaagccatcacactacttgactgaccatgacagcactatggataaacttcaagctttttaggttaacttctgtctgccacagattctcaggaaaagataccgtctttctaagcagatgacagtccatgacctgaataacctcttagtgaagattttcagattttgcttcacatgctgggaagctcaccaaggctttagatttaggaggaggattttttttttttttattatgacctcgatgcaggcctcctttccttggatgcaaaattagtgtgatataaaggaaaatgaacaacaagcacattgtggtactggtgaaagaagtgcctaccattttgaagcccaaaggggagtgcttattttttaatttttaattgtaaaaataaaatatataatttacgatcttgacaattactaagtgtacagtttggtaatgttaattatattcacattgttgtgcaatagatagctgtaagtttttttatttttatttttttttgagacagagtctcgctctgtcaccctggctggaatgcagtggtgtgatctcagcttgctgcaatctctgcctcccaggttcaagcgattctcctgcttcagcctcccaagtggctgggacaacaggcatgtgccaccacgcctcactgattttttgtgttttcagtagagacagggttttgccatgtcggccaggctggtctcgaactcctgacctcgggtgatctgcccgcctcggcctcccaaagtgctgggattacaggtgtgagccaccacacccagccagttataggctcatttaatcatagttacttctttaaaggtcttatctgcaaatacagtcctgttgaggttgggacttcaacacgtgaatttgggagggacacaatttgatctgtaaagctcttatttacaactcctgatttccccttttcctatcccctgccaaccaccattctactttctgttttgatgagtttgattgctttacatacctcacataagtagaatcatacagcatttactttatgtaactggcttatttcacttggtataatatcctcaaggttctacatggcctgtgatgggatttcctttgttaaaggctgaataatattccatttaatgtatatgccacattttgtttatccattcatgtatcaatggacatttaggttgcttctcttggctatcatgaataatgctgcaatgaacatgggtgtacaaatacgtctttgagatcctacttttaattctattggcatatacccagaagtgggattgctggacctggtaattctatttttcattgtttgaggaagctttctaatgtttctcatagcagctgtaccattttacattcccaccaacagtgtacaagaattctcacttatctacatcctcatcaacacgtgtcattttttgttgctttgatagtggccatcctcatgggtgtcaggtgatatctcactgtgcttttgatttgcaattctctaatgattagtgatgttaagcatcgtttcacatgtatgccttttttggataaatgtctgtttaagttatttgttcattgttcaatcaggttttttgttgttgagttataggaattcttatatattatgtgacttacattattttttgagacagggtctcgctgcatgcccaggctggagtgatgtggtgcaatcttggctcactgcagcctgaacctctttgagctcaggtgaccctcccacctcagcttcccaagtagcagggactacaggtgtgtgtcaccatgcctggctaatttttgtatttttcacagagacagggttttgtcatgttggccaggctgatctagaactcctgggctcaagtgatctccccacttcagcctctcaaagtgctaggactataggtgtgagcctcggtgcccagttggaattctttatatattcttgatattaaccccttatcagatagaatttgcaaacattttctcccatcccatagcttgcctttcactttgtgttctttgatccgcataggttttaacattggatgtagtcctatttgtctatttttgcttttgttgcttgagcttttagtgtcaatccaagaaatcatgggctgtttaacctcatgaagcttttcccttatgatttctttttattttattttatttatttatttctatttatagaggtgaggtctccctatgttgcccaggctggtcttgaactcctggactcaagccatcctcctgccttggcctcccaaaatgttgggattattggtgtgaaccaccatgcctggcctcccttatgatttcttttttccccttttcaaacgaggataagccacccttccttatgattttatacttttaggtctaactcataataaatggaagatttaaatgtaaggcttcaaagtataatatgagtccgggcgtggtggctcacgcctgtaatcccagcactttgggaggctgaagcgggagggtcacttgaggtcaggggttcgagactagccagtttgagaccaaaattagctgggtgtggtgtcacatgtctttaatcccagctacttgggaggctgaggcaggagattcacatgaacctgggaagtggaggttgtggtgagatgagattgcgccattgcactctagcctgggcaacgagaacactccatcaaaaaaaaagtataatatgaaatttataagatgaaaattagctcaaaatgaatggaatatttaaatgtaaattttcatatatggtgtaaggtaaggatccaacttcattatttcgcatgtaagtattcaattttcccaactctatatcttgaagacactgtcctttctgcattgtatgatcttggtcctcttgttgaagaccattcgactacattttcctgagtttatttctgatctctgtattctgttttattggtctacatgtttgcctttatgccagtaccataccgtgttggttactatcaatttataattagttttgaaatcagaaactgtgagatctccaaatttgttcttctgtttcaagattgttttggctattttgcttttctctgagattccataggaattttgtttttgtttttttgagatagtctcactcaactcacagttgcccaggctggagtgcactggcaccatcttggttcattgcaaccttagcctcccaggtttaagtgattcccctgccttagcctcccaagtagctgggattacaggcatgcgccaccacacccagctaatttttgtatttttagtagaggtggggtttcaccatgttggccaggcgggtctcgaactcctgacctcaagtgatccacctgccttggcctcccaaagtgctgggattacagatgtgagccactgcactgggcccagattccataggaattttaaggtagtttttcctgtttctataaaatgctattgaaattttgatagggattgcatttaatctataggttttaaatagtatgggaatcttagcaatattaaatcttgaaattcatgaacacacacacacacacaaaaataataataaggtgcaaaattaaggaaggagttaaactgtatctactccctatttctcatactcccccagaaacactgttgtcagtcatgagccctcccagcaagaaatctaactcaaaagaactaaaaatacaaatggttctacaacataattccatagcttagcttgtagttgacaagctcacctccaccattggtacagggcttttgaggtaggttttggcatgttacttttaaagctgaatagataaggattggcagcatttaaggaaagcattttacatgaagaacccagagcagacagataaaagggataaaatagatttatattgaaggacctataaagcagtctacaatagagtaatgtaaagaaagtagattatagaactttatagtatgggccaggcacagtaactcatgcctgtagtcccagcagtttaggaggccgaggtgggcggatcgcatgagcccaggagttcaagaccagcctgggcaacatggcaaaaccccatctctactaaaaatataaaaactagctggatgtggtggcacacatgtgtagtttcagctactcagaaggctgaggtgagaggatcacctgagctcgggaggtcaaggctgcagtgaactgtgattgcgccactgcattccactccagcttgggtgacagagtgacaccctgtctcaaaacaaaaaaaaagggaactttatagtatgattttatttccatttatatacgtatattcattttatatcattttaatgtttaggaatatattcaccaaagttcttacctctaagaagtaggattaggaaacacctatctagttttgttttaatttgttttaaatgagcatgtcattggaaattttcttggagtgggggaatgctactacataaaaagtcagaaatagtcgagtgtctgctaattattttgctggtattaaatcatattattcacgctgagtacagtggcccacatctataatcccagtgctctgggaggctgaggcaagaagatcacttgagcccaagagttctggactaccctgggcaaggtagcaaccccatctctatcaaaaataataataataataaaataagctgggcatagtggtgcacttgtagtcccagctactcaagaggctgaggcaggagcatcagttgagcccaggaatttcaggttatagtgagctacagtgactctaccactgtaccactacactccagcctgagcaaaagagtgagaccctgtcttatatatatataatatgtaaatatatataaattcagttagaatcatgccttcacgccactcctttcttgcagagtgaaattcacatgtctgaagaagctatacaggacatattggaacagacagaatcagacccagcatttcaggcactctttgatctctttgactatggtaaggagactatttatttcaagacagaaaaaaaaggcttctacaatttctttggtaacttaaccagagtgaatcaacattccccagagtatctaaaaaagttcttgttttcatttcatcaaacattatatggatatgttaaaggagtgtttgttgttttgtttttagctgagaaactttagctgttaaagtggagagtagttttgttttttatttttgtggcatttttgccagtcatcagggaatgtgttgatgtctaccactatacaaatgtgttaaacacaattgaatcgtacaaagggaatacaaaaaattggccattgtcctcaatcttatgatttagtgcagtagttctcaaagtatagtcccccaaaccaacaatctcagcattatctgagaactcgttagaaaatgcaaattactgggctaaagtttaagaaacacctgtctagtgggaaaatctttgtacttgtaaatgatattaaaagcaacattttttaaacatccataaaaccctaaatcgaagtttaacatttgcgtaatcaccaacaagctgtattcattgatgtttattttttgttttggtcatttaattatttccatattccctttttaacaggcaaaacaaagaataataaaaatatatcacaaagtatttccagtcaacctatggaatccaatcccagtatagtcttagcagatgaaactaatctagcagttaaaggttcttttgaaacagaagaatctggtaagaatttaattttgttaatatcatcaatccaaatcttaatattagtctcaaaattcaaaggcagaaaatattaatttggaagtagaagttgttcagattgttataggtcatttttgtatttttctctctgttaaaaacaattataaatctttggtagtttgattaaaagaaaatttacagtattcattcttttactataagctttttttgttggtgtgtgtttgttttttgagacaaggtctccctcttgtcatccaggctggagtgcagtggcacaatcatagctcactgcatgcagcctcaaacgatgctcccagcactttgggaagcagaggtagcattacaggtgtgagccaccacactcaacctcattcctttataattcaattcttgacatgtacaatttagtattaatgttgttcagttgctcaaaagtctgtaacatttatttttattaaggcacatgttttttgtgcacctgtttttaaatgttatcacctgctcccaccagtaaaaaatctgatggcttccagtgttcattcacatcctgtccttggagaatctcagactgtgtgcctcctttaattcctctgccaacaatcaagtccaattctccatttcttcttaggctgaattatagtgggttgtgttttttgcagtatatattatgtctagaagattgtgtttcacttaagttcttccctgtacaaagtgaaacttgaaattccgttttctgagaaagtcttcctacttcactgaggaactacttatcctgaatttatgtggcctctatacaatttctactgttttccccacaataaggattcagatgtgctctgtactcagcagcaagtgtcacatttaacagaattagagtagtccccccttatctatgggggatatattccaagccccccagtgggtgcctgaaattgggtggtaccaaagcctatatagtatttactgttttttccttttcaggcatacctatggtaaagtttaatttaaagttaggcacagtaagaaattaacaatagctaataataaaatgggacagttataacaatatactgtaataaaagttatgtgaatgtagtcttcctcaaaatatcttattgtactgtactcacctatttttaggctggttgactgtaggtaactgaaaccacagaaagcaaaactacagataatgggagactgctgtatatgctagttgacataaatgttctggtttttaaaaaatatttttcatactgattcaagttaatgttttctgtcctaaattgtgaatgctgtattgttgttttctgaaacactttttccaggccaggcacagtggcttatgcctgtaatcccagcaatttgggaggccagggagggcagattacttgaggtcaggagttcaggaccagcctagccaacacggtgaaaccgcgcctctactaaaaatacaaaagctagccaggtgtggtggctggcgcgcacctgtgatcccagatactcaagaggctgaggcaggagaatcacatgaacccgggaggcagaggctgcagtgagctgagaatcgcaccgctgcactccagcctgggcgacagagcaagactctgtctcaaaaaaaaaaaaaaaaggaaatactctttccttactcatatcatactctttttttttttttttttttaagatcttctcatacagtgcctcctttataattttttctcatggtaccttttgttcctatgctgttacagtttttaccatgctttcttatgactttctgttctatagttggttccttgactaacctctccaagattagagattggatcattcatctttgtatcccagtaaccaagtatggttggtcttcagtaaatatgtgtttaatgttaaacagtacacaatgagatcaagtgtcaatcatgcaaaatgtacttggccccatctcacctttaagaatatgtcagataagttgggtgtggtggctcatgcctgtgatcccagcactttgggaggccgagacagtagataaattaaagtcagaagaaatgttagaagttgaaaagttagtgtttcaaaataaacttcatttttggagccagtatgttttttacctattgaaatattaaacctctttactttttccttctttgtatcatctgtcttccaagcttggaaaacaaattgacacttgtgtaaaaagtcatcagtaactagaaagtacctgtaaattttttgatactcagtaaatgggaaacacagcgtatcagacttccacttactggtatgcaaagatgagttattttcttggcaaaataagttttatggcaaaaatgactacctcagaagctgaacatatttaccatatctgtctacctgcctgatactttgcagatggtcagtctggtcagcccgctttttgtacatcctatcagaatgatgacccattaaatgctttgaagaatagcaacaaccatgatgtgcttagacaagaagaccaggaaaatttttcccaaataagtaccagcatacagaaaaaggcctttaaaacagctgtacccactgaacagaagtgtgacattgacattacctttgagtccgtgcctaatttgaatgactttaaccaaagagggaattctaatgctgaatgtaatccacattgtgctgaattatacaccaatcagatgtccactgaaactgaaatggctatagggattgaaaagaactctttgtcttcaaatgtaccgagtgaatctcagttacagcctgatcagcctgatataccaataacttcatttgtttcacttggttgtgaagctaacaatgaaaacttaattctctctgggaagagttctcaacttttatcccaagatacttcattaactggaaagccatctaaaaaaagtcaattttgtgaaaattctaatgatacagtaaaacttaaaattaattttcatggttccaagtcatcagattctagtgaagttcacaagagtaaaatagaaattaatgtgttagaaccagttatgtcacagctatcaaattgccaagataattcttgtcttcaaagtgaaatactacctgtgtctgttgaaagttcacatttaaatgtatctggacaagtagaaattcatcttggagattcgctgtcttctactaaacaaccatctaatgattcagcatctgttgagttaaatcatacagaaaatgaagctcaggcatccaagtctgagaattcacaggagccttcatcttctgtaaaagaagagaatactatttttctctctttaggtggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggtaactttaataacataattgaaatttgtttctctgggttgggatctaatttcttttgtatgtgatgttattgactgcgaagtaataactaatgagtagatggtatgagaaaagattctgaaatttgtgattacgctgcttctttatgctagctaattcaaaccttttttatttttcttaatctgctagtaagctatgggctttagtggtttttcttttttcttttcacaaatacttctcaatctatgtgctagtaagttacaataaacagaaaagacagactaattcatcacatagttgtataaaacccaatgttgtgggggagtttttaaaaatagctcttatagtcatggtcttcagggaattcatcatctttttggagaaattttcaagaaaaacttgaatttcagccggttatggtggctcacgcctgtaatcccagcactttgggaggccgaggtgggccgatcgatcacctgaggtcaggagtttgagaccagcctcgagaacatggtgaaacctcatttctactaaaaatacaaaaaaatgagccaggcatggtggcaggtgcctgtaattacagctacttgggaggctgaggcaggagaatctcgtgaacccaggagacagaggtttcagtgagccaagatcatgccattgcacttcagcctgggcaacaagagcgagactctgtctcaaaaaaaaaaaaaaacttgaatttcttcctttataaaatcctttctaattgatctctgtctttaaaatcctttgtttatggctgggctcagtggctcatgactgtaatcccagcactttgggaggccgaggcgggcagatcacccgaggtcaggagttcaagaccagcctggccaacatggtgaaaccccgtatctactaaaaatacaaaaattggcatggtggtgggcacctgtaatcccagctgcttgggaggctgagacagaagaatctaaagctgggaggcagaggttgcagtgagccaagatcgcaccactgcacttcagcctgggtgacagagtaagactctgtctccaaaaaaaaaaaaaaaaaaaaaaatccttttttcataggggctcttgtggcatttattgcgtgctgtgttatatgtagttagtgattgatatgcctatcatattgataattttttattgtatgttcctcagagatagtgctcatggcacatttatttacatttccttatgtgttggttcccaagcttccctcttttccctttttgttacattatagacatacaataaaatttcattaaatatcaacaattagtattaaacctaatgggtctgttttacgtgctgttacaaattacataaaggagaggtcagaattaatagagaatgtggggcttgagctaaagcttaaagaatgaaggtaggatttggagttaaagcaaggaagtttttataacttataaaatctgtaagttataaagagaagcagcaccagcatagacagagagaccgtagtaggttgcatgaaaatgaggggatcaacctgacagtagtgtattaggcaaaagtttgtttatggacaggactaaattacagtagccacaaactatgttgttgacttctgaggaccatgtagacattgtaattttccctccatagttttgaccagttacgtgcttaccttacccccttttgatcaataccattgagatatgtaataggttggggttacaagtgtagtcctgggtataaatattcagttggggttgtaattttctggtgtaaggttcagacttgaaacattcaccactcattttctaactagtttcattatttctagaggaatccagatatgattgtaatatgatgtcttggctgtagagtcttatgcttgatcagcatggttcactgactgaataacattaagaccaccttaatatttggattgactttttcttaatttgttagccttgctgtttttcctaaaactgtttcagtttcgttttttttgttttgttttgttttgtttttggagagtggatcgtaaggaagagggattgttcatagaatttatttcaaagcagtaattaatttgtgccaaacatttgtttgttttgtgccaaaacatttcagagaaaatctttttttaacaagaattgtttttttaggatctgccataataattgcctctccagtccagcctgtactccaaggaatggtagggatgatcccagtatctgtggttggacagaatggaaataacttttctactcctcctcggcaggtaagatttatgaactgaaaatggtgtggtgatgcttttcaagcttagtgtaattaatggctttttctcttccaggttcttcatatgcctttgacagcacctgtatgcaatagaagtatccctcaattccccgtccctccaaaatctcagaaggctcagggactaagaaacaagccttgtataggtaccatttttaatttcattaatgttaactttatgtttgtatgttcatttgtttgcagcaacacctaaatgttttctttctgaatacctaaaccattttaaaacaagtgatcaccctacatttgctagtaacagatgtcataatgcagccaactgttactgaacagctttggttctgagaaaattgtctcctttgttgaatctgttagcttttgcccagtagtccttggtttgttctttgcagcttccctaaattaagtatagtccctatttttcccaacagctttcaagtgtttaatgaatgcctcgtataattgtatgagactttagagcagttcttcttgtagtttagtgtgtatatgaactatttggggattttgttaaatgcaggtactgaattgataggtctggtacagcacctgaaattcctcatttctaacagcttctaagcaatgccagtgctgctggtactggaccacacttgaagcaaggctttaaagtttgcaaattaccttcctgtgttccctgttttagccattgtcccaaccatctgtttacttgtgaaaaacctggtagtcactcttaaaacacattttcctctccttcttagttcaagtatttgtcatttttcatctaagttgtatcaatagtgtcatgtagtctcccttcttttagtctctgttgtttcagttcacctcatatctgctggctgagtgactttttttccctaaaatacaaatctgaatatgttgctttcctgcctaaaaactttcagcaactcccctttgcccaaaggataaaattgaaatttctcagggtgacatatgtgcatacatttgtcatctagtcactctcgacctctccatctcatctcttaccacttcccagcatggaccctttgtacaaactatagttgctgctcaccttatacttggtgatctttcttgtccctgtaccttttaccaatgctatctcttctacctagaattcccccttcttacccaactcttaccctcaatctggttcttatttatccttcgaaattaacttaaatgttcctaggaagcatttttaaccagcggtggctgaggtggatattccggttttatttttttctttaattcttagtgatacctatgctacagcacttaacacattacattgtatttcttctcagtagtctgagtatcttaaatgcactcattatacagagaactcaactaactgctatcaaatcagcctttccttaaactaaacagtatacatctattgatgtaggcttaagttgcattttgacttattgaggcaccctcttagacttatgtcctgttatagctactctatattatttttatgttctttcttataactagttcattccttttaatggccatttgatatctatcacttgcataaatgtattttatatatgtcctatcagtggacttttcagatgttttcgatgtgacatgcaatgatatgaggaacatctttgtaaatgcctctgtgtgaacccatatgagagtttctttgggggcttattcccagaaatctttgggtatactgggtataatagagaagaagtatatcttctctatgacccagaatttctgagtcatagagaagaaaatttatacttctaccattattttccctgcttccctcacaacactaccaatatttgataccatgtgatattttaacttttgccactatgatggatttaaagtggtagtatctcatatcattcttttactttattctgattactaataaagtttggaatcttctcttataactataaataatattttcccttctgtgaattgcttattcatatccttttcctacttctctattaaatttcctgtctgttgaggtgttatacttttattagtaacatatcacagatgtcttcacagtctgacacttgtttttatcccttacaaagttgataccagaaaaaaacattggtgaggttaagcatccatttatgataaaagctcttaaaggctatctatagtaaacatcatgggttccctttaaagctgtgaataacacaaagatactcattcccaccctgtatgtaataagccagtgtttccaacaccagtaaattaattattaagtaatcagttttttgccccactgacatctgattatacttccaccataaacaaggtcccatacatccatacatatgtggttccagacaatacagtaagaaaatggagctgggcatggtggctcatccccataatcccagcaccttgggaggctgaggcaggaggattgtttgagtctaggagtttgagaccagcctgggcaatatagtgagaccacatctctagaaaataaattttttaaaagtagccagctgtggtggcagatagtagtcccaactattcgggagggtgaggcagaaggattgcttaagtccaggaggttgaggctgtaagtaagccatgatcatgccactgcattccagtctgggcaacagtgagaccctgtctcagaaaagaaaagagataggtgtaaagatttgaagagagggaattaaactgttatggaaaatgatgtgatttttacacaataaagccacagggagttaatagaaaaattaatagaactaataattcagtaaagttgccaggtatggttaattaaaattgtgttttaggtgccaacaataaacacctattaagtgttatacaaaataagatactgtttataatgaccacaaaaatgataaagtataaaggaagtaacctaaccaaaaatgttagaaatggagaatatttgaaatctttcataaaggatgtataaatagaagagaaccatgttcatagatttgaaaatttaacagtgtaaagattgcaattattccaagttgaatcaaaaattcaatgtaattttccttaaaaatcccagtagaatattttgggagatgggaaaaactataaaatctatgagaaagaataaaagtccatgactagccaagatagaagagcagaggacagactcattctaccaaatggtaaaatattgcagagccacagtaattaaaacaaaaagacaaatggaacaagatagtttagaaagagaccttgtacatggtaatgttaacatcagaagtcagagcaagatggatggtataatatatgaaatgtattgatcattaaatatacaatatatagagaagaaagtagatcccttcctcatacaaagatgaagtccaagatgattaaagacctaaaagtaaaaagtcaaacaattaaatgatagaagaatgtataagagaatatttttatgacattaggataaaggatttatttatttttttatttttttttagatgggagtcttgctctgtcactcagactggaatgcagtggcatgatctcagctcactgctaccttcgcctcccgggttcaagcgattcttctgtctcagcctcccttgtagctgggattacaggtgcatgccacaacactcagctaatttttgtatttttagtagagacagggtttcactatcttggccaagctggtcttgaactcctgacctcttaatccccccacctcggcctcccaaagtgctgggattacaggcgtgagccaccacgcctggcctgggatttctttttttaaaatgagaagactttgggcacaatggctccactcctataattccagcactttgggaggccaagacaggtggatcacttgagcccaggagtttgagatcagcctatgcaacataatgagactctgtctttacagaatttttttttaaaaaattagccaggtatgggctgggcgtggtggctcacgcctgtaatcccagcactttgggaggccgaggcaggcggatcacaaggtcaggagatcgggaccatcctggctgatacggtgaaaccccgtctctactaaaaatacaaaaaattagccaggcgtggtggtgggtgcctgtagtcccagctattcgggagactaaagcaggaggagagtggtgtgaacctgggaggcggagcttgcagtgagacaagatcgtgccactgcactccagcctgggcgacagagtgagactccgtctcaaaaaaaaaaaaaaatattagccaggtgtggtggtgtgcacctgtagtctcagctacttgagatgctgaggtgggaggatcacttgagcccaggaggttgagagtgcagtgggctgtcctcatgccactacactccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgcatcaccatgcccagctattttttgtatttttagtagagacggggttctccgtgttggccaggctggtctcgaactcctgacctcaggtgatctgcctgcctcggcctcccaaagtgctgggattacaggcatgagccactgcgcccggcctagatcctttccactactaagacttatttttacttcagccaacctctcctatagccacaccttgaatttttcacctttttattagacttacaagatttttaaaggccagtgatgtgtctcaaaacacacttgtttccatatacccattgaattcctcttcaaccagtgatagcttttcttacttgaatcctcaccttttacctgaacttgtgtcttctttccggattcacttcctttactaaacagcctagagcccacaagccaccacatcagccactttggccagttttcttaataacctacatatccacattcttctacatagccactagctactctatagcccttgatctgtccagccagccatctcaacttttacacctgggcttcttagcattgccttagaagtgctaccattccctaccacttaaaaaaaatgtatttctcacccaccttccacttggcaatcattttaaatatctgcgtgtctgctttctcttctgttcctccttcaaactattccagtcttgcacaacacgtctcaaatctagtcctgctcctcctcactcttagctagtggttttattttccatcttaccagtattaaacttcactttctgatcatcactttcattcagtacataacctattctgcttccaaaatcatccttctttcttaaagaaataactgtccttcattctttctaaggttaatgcagtctacatgtgctccagtttcttatcttctatatatgtttcaacttttcctgtttggcttctctccctggctataaacataggtttgtcccacctgctgactttttatgttaatctcttaacctctcttaatcttccatttcttcattcaaattactgtcttttctcatgcatctactgaaactgtctacactagagtcaccagtggcctcctaatattgcattatgcattgaaacttttccattcttaccttactttgctttctctataactgttgatactatggtggcttctggagccataactaaactattctccacccttgctaattttgtgtaactcaaggccttcaaactacatatttctcacctctcttcctcaaagacttcttctgcctagtgtttttccccttggttaatgtcacaatttatttttttcctttacttttggaaatgtacatgcccattattgtctctcagaccctcatcatctcttacctggaatatagccatctacatagagtttctacttccagttttctgtcttctcagttccatcttccacattattgccagatcttccaaagacataaacctattcatgcatcttccctacttaacacccttaaaggggccgggcatggtggctcactcctgtaatcccagcactttgggaagccgaggagggtagatcacctgaggtcaagagttttgagactggcctggccgacgtagtgaaaccccttctctactaaaaatacaaaaattagccaggcgtggcagcgtgcacctgtaatcccagctactcgggaggctgaggcactagaattgcttgaacccaggaggtggaggttgcagtgagccaagatcatgccattgcactccagcctgggcaatagagcgagactccgtctcaaaaataaataaataaataaataaataaataaataaatctcttaaaggattgcctctgaaaccttttgcataatatgtaagtttcttcataatctcatctttgctcttctttctagttttgatatcttgctgctctcccacataaatgctgaagctcgtggaaattaaaatatggctattagaactccagagcatgtgctctgagtgacataggcttgtaaacatgataggtaccgggacagaattttaaaatagatataatctgttgttttctttaagtgactacctggatgtaagtagtacattatgtgctatattgagcattgtaatttgtagatccaaagactggatttataatatttgcctgaaccgggcgcggtggttcacgcctataatccagccttttgggaggcccaggtgggcagatcacttgaggccaggagtttgaaactagcctggccaacatggcgaaaccccatctctactaaaaatacaaaaaattagctgagcatggttgggggcgcctgtaatcccagctactcgggaggctgaggcaggagaattgcttgaacctaggaggcagaggttgcagtgagccgagatcatgccactgcgctccagcctgggtgatagagcatgactctgtctcagaaaaacagacaaacataatatttgcctgaagttgatgcatgtcatttattccatatctggatttcctctgtagcagtggggaaatagccatcttgtacttatttcaaagctgctttttaaaagctgctttgtcaacgtgttctatttgtgtgtacattagctaccatttaaaattttttctcatgatatgtgataattgtcatctgttctatcctctttcagaggagtatattctttttctcaggaatgttcatttataatttcaggaaaacaagtaaataatttggtggattcgtcaggtcattcagttggatgtcatgcacaaaagtgagtataaagtagtttctatcatagattgtttgaatgctcagatttaaaacataaaggatttctttatgctgctagaaatagttttgttttgttttgttttagaactgaagtttctgacaaaagtattgccacagatcttgggaaaaaatcagaagaaaccacagttcccttcccagaagagagtatagttccagctgctaaaccatgccacagacgtgtactctgtttcgacagcactactgctcctgtggcaaatacgcaggggccaaaccataagatggtgtcccaaaacaaagaaaggaatgcagtctcttttcctaatcttgactcacccaatgtgtcctccaccttaaaacccccttctaataatgctatcaaaagagagaaagagaagcctcctctgcctaagattttatctaaatcggaaagtgccattagccggcataccaccataagagaaactcaatcagaaaagaaagtttcaccaacagaaattgtgcttgaatctttccataaagcaacagctaataaggagaatgaattatgcagcgatgtagaaagacagaaaaatccagaaaattcaaaactatctattgggcagcaaaatgggggtttgcgaagtgagaaatctatagcttcactgcaagaaatgaccaaaaaacaaggcacatcttcaaacaataaaaatgtactttcagtaggtacagctgtgaaggatctaaaacaagaacaaactaaatccgccagttctttgattaccacagaaatgttacaggatatacagaggcacagctcagtaagtaggcttgctgatagtagtgatttacctgtgccccggacacctggctcaggggcaggggaaaaacataaagaagaacctatagatattatcaaggccccctctagtaggcgtttcagtgaagacagtagtacatcaaaagtaatggtccctcctgtcaccccagacttgcctgcctgcagccctgccagtgaaacaggaagtgaaaacagtgtaaatatggctgcccacacattaatgattctctccagggcagccatttctaggactacttcagcaactcctctgaaagataacacacaacagtttagagcatcttcaaggagcaccacaaaaaagcggaaaattgaggaattagatgaacgtgagcgaaactctcgtccttctagtaaaaatcttacaaattcatcaataccaatgaaaaagaagaaaattaaggcaagtttgaaagttttaatttcaaaaccacaccttttttttccgctttagtgattagcgaattcagcagttcttgccacaacaacttgactgaacgttatggctaagacagcttttagttttcattgacaaaatacataaccatgatcacaggaccaataagcagtagatgcaggattcaaactcagacttgtagggcaacaaagcagtccagcagtgttagtgtagtacgcacaaggtgtctaggtgaaacagcattttcaggaaaaactgctgaggcatttgtttataaacatctttccgggggaaaagaaaaagtttttctttctttcttggtagaactcaagttttttcatgagcgtgacatagtcatgaaagattgggaaacaatattaaacactattgtgtagaactaccaagtaataaatgactttgttcttagatcttcagttttttttttcccccacgtcttgtaatctcttccataggcccttaaaaatgttagcatattagagcagtggaaaaatcaaatttacgtatgtttttccatttttttgagagagggtttcactctcgttgcccaggctggagtgcaatggtacgatcttggctcactgcagcctccgccttccaggctgaagtgattctcctacctcagcttcccaagtagctgggactacaggcatgcgccactgcatctggctaatattttttccttttttttttttttttgagacagagtcttgcgctgttacccactagagtacggtggcgtgatcttgcctcactgcaacttccgcctcctgagttcaagcaattccctgcctcagccccctgagtagctgggattacaggtgtctgccaccacacccagctaatttttgtatgtttagtagagatggggtttcaccgtgttggccaggctagtcttgaactcctgaccttgtgatccacccacctcggactcccagaatgctgggattacaggcatgagccaccacgcctggtcattttttctggttttttttttttatagagacagtcttttgccatgttgcccaggctggtcttgaagtcctgagctcaagtgatctgcgcaccttggcctcccaaagtgctgggattacaagcatgagccactgcgcctggccttatgttttttatttaagcatggttgtctctaggaaggcagtgcagggatagcattgataaatgaaatccatttattttcgatttggttagctgtttagtaagtggattgaatagaaagaaagtgcttaaaatatcatagaggaagtatggtatcagggaaataatttaggctttgttgccctacaagtctgggtttgaatcctgcatctactgcttattggtcctgtgatcatggttaagtctgtagcctttctgagtctcagcctcatcacttgacatgatattaccaggtatcttaggttgtgaagtctaaatgtagtatacataaagtatctagtgtatattaagttttggaactgataagtacctgtaaccctaaacatctgttagtaaagctttctaagcagtaataaccacctaacatagaaagcatgttctatcttgtctcattcaacattcagacactctggatttgtatcatgtcttttgccataaactaacattcaggtgccattgaagtatatttaagtaactttgggtttataaaacttgtctctacttctctatagaagtaaaattctaatagactaaaaaagtttgacaattttagtagtatgtgaaagaacccaatatactgttttaggtgacttactaagaaagcattttggccttgttttgagtttattttttctttctctttttcaacagaaaaagaagcttcccagttcatttccagcaggaatggatgtagacaaatttttgttatcattgcattatgatgagtaaacattctggacacataagaacagtaggtgttaaaaactcatatcccttaaactgagtgtagggaatgggatattgacagaatctgaaagcatgacctgcactttcattgtactgaaacttcactttatatctaaatcatgctgtttctgaaacagcttcctagtttgtaaatagacttacttggtatatttttattttgggaaaaacgtttgcagaaatgtaagtaaagccaatctgcaaaactgtatagctttgacaattccatattgtaaatactgtgtaaatcttgttgaaatagaggttaaatcaacctaatgttcttacactgtgttttttgacttcttatgatccctaattctgagacttactcatctggaatagtttctcacttgttttggaggaaaatgatgcttattcttataaattaccttcagtaactattcaataagacatttaaatacacaatcactaagtactacaaaataataaccacctcaactgatagcaaaatatctaattagaaatcaacagtttgatgagtttttttcctagagtgaatactacccctttcttataattgctgtaagtattatatttctggaatttcacactttacctactctgatcactctgttctctttgttttaaagagagaattttgtaaaccatttattgaatgttctgatctttcatttataacttaagattttttacagaactttaagtggttagactattgagccataaaattttggtttgtagtagagatttctcggtatgtacttttcccctaaatgctggggatttaaagaattgcactaattcatagaactctttacattgtagtgaccaatgcacatataatttaaatcttgtgttctatgtgagagtttatgtggaggattatcttctggtgttgtgtccatcataagatgtaaaaagagaaatcatagttttatattttagtttctcctacaatgggtatgttaaataactatatctatacttagatatagtgcattgtctgtgtcccttaaagtgttacaaagagtttctctcaaaaggtccttaaggagagtgagagatgagagaggtgccttctctgtattagactcacacacatcagtccagttgaagaattggtttaaacttttaaatgagaacagaaattataattagtacctgaccaattgtgcctagatattaaagtatgttctctttagtactttccgttcaattaaatatcagtatattagggatttttttctacaggtgtatattttgttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgtaagaaatttgtatggtgtggcagtggtctattcctaaggaactaaatatcatatagttaatgtttatttaactcagcttgagactgtactacagttaggtttgaataaatattttcattaacttcaaaagtttgaattactttacattggcagtcttgtttagaaactgattaaattcctttgcaagtcagttctttttgggagtttgtacaatgctgaaaatcacagttttcttcttattcaattcatagttgtatgtactaagcactgaaaattcatatacaaataaaataagtttactttcttcaagattcatagttaactaaccaggaactgctaagtaaagttgaaagataacttgtacttggagcttttatgttcaagagcaaaatcatatccccattttaccttaaaagtccacaggtcctgaacttaattatactattgtacctggtaacctatttgaatacttaaatgcccagtgactgcatttcagggttgatgtatactacaacaatccatggctgtttttataattacatatgaggatccagtctgttgtttggatattacttagaggttaatgcagtcagtgtatgccaaatctgagaagtgttgttaagtaaaatcttgttacagatttagccctggatatattagaactatagtgtgttgaaattgcgcataagaaaagcatccatcagcattcatgcaaaggctacatgtcatgactattaggagtaatttcaaaagcatattactatatattctgcattcatcctttctctggtcatcatcttttaggctcaggcccagctttctgaaattacataagttttgactttattattagttattttgctgcttcctttaagcaatggactcattgtgtacttttttctttttataaatgttatcattttgtcatacttttgtctttttttcgtaaatttgtatctacattgttgaacacatggtacatatagcttcctaatgctttttgttttgtttttttttttttttttgagagagggtctcactctgttgcaggctgaagtacagtggcacaatcatggctcactgcagcctcgatctcccaggctcaagtgatcctcctacctcagcctcccgagtagctgggaccacagacatatcccatcgcacccagttttttgggtttttttggtttttttgttttttgttttttgtttttgtctttcagagagatggggtctcactatgttgcccaggatgatatcaaactcttggactcaagcagtcctcctgcctcggcctcccaggtgttgggattacaggcatgtgagccacctcatccagctgctgcttttacttccaataatataaagctttttcctttttttagctattacaaacaaaaacagcagtgagcatttttataaacatttgtttatgttaactatttccttagaaattttagagagtagaattaccaaatcaagaagttagtgtacctttttttaaggatctcagtacattttgccatatgctgctattaaacttgcgtcaatttacatttctaccagcaaattgtcatttttttgcatagcatatgcttatccatttccagaggcatattcacctatatcatcacctgtttctaggtttgtgtttcctgatttggtaaaattaggagttagctcctaatccatttgttacttgttttggtacctgatatgaaaaaagggtcaatgtacattttttccctaaatatttaactgcttgacaatttgttcacttgacaatttaaccactgcacagtttgttcagataagctttcctttcccctgctcatttatttaagatgtctgtcttatcctacactgattaacaatctcttattcacaattctaaaacccaaaaggttccggcaaccaatttttttcccctagatttaacatcagaactcattctgtggcaaacctgacctgaaatgacacgaggctacttaacagtctttatctcatttatagtaatgttgattagtctgctgttccagactcaactggggggcatatggtgcatacatttgagttattttttagaaatccaaaatattctgatttatgaaccccagctaaccccaaaggt

SEQ ID NO: 16407 - DNA, 21893 bp, Human
  misc_feature (1)...(21893): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaatgtgggctgggcgcaggggctcacgcctgtcatcccagcactttgggaggccgaagagagcagatgacttgaggtcaggagttcaagaccagcctggccaacttggtgaaaccttgtctttactaaaaatacaaaaattagccgggcatggtggcacacgcctgtagtcgcagctactcaagaggctgaggcaggagaattgcttgaacccaggaggcagaggttgcagtgagctgagatcgcgccactgcactctagcctgggtgacagagagagactccatctcaacaacaacaacaacaaataattaaatgttcctaattgtaggtttgttatgttctgctatcctgtctttttctttttccaatgaacaatttatgaatattgacacatttttaatgatgtggaaattttcagaattgtaaatgtttatgtatttaaaactggttggaaaagtactgtctcaaaaatgttaataaagctagcagtctagctttattaatattcatttattcaatagctctgacctttcttatccttggtttacccagctctgaaatggttgcaaagattactaaaaatatatgtaagttactttcataaattagaaactaagaagtaaaaattactttcaaaaatctgccattggccaggtgcggtggctcaagcctgtaatcccagcactttcggaggtcgaggagtgctgatcatgaggtcaagacatcgagaccatcctggccaacatggagaaaccctgtctctactaaaatacaaaaaattggctgggagtcgtggcatgcacctgtagtcccagctactcaggaggttgaggcagggagaattgcttgaacccgggaggcggaggttgcagtgagctgagatggcaccactgcactccagcctggtggcagagtgagactgggtctcaaaaaaaaaaaaaaaaagtctgcaatcataattacttacagtttaatctggaatttagtactctattctattttcaaagctgctatagggtatgctgtcctttgtagttccacttttagcagaattgaacgtttttctaacgggtacagatctttatgcttgagactgtgtggaaaccttggacttgagctccactctcagttattttttgtatttgctaaaacttaaatacattctgtccacctctagcatgatacctggtatgtgataggaacccaataaaagtttggctttgatgggagtgtatgtttctacattatttttggagggtaattaggtagtatctttccaaattttaagtttgtatgtgtttcattccagacattctacttctaggaatttagatatagttgtatatatgtataaggatgttcacattgcagcattgtctgtaacaagatttgaaaagaacctgaaaacaactaaaggtccattaatattgaactggctaaatacgttatggtacttttaattatgttactcataagcaagtaaattgcctatagccattaaaaatagaatctatgtatgcataaattgactgggataatcagtgtttaaggtatactgtagaatatgtacagttactccttttgtataaaaatagaggatatacatatatgtgaaagtaaatatgtatacaaaatatgcaaaatgtgaatgtaagcgctggtaaatatctagaagaacacacaaggaaccggggcgtggggcggatcgggcagagggacttccctgtgcctcactgtttgaattctgaagggtgcatacacgcccttattgacctgtgctaccggcctctggctaaagagggcgctgtagccaccaaagtcctgtttacagatcaggagtctcagtaagccagcgtggctacgccatcacgaccggcggtggcacatgcgcaatagcgagacgctggagcgcggcgtaggtggctgccgagtcttttcctgtttagggtcttatcctggcattgagggcgccggactggcgcttttggccggcttggcattgggtgggcggcttcttgggacccacatgagccagtggcatcatccccgcagtggctggggccggagacgcgacttttcaggacgctcctcagccaagaagaagggcggaaaccacatccccgaaaggtagtatgtcttggtcccttggcgtggcctttccagctcgtggcttctgggtctgggcttcatcgtttgtggtctctgcctctcgccgttgccatcgcaagcttgacttgtccgccgcttgctttgaggctttgaccctctgcgccacccgctgtagctgaaaggggcgatgtctgtgatgtcctgtgatttctccatattcttgtaaaagggaggttctggccattgctcttaggtaaaatacggaaggattgctttaaggtgggactgttactgttggggacactccttaattcccaaaatggaacctcctcaattccttgttacgttggcacggaaagtgtaatggtttgagttaggaacccagcagtagtagcgccctgagatctcacatggaaagttggtttgtattgtttccagaaatcacaaagagcatactttgttacttcctaacaggcctcatttgaaagataactcctttatacgtacaaatgattaattttgagactttgcacgtaggtgcattgaactgtttttactccttgagaccatcctccaccatctcatacctcaataaatcctcttcattttatctactatcttttgactgtcactttctgtcagtaccctaatacaggtcttgcctgacttattgcagtggggttctaattagtgaatctcctgtttgttttcttccaatccgtttttttgtttttgtttttgggatggatttttgctcttctccgccaggctggagtgcaatggtccaatctcggctcactgcaacctccgcctcccggattcaagcgattctcctccctcagccgcccaagttgctgggattacaggcgcccgccaccacacccggctaattttttttgtatttttagtagagatggggtttcaccatgtgggtcaggctggtctcgaactcctgacctcaggtgatccacctgcctcagcctcccaaattgccgggattaacagacgtgagccaccgcgcccggccagttcctagcattattaagtgaagttcacagtccctcttctagcaggttttctcttaaaatatgaacttgaagtttcctactaattgaactttatggcatcagtcgtatgaaaactaaaagcgtgaagtgaaataattgaatttaaattatttcagtgaatatgtttgtattaatggcactttagtatctggtactgggccaagtttaacagggatacagaagttctgggtatctccggttttatataggccttatttgagttgtactgttgtgttggcttgtgttcgtttttatgatggggaaacaggagagaaggacggtataggtcgttacttggtggggtttaataagtggagtggcgaaatgcaaagcagagaggagagaggacatgttgtgcgggctatgattcccattttcaaaaagtcttattttgtgcaaggaaacaaggctaacatacaatttggctaacaaaaaatatatctaataggtggaaagactatctcccagttggacagcggatgcctgggactcgtttcattgctttcaaagttcctttgcaaaaggtaagcaaaagttaattcagtattctttcaggcatctgagttcaccatgcagaacactgctctccactctatcacattccattttctctttttatagcaaatactttgtaatgacccctttactatcctgaaatgaagttcataggtacatacaacctacttcatattttaaacaaaaataccaattaacaccctaactataatataaaaaataaaataaaagtaatttataataaaataatatttatttcaatatataaatgtttggacatgactacattaaaagacatagagtaatagttgcctgcgccatgaattcaagaattacaaatgtagactgatctaggtgggttgtattgctttagtggtaggagtttctgtaatagatttccaaatataacaaagtataatcttcatttggttgataaggtgattattatcctggaaaattcaatatatattagtattgtacaaaaaatactttgtgtttatttgtgaaatggagttaggttctgaggccaagctaaatatgaacagctttttatctatattaatcttgaataggacatccaaaagccattcaggatgtgggacacatttgtaggactgtcctgaatttggcaagttgtttagaatttgtaacccttacccactgaatgccagtgggactcctttccttccatggtcacaatcagaaatatcccccggatcatcaaggtcaggatttcagtggggaaaatctgaagattgtatttttgtttaaactaggaaaggaataggagggataggaggggaaagcttttgacagccataaaaaagatgagaaggtgaagacaaataattgttttctagattccatgtctttcttattagacttccccagcatagctcagattagtatcaggagaagcctacttgaaacgttttgggaatttacttaatttgtgacttatagatcagatttcctttttcaactgctgtgtcagcttctctgcatgtctgggcttaaaaatgagtcatttcaggccaggcctgttggatcatgtttgtaatccagtactttgggaggcaaggtgggtgtatcgcttgagtccaggagttttagaccagcctgggcaacactgaaaccgtgtctctacaaaaaatacaaaaattaaccaggcgcggtggcgtgtgcttgtagtctcagctgctcaggaggctgaagtgggaggatcgattgaacccaggaggtcaaggctgcagtgagccatgatcatgccactgtactccagcctgggcaacagagcaagaccctgtctccaaaaagaaggtgttggagacacagggaatttttagggaagtgaaactattctgtgtgatactctaagggtggatacatgttatatattgatcaaaacctataaaagggcttcacgtatattaacacatttcacaacaatcctgtgctgatgaagtagcagtagtactaatatctcttactgagtgcttattctgcactaagctcagagaatagatggttacatctaataaataattttgtagataatcaaacaggctcagaaaaggaagaatcaaaacttgaacttagttctttctctcattttttttgtggcaaaatatatataacataatatgtacatacaatgcataacatagaatgaatcacgcatacctaacctctagactttggtgataacgatgtgtcagagttggttcttcatttgtaacaaatggaccacactggtatggaatgtggatagtgggggagtctgggtgggttggggaaggcaaagtacatgtgggaactatctgtccttttggctcagttttgctgtgaacctaaaactgctctgaaaactagtctatttttttttttttttttttgagatggtgtctcgcttgtcgcccaggctggagtgcagtggtgtgatcttggttcactgcaagctctgcctcctgggttcacgccattctcctgcctctgcctcctgagtagctggaactaccggcgcctgccaccacgcctggctaatttttttgtgtttttagtagagatggggtttcaccgtgttagccaggatggtctcgatctcctgacctcgtgatcctcctgcctcggcctcccaaagtgctgggattacaggcttgagccaccgcacccagccaaactagtctattttttaaaaagtacattgctggcacctgagtagccagacagattgaaggaacagagcataaagttcaaaaataagccacatacataaaagaatattcagcaatgaaagccatccttcatatatgtagacatgtgagaaatatttatttgtgaggccgagacaggagggttgcttgagctcaggagtttgagatcagcctgggctacatggcaagacggcaagaccctatctcttttttttttttttttttttttaattttttttttgagatggagtcactctgtcacccaggctggagtgcagtggtgtgatctcggctcactgcaagctctgcctcccgggttcacgccattctcctgcctcagcctcccggtagctgggactacaggcgcctgccaccacccctggctaattttttgtatttttagtagagacggggtttcacagtgttagccaggatggtctcgatctcctgaccttgtgatcctcccgccttggcctcccaaagtgctgggattacaggtgtgaaccactgcgcccagctgaccctatctctttaaaaaaaaaaaaaaaaggccaggtgtggtggttcatgcctgtagtcccagctacttgtgaggttgaggtgggagtattgcttgagcccaggaggtggaggctgcagtgagccatgtttgtgtcactgcactccagcctggatgacggatgacagagcaacaccctgtttcaaaaaaaaaaaaaaaaaaagaaaagaaatatttataagcactaaatatgataagcactccacctggagctggagatacagtggtgaataaaatctgggagattacagtctgattaggagaccaacatgaaacaaatacagaaatacatatatagaagtgggcttatttttttctttctgaccactctggaagaaaggattgttgtaatataccttctatgttccaggagaatggaaactttcctttgaatctcgttgtatgttagcatcacaggacttgaataaatgcctaatgtagtacaggattttaagcacatatttgctcttatttcattctctgtgacagagttttgaaaagaaacttgctccagaagaatgcttttcccctttggatctttttaacaaaatccgagaacaaaatgaagaacttggactgattattgatttaacatatactcaacgctattataaaccagaggtaagtggaacccttcaatgaaaagaactttcttccttctgatcctaaaataatttatagtaattcagtaatcatcttgtgctaatgtgaagcttggccttctttgatgggtagtaagtttaaaagagaaccaagtgatttctctaattacatgtttttaattgctgtcttaaatggaatattattcagccataaaaaagaatagatttaatacgtgctacaatatggatgaaccttaaaaacatgcttagtgaaataaaccagacacagaaggacaaatatatgattccacttgtatgaagtacctagaatagacaaattcacagagacagaaagcagactaaaggatctatgaggtggggagaaaagggaattatggtttagtggtcagagtctttttgtcggggatgatgaaaaagttttgggtatagacagtggtgatggttacacaatactgtgaatgtaatgccactgaactatacacttgtggatggttaaaatgattttgacttagcctcttctgtcttttatctgtatctacttttctcccaccccaagaatatcggttctcaatagtgcctggaattccctctatctcacaattcaaatccaagttcttctgactctattctctactcttctacttaaatcatagctgctttatgaaggcactggcccttgaattataaaatattaaatggaactgtttatataatttatagttaaatatgcattcattcacatggaatttgctttcagttttgtatacctagtgactatctattatgtagttttattgaaaatcaagtgatacttcctggttgaagcagtgttggaaaaaatggctcttttatcagaattgtgtatactgatattggcatattaagtttgttataatctcttggcttatattctgggtcccctaattactctttaattatttctctacaagtgaaataatacacatcttttatggttttgctttataggatttgccagaaactgttccttacttaaaaatttttacagttggacatcaagtgcctgatgatgagactatttttaaattcaaacacgctgttaatgggtttttgaaagaaaataaagataatggtgagtttttgttcttacctgaactgtggtgtgcattatgaatggggttggggatttttggtatttttttatagttccaacctcagacctgttgtatttaatgatgctaaggtgatgaaaatgtcagatggtgctaatagggtaagatgtttttccttttgttgatcacaaataatttaactttggaatgttaaattagttttagtgcaaaatatgaactgaactggctcatctttcttttttaatttgaatgagaaatatataaaattaaaatgttatttttgtcttctatattggttaagaagtgagaagtagaagaaaagattaaaaaactctgagtcttagagttatgtgaaagagacaagaaagggcaaagattaagaatgggacggacccctagaagcaaaacaagaaagagtgcaccagtggaattgcccctttgtcatatgtatttaagacacatgtatacatatgtaacaaacctgcacgttgtgcacatgtaccctaaaacttaaagtataattaaaaaaaagatatttctgctgtttttccgctttgagtacagatggggaaggataccaccacctcttattcttcacatgggagaacttaagccaaaggctggtgctttcttgttcctgctttaagatttaccttactcttttgaaaatagaacttaacagcttctttatcttaaggatccagttgcctttttctggcatctctctgccagaaagaacatgatatttgtcatattttaagactgaagaagcttttatctttggaaagccactgacacccacaggacagaggcttcatttgccttctttccaaatttagcttgaggagtgtacactttgttacataaatctgacagtaaatactcctttttaaaaaatgtgatggagtagtggagaaagaatagagacagaggtgggaagatagggaatggaaggtgagagatagagactggatcagtgggtttgaagataaaatttcaaattgtaacctagtcgctcacttaatgtggacactagcttttaattatgttaaaccttgttcacagatcttcccctgtactttaactttaaaacttgagaggtttggctttcccatttgtataagctgttgtcacagaaatactaccttttaagatatgagggtacagctgatggcctattcactgcttccaggctcttttctgtgaaatttttatatagcacttcatctgttctgtgagggctaggaggtccttatgaatacatgagaacatatttttaaatcttagttgttcacgttatactgattgtagtcagttggatagactgaactccatgttggtcttctgcctgagtggtgctgactgtctaagtcttgcagtactcactgccatagcaggcttgggaccttgtttataatcagttttggctacctctgctataatcccttcccacagataacaggctcactgataaaaagaggacactacactctccactcgcttctagaactagtagggactgagaaaataaattgattcagtaaacactgagatccttttagatttgttgttagagcatgaagacacagagatgatagcagtctttgttttttgttatagcagttcacagttatctaggaaaataaatatgtagtgcatgtggtttaagatgtgggttaggctgggcgcggtggctcatgcctgtaatcccagcactttgggaggccgaggtgggcggatcacgaggtcaggagatcgagaccatcctggctaacacggtgaaaccccatctctactaaaaatacaaaaaattagccaggcgtggtggcaggcatctgtagtccaagctactcggggggctgaggcaggagaatggcgtgaacccgggaggcggagctttcagtgagcggagatggcgccactgcactccagcctgggggacagagcaagaccctgtctcaaaaaaaaaaagatgtgggttaattatagaacaaaaaagccgggcgcgatggctcatgcctgtaatcccggcactttaggaggccgaggtgggcagatcatgaggtcaggagatcgagaccatcctgactaacatggtgaaaccccatctctactaaaaatacaaaaaaaaaaaaaaataacccaggcatggtggcgggcgcctgtagtcccagctactcgggaggctgaggcaggggaatggcgtgaacctgggaggcggaacttgcagtgagccgagattgcgccactgcactccagcctgggcgacagagcgagactccatctcaaaaaaaaaaagaacaaaaaagacagttcatcataataaaagaataaattaagtgcagtgagaatatagaggagagattgaggaaggcctgacaggagacaacattcgagctgcagggatgagaattttgccagtatgagaaaagggcagcccagttttggggattaggcacaaaaggcacagggcctaaagccatggagaggcagcctcttgtgtgactagaagataatgtgaaaaggcatggaattcatatgttcatttgcaacaaataattatataacctatgttgaagtcacttttctagaaagtggaaatagaacaaagtccttgcccttatatactttacattctagtcggggagagaaataagcaaataaatacatggaatatatatggtgataagtgctttggagaataacaaaacatgataaagggatgagggaagaggtgagtgatcaggaaggcctctttatgaagatgtcatttgagcagaaccttaaaggaagtaatgaaccaagccattgggtgtctggggaggaatgtcctaaggcagagggaacagcaggtgcaaagtccctgaggcatgactatgctaggcatgtttgaggaatgttacagagccgagtgtggctggagtggagtgagtgagggtaagagcaggagaaacgggatcagagaggttggggttgggcagaagggaggtggatcatatcagcccttgtaaatcatagttaggatcattgtggacttagatcggttggaaagacagattgataccagtttatgaaggattctaaatgccatgctaaatttgggcttcatgctatgctaaattgagatttttaagcaaaaacaacccagccaggcttatgttttagaaagataacatctgccatatggaggatcagttgagatagaagtagggagattagtttgttgtagtaatccaggctggcgatgatgagtgccttcttttttctttcttttttttttttttgagatggagtctcactctgtcgccaaagctggagcgcagtggcaccattttggcacactgcaacctccgtctcctgggttcaagcaattctgctgcctcagcctcccgagtagctgggattacaggcacccaccaccacacctggctagtttttgtatttttagtagagatggggtttcaccatattggccaggctggtctcgaactcctgacctcagatgatccacccacctccgcctcccaaagggctgggattacaggcgtgagccaccatgcccggcagagtgccttctttttttcttttctttctttcttttttttttttttgagtagctgggattataggctcccgccacaatacccagctaattttttgtacttttagtagagacgtggtttcgccatgttggccaggttggaaagtgctgggattacaggcgtgagccaccacacctggctgatgagtgccttctttaccagacactacctagtcatggacacagattttgcaaagataaactacacttttttttatttaattcctcatgtaattttttaaaaagatggactaagaaatactgtggtgtaatgggaaaaatcttagacttgattctagtcttgtactatttgcctgctttgacttacatctccaagccttgccttttcattgtaaaatgtgaatagtgctatttacctgagtacttcacagggcaggtagacctgtggtatgtgtggagcaccgaacaagagaaggaatagaagctcttcgggaactcaagagtactatggaaactgtccttaatattcagtatcaagagtgaaggccttttatttgtttgattcagaaacaaatttcattcttctcttagcctgttgttgctttcactccctttttgtataattaaatcagttgctgatgggcattctgttttaagatagacgggtttgtctcattgcagttttagctgttagtgtctgaccaggcttgcagtttacatcactgagtctaattgggactatgcaaagtttcccagaagcagtgagttttggctttctgttagatgattctttatagtatgttcctagaaaaaacaattcctcttaagagttattcattttcagggcagtgataatgttatatacttgtgtatctacttcagttacttaaccctgtattttctttttatagataaacttattggtgtccactgtacccatggtttaaacaggactggctacctcatttgcaggtaagttgccaaccccagaggcagaccattttaaattgtttttgtctgtttacaatggtaatgtaaggttgtaaaaaatggaactggtatagaaatacatgaagtagaaggcagtcttgctccccacccagagattaccaccattaataatttagtacacatcttttcagactctaaaaatgcagatacaagcatacatgttattgaatggtataatagttagacattctgttttttaatttaatatgtgatagacatctttctttgaaaatacttggactccttattctttttttttttttttttattgagacggagtcttgctctgtcacccaggctggagtgcagtggcaccatctcgactcactccaagttctgcttcccaggttcacgccgttctcctgcctcagcctcccaagtagctgggactacaggtgcccgccaccacgcccggctaattttttgtatttttagtagagatgtggtttcaccgtgttagccaggatggtcttgatctcctgaccttgtgatccacccgcctcggcctcccaaagtgctggtattacaggagtgagccaccgcgcctggccagactccttattctttttaaggcctgcgttgttctttgcacaccgatgaacacaaaagtcagaagtttttgatattataaaacattgaagtagtgaacatttctatgtaaatatttttgaatgcatatctcatagccccggaggtaatttcactcaaaatagaatttcttaatcaaatagtatgtgtcgttatgctttttatggatgttgccacactgtactgagttatgtttgttcattcagaaaatatctcctgagcatctattatgtgtaagcagtgtgctgcgtgttagcaaagagactttagctgccctttgtgcgtcctaacagtctagggagggagtagatattaaagaatcacacaaatgcctatacaattacaattccaacaagtgctgagaaggggagtgacatggtacaatgagagcatagaatagggaggatttgacttcaacaagaggactagaggtttctgtggggaggtctgagcaaatatctgaagtataagtaggtgttaaccaggtagggatgttgtggagagaattctgaacgtaaggatcagcagagaccatattaacaggaaaatatatactgtgttggaggaactggctagggagactgggccatgggggtagtatggcgttaaaatggagctggaaatatgaataggagctgaaaccatgcagagctatgtttaaggttttagtcactaccttaagagcaatagaaaaccattgaattttttttgttggggatgagtgtggggaacacattcaaatttgtattttcaacctatcattttgctgctgagtggagaatacactgcagagggaaagaggtagaagcaaggagacaagttgggaggtgtttgtaggaactgaggcataatggtggattggaccagggcatggtggtcattttggtagaaagatacagatatactctatagagatatttaggtaatattgttgtcaggagttggtggtgaattgaatatgagagtttggaagaaatggctgacagtgatggtgactcccaagtttctggcccattctgttggttatacagtattttttagatataatgttaatatttttcccaatttgtcttttgttcattgttggtttctgataaatactctgtcatattaaggaagtctctatttttagtgtataaagcattttgataaaaaatgattctgcattttctttccttttgtttattaaattacattaatgtaaataaatatataaatagattttctggagttgggtcatccttgcattcttgaaaaacgtctttttgtggtcatggtatgtcattctttaataactgctggatttgatgtgctgatattttcttaggatttttatatctatgtctataagttgaaattggaccttttttgaaaaaacttgatttttttcttttcgtatataaatgacccaaattatgttgttttgttagatatttgattgatgtagaaggcgtgaggccagatgatgcaattgaatgtaagtatgagggttgacactatttttcccttttattaaagttaaaggtggaaatgtagaagaatttatcaaattttggaaaaaaagaagtttgtaattcgtttgttccaatataagatagtcttgccaaaagtctatagatgtatgtggaagtagtgagatataacagcttgaatagtgaatttcagcttaatttgctttttctggaaagatttgctttttgtacagttatttctaacagtttatcctctcctcagtattcaataggtgccggggacattgcttagaaagacaaaactacattgaagaccttcagaatggtcctatcagaaagtaagtcttatgttatatatgtgagatttgtgggtcagggagatctctgtttatgtaatttaagttgcatatgttcattcttctggtagcttgtttgtttgttggggggagatgtaaacaaataggaatgggagaaggaagaaattgttattttcatatgccaaaatatagtcactaaattgactactaaatttggaaaccagtaatattgtgtggaaaatattctctttaaggaattggaattccagtgtacccaggtcaagtgattttgaagactcagcacatctcatgcaaccagtccacaataagcctgttaaacaaggacctaggtataatctacatcagatccagggtcactcagctcctcgacatttccacacccagacccaaagtttgcaacaatcagtcaggtacctctctctgttttcccttttctagaattgagatagaaattaatactatagttaatgaaaacacattatgatactgatgaggaattcttcgttttttttttttttggagacagagtctcgctctgtcatccaggctggagtacaatggcgcgatctcggctcactgcaacctccacctcccaggttcaagcaattctcctgcctcagcctcctgagtagctgggactacaggcacccgccaccatgcccagctaattttttgtatttttagtagagatggggtttcaccatgttagacaggatggtcttgatctcctgaccctgtgatctacccgcctcagcctcccaaagtgctgggattataggcgtgagccaccgcgcctggccgataaggaattcttgctgttcagtttgaaccaggagatattattctgctctgtattttgcatttagcactggaaaatcagttacaggacagggaatatgtgacttttcagaggcaattcggaaagggacttagaaattttgattgattttaaacttaagccaagagtttgatgtggctatcaaaaaggatcttatattcttaggctacattaatgtagtatagtttttagaataaggaagattgttatttaaggagttgatatgaattataagaaaaataataaaatcctaatagagaaatagcaaaggatctgaacagataaaacgacaaaagtattttcacttggaaaatggggaagacctcagtatggttaaagtggtacattagtatgagttctccagaatgatagaaccagtaggatggatggatggatggatggatggatggatggatagatggatgggtggatgggtgggtggatgggaggaggagcttttttattcggggtatcagcttatgcacttgtgaaagctgagaagtttcatagtaggctgtctgcaaactggagaaccagggaagctggtagcattcagtccaactcagaaagcctcagaaccacggaagccagtggagtaactctcaatccaaggctgaaggcctgggaatctggtaagggttggaggacactggtatgagtcctcaagtccagaggccatgaagcctggagttctaatgtccaagagtaggagaagaaggtaaggtattccagctccaggagagaacacaatttgcctttcctctgcctttttgttgtatccaggcccccagcctattggatggtacctacgcaaactgagggtggatcctcccactcagtccacccactcacacaccagtatcctttggacacaccctcacagacactcccagaaataatactttaccagctatctagatatctcttaacccagtcaacttgacacctaaaattaactatcacaaatagcaagctattattcttgcctattaatttagcaacagttttgtttgctttttttttggtgacagagtctcaccctgtcgcccagactggagtgcagtggtgcagtcttggctcactgcaacctccacctcccaggttcaagcagttctcctgcttcagcctcccgagtagctgggattacaggcactgccaccacgcccagctaacttttgtattttagtagagatgggggtttcaccatgttggccaggctggtcttgaactcctgacctcaggtgatctgcctgcctcggcctcccaaagtgctgggattacaggcatgaaccacctcgcccagccagtttagcaacagtttttgataagcactccattgtagtggttgtcaggctggacctggatttgcatgttggctttgttactcacctgctttgtgatcttggataagatacttagcctatctacatttcatttttcccattagtcagatagatattttaataatacataccccatagtggttgttattgacagttaacatgaatttaaacagtttagcacgttgtaaacactttcaaaaatacattgccatttttaggccaggtgcattggctcacacctgtaatcccagcacttagggaggccaaggtgggaggactgcttgggcccaggaatttgagaccaccctgggcaacatgctggaatcctgtttttattaaaaaaagaaaaaagaaactttaaaaaaattgacatttttaaaagatgtaaacaaacatttcaaaaaacatgtcacttgcggcattgaaaattggtataagccttttgaagcacaatttcaagagccataaaaatactttacctagtaatttcattctgagacttaaggaaatacttcaaagtacagaaaaagctatatttacttaatcattcagcacatttctcaaactcccttccatgtgtcagatgctgggctagctcaggatacagtagtatatgttttgcagtgttaatcccagcattatttgtggttgtggaaaaacttgtagctgctatatttctaacagtggagaatgtagctaaataattatatccatactataacattttataaagccattggaagtgttagctcatttatgataagtgaaactaataggctgtgattcaacagtcagaaaaagatgctggggaaaagaacaaaaggaaatactaactaattgaattatagtaagtgggattgagggctctgcagtggggggtttttcttttctcatatttccaaagtttctttatttttttttgtaagatggagttttgctcttgttgcccaggctggagtgtaatggtgtgatctcagctcaccgcaacctccacctcccggtttcaaatgattctcctgcctcagcctccccagtagctgggattacaggctcccaccaccacacctggctaactttgtatttttaatagagatggggtttctccatgttagtcaggctggtcttgaactcctgacttcaggtgatccgcccgccttggcctcccaaagtgctgggattacaagtgcgagccaccacgcccagccccaaattttcttttgtataattatatgagattttctggtcttgcttttgaaacaagttaatttaaatcctaatttttcaaatttgttgcatataccatgcttaaagtttttcacacttcataattaatttatgtatgttcgtttataaagtggaagcagatatctgttctcagtactaactagcttattctgtcttatgtcaaccctgccagactttgggagagaaagtatttgattagaatagtatgggcatgcatttatctctgtagggaaaggtggaaaggcttctgggaatccacggtgtgccagggcattgtaggtaattgaaatgtatttttttaatttagcttcataacagctcgtgaaggtgaaaagtattattagccccattttataaagaacttagggaaataacaattaagtattttatctgcttaggtcacacaggtaggaaacagtagaatatatattattttgtaaatttataaatttaaaatattttatgaaaatataaatttaaaataaataaaaattattgtattaatcctagtaatggcttattactttttgttttgctttaagaaaattttcagagaatccacatgtttaccagagacaccatctccctcctcctggtccccctggagaggactattcacacaggaggtattcttggaatgtgaagcccaatgccagtcgggcagcccaggatagaagaaggtggtatccttataattactccagactctcctatccagcctgttgggaatggacccagtgatacaaacctgtcctggaattctacctggagaccagagctggcctgaaaattactggtgtgacttttaattagttcaggtctaatcaggtttctttattgttcccttatgtattcaagcttaaggaaaaattgcattgctgtttacctctttgctgataaatttgcagtaattacagcattgcaggaaaaacaatctgttattccagtcttaaatttttctaaaagaagacaatattttagaactgaagcattgagaacttcccttgcaaattatttttaaaattctatcttgtttttctatgtatttctttctgactagacttgtgatatgcgtgtgtttatgtacagaaatttttagtgtttttgttatgttctgttattgacccaaaggccatctttattttctataactgttcaaaatttatattaaaatctacttaggagataatttctttagaacctagttactacctgtaattaattgtggtatttttgtgattagatattactttctttggcagtcagttgtgggatttgaccaacttcctttgactgaattgtcagatatacggtctcacacaggaatggatgaacttttagggattgtcaattgagcaagagagactgactgataaaccagattgctggtttattcaattatagtgagtaagttacctggcagggtaattgccatcaactgagtagaactatccagaaaacttgaaaacttttataaaggtgataaacagagtagaatatgtccatttaaaggctgtggatgtctagcaagactactgtgttattgctccgttgttgaatataacctcctgggatctttctccagttgcctctcctcttaagtggagttgtggcttaccttttttttttttttttttttttgagacagggtcttgctctgtcacccaggctggagtgcagtggtgccatctaggctcactgcagcctctgcctcctggctgaagtgatcctcccacctcagcctccctagtagctgagactacaggtgtggactacaatgcctggccaattttttgtattttttttaatagagaccaggttttgccatgttgcccaggctggtctcaaactccttagctcaagcgaatccactcacctcagcctcccaaagtgttaggattatagccatgagccactgtgcctggcctaccttcactttttccaagttgtctcttctgctgctatacctgtggaacacacagacccttcattggggagggtaattatttttagttgcagaggaagccagaaacctttgatggctcaaagaagtgtctcatcatcataacacatagtaagcctcagtaaatacttgatgaatacttgagcaacctggcttcatttttaaattattttaattaatttatttttaaatttttgatagagataaggtctcactttgttgcccaggttggtcttgaactcctgagctcaagcgatcctcctgccttggcctcccaaagtgctgggattacaggcatgagccaccatgcccagccattggcttcattttttaaagcatctgattttgaggatttgtgtcattgaatgtctgatgctgcatgtgatagttattttctcttctctcatctatgaacaacatctggaccctgattttaaggagctactgtagctcagctgttcttggctgtacgtgattagctcagtcaggttgctgttgtagaaccccaaaagttaggttcatgtacccggtgcacagtaagccaaacactgacacattaatgcttagaaaggtttattcaatttggccaaagtatgagggtgggagaagcagattctcaaatatgaccttcctttgcatgtaattgggggctttccctgatgatcaaagctgctcgtgtcccttggccagtcaaatttctggatgccatcagggaggtcagtatgacctaaggatcattgttctttaaaagaaaaacaagtacgttaatcttgcaagcagcccctgggggttaggatataaagttaatcacttgttagtgactgctctctaccaaaatgactacgtgcgagcgatcctgcctggaggaagctaaggacagagaaagaaaaataagtaaaataaacacctgatgatttttctaatataggctgggttacagtatccccactgacactgttcctttcctcaatcttcagttggggtgttgactcagtctaactacttcccgctggcaaggggcattcctagggggctgaggaatggaacttacttacctgcagttgaaaatattcacatgtcccgggacttaggcaattttgttgtaacattgttgaacagggtgtcaggagcttgagaagggcgatcttgcaatcccacatatatagtgccacagcagtataatccacagccaaggagtattcctgttcctatagtcatagctagaattaccagtaat

SEQ ID NO: 16408 - DNA, 6436 bp, Human
gtacgatgaactaaactcttttcatctcccctcacccgtctcagcctctggtaactattctaccctctggttaccttctaccccgtacctccatgtgtttacatattgttgtataaattttgtggaaaaaaatcctttttaacaaaataatctgctggctatatttcttctcatattatttgaggaattgcattgaattttgggtactgaattttgaggacgtgaattaaggatgagctacatctcatgacctcgtcacagacccctactataaacatctgcatacaagttggcatattacaacaatagcatgagagtcagggtctgtagaaattcccagcctaactttttcctggactggccaaactgaacctgaaccagtgtatgggcaatgtagtatgcttgtcagaggcaccaaactgctaactcaaaaataaacatgactaaaagaacttctcccagtatacccatatgaagctgaccatttgcccagtaagaatgcaatgaaaagggcttttaatgtacagccaaatggcagtccagcaaggaagctcatgagcaacctacaagtagtgagcattttgatgtaatagagacttacatgcaattcagaattatgtttacaacatcacaaaacaaaaatttagagataggctctcactctgttgcctaagctggagtgcagtgggatgatcataacttactgcagccttgaactcctgggttcaactgaaggtcctcctacctcagcctgctgagtagctaggaccacaagcacacaccaccgcaactggcttaaattaaaatataaattgtagagatagggtcttaatgtgttgcccaggctgctcttgaactccttgcttcaggtgatcctcccacctcagcctctcaaagtgctgggattatagacctgagccacagcacctggccaactgacctatgattttacacaatggctgctcttcccttctttaactattattcattcttctttgatcctcattatttgactgtagtccttcttatgtcttgttttccttcattacctcttattctatcacattgccattgtcattctccactggggaagctctttcttgctgaagactggaaagacaagtccattcacctgattttctgtaagattgtggctcatgtattgacttgtcagacaattctgaagtttcatcaaaattagctatcatgcttgcataatggccctgaaccctcactcctactcttagcttcagtaccatctatgtcctcaactgtccatgatacttataattcccgtaaatcttcacttaacacctaacatttatttaatcttactaggcaaggtaataagaaatacataggtttgcctccagaagtgggttcttaagaaacccaccagaggaactcctctttcagatgtccacattagaagatttcatatcacatttggtgccacaggcctttgacaaggaggatgcagaggaaaaagcaaacttcacctcttcctagggaaagtgttggcctgccaacaggaaagaggcaacatctgggaaaatccccagtctttgccaggaagagtccatgccaaccccaccccatgacccctgtcctgcctactcattgtcactcttcactccaatgtccctcccccagatcctcttataaaatcccactctttcctgaccagacaaaccataccatatcccaccagagaggtaagtgggagctgagagaagatgagacccagggaggagctactgcacatgacacaggagaatacatgggagggtcccttcctcagggagcacaggaactctgagactcagcaagggtgtcctgggagggctcggggatgggagagtacacagattcacaactcattcagaactgtagaagatgatggatgtgaccaagatcactttagtcctaggggactagagaaggaaaatgacatgaggcagtggggtatctgtgtgttctcccactgaccacgctttctttagtgactcctgattgcctcctcaagtcgcagacactatgctgcctcccatggccctgcccagtgtatcttggatgctgctttcctgcctcatgctgctgtctcaggttcaaggtgagattgctttgcctctagcactgggttccctatgaatcctcagagctaacaagaggaggaaggctcctgtgtgtcatgtgaggtaatgacgtggtgtctaatgaacctgcctgcagttcttgcatcatctctccttccttcaggttaacttgcagtgggaggctccatggtggtccactaacagtggaatgagatggcttccatttagtcagtggactctaatatacactggtgggaaagtggactctaatatacactggagggtcagtaatgagatgtggggagggacaatgattggaggacccaatgtagagacagcccagagtgaggagagtattgaatggttgaataaggggaaagggtaataagagactggatggtgctccatttactacggctattttgagataaagaatttctgaaaacataagggaagatgaaggggtgtcaggaatgtggtcttcctccccaaggacattcctaggtattccccaaggtcatctcccaccccaagccccactcttcattttaccctcccccctcttcttccacctcaggtgaagaaccccagagggaactgccctctgcacggatccgctgtcccaaaggctccaaggcctatggctcccactgctatgccttgtttttgtcaccaaaatcctggacagatgcagatgtgagtggttagatgtggtgttggaggtgaccggtctcagggggaggagggtctccattcaggagagttccttgggaatgaggatgaacacgtttatctttcacacagtcctcctcccacctacctttgccctgccctccctcagcaggtctcaggctccctctcattctctttgttgccctcaaagctggcctgccagaagcggccctctggaaacctggtgtctgtgctcagtggggctgagggatccttcgtgtcctccctggtgaagagcattggtaacagctactcatacgtctggattgggctccatgaccccacacaggtgccagtatatcctcccctctctgttacctctcaaggtgctattgttgcccaggcccactccctgtcccctgtgcctgcccaggaagtacttcagggagcactggagctcagattctggggaatatttggggggaaagggaaggccatgaagcatctgaagatctgagttctgtggaggtctctatctttcagataaaatcaatctgccttcctcaggcgtattacataattctcatatgaggctgggttaacaattctctgagcttcatggagtctttgcctactattctgaaggaactcttaatgaagataggatcaatttttgtccccatacagaactgacattacttttgaggttcacaagctaatcacaaatgctacatcaattattgttctgcaaataatatattaccttgagttgttccaaaggtcttatgtttattggctggaattttccaatagcaatgaggagtcaaggaagagtttcctactcaccggcagcatctggaatagcagaccaactttcctcatgctggggagcaaatcaggtgttgcagctaaggggccatgcaagaagagctgcaatggccattcccttcacctggctacctcctctactctacagggcaccgagcccaatggagaaggttgggagtggagtagcagtgatgtgatgaattactttgcatgggagagaaatccctccaccatctcaagccccggccactgtgcgagcctgtcgagaagcacaggtaagaaacagaggagctgcctcttcccagtgttttccatctcatcccccattcctgggtctgaccttcaggaaatcttcctgagctagaaaatacaatgttagtgtgtcttctcttatctcctctcttctccactttctttgaatctctctcctggattgggacactggtgaaggtgagggagaggctttaacttctaggctaaaacctgggatgccccttcattggattcacaagcttcctcagccccattccatttatgtcttctgtctctccagcatttctgaggtggaaagattataactgtaatgtgaggttaccctatgtctgcaagttcactgactagtgcaggagggaagtcagcagcctgtgtttggtgtgcaactcatcatgggcatgagaccagtgtgaggactcaccctggaagagaatattcgcttaattcccccaacctgaccacctcattcttatctttcttctgtttcttcctccccgctgtcatttcagtctcttcattttgtcatacggcctaaggctttaaagagcaataaaatttttagtctgcacttgtttgtcttgtatatgccagtgtcatagccatactctgagaaggacaaagtgtttgagtggaggaaactttatgggtcttgcttcttccctattcacccaggcctctagggaaaatgatgaagtgtgcatccctaccagtgtgttatgatgagggtgtgggtcctgctcatgtaggatttgtgttgtggagagatgaggacatttctctcccgcgtacttactgccctcccattcccgtagcccaaacctgacagtgtgacatgaacagatttaggaggctctgatggtgcttagaatagtacttctcagagaatggcatcagcaggatggtagataggactttccagctcttgaaccttcacagaaacattcatttgaactactacccattaaaatggaaataccttcacaagagctaacaatcccaagtgagtgattaaagcatctgaatgttgcaaaaaataagaaaggatgcatcgaagagggtagaaagaagacttttacattatttatatcacccctccatcaatctcagtaagcacagcatggagagacattccctaaacttggggaaagagagtgaaataagcacttgagttttccatggaccctaacactaggtttgcctcagtaagacccagtggcctctgactccaggcagacacccttggacttagactccaggctgccttgatgccaggccaggctctgtggccccaggctctgtgaccccaggctccaggtcagcccccatgactgcagcctccagtcttgccccagaagatgcaggctctagacacacacagcatcatgcttttccccatagctccagaccacaggccagcacccactgacaaagactctaagcccacctcaaggacaagctagcacttgcagccacagactccagggtgacccctgaaatcctagacatcaggcctgcccatgtggacctgcccttcagacccaccacagctccaggatagctcccacagctacaacttcaggccagcacttgcagaccccagctccagactgacactcacagtcgcaggatacggtcctgtcaaatcccaaaccctccccaagcctttaggtccatctgagcacaaagccctgatgctaggccagcctctgtggcctctgtcactaggccagcccccacagacacaagttctggattttcccagttccaggcgaggctctgtggactcggtactagtctggcctcatactccagcagacccaggatcaagcttcattacagtagaccttagcaccaggccagcccccccgactcaggctccagccttagccccatgaatccagtctccagacttaccccagaggcaagttgacattcatggtcccaggctacaggccacccccactaaccctggctccataccagcccctgtagtttcaggtaccagcccagtatgcacagactcaaactccagacctgtcctagagactcagatactacatctgtcctagtgcctggctaacccctgaagacatgggttcaaggcctgctttagagccagattggtctccaggaagtaggatttagtctggctcctgtgattagaggcttcgggcctgccctcatgaagtgactgcctaccctggtataccaagtcaataggtccacttgaggatgccagcagcaagcctgcccaaagaccaagccagatggcctgcccagaatctctggatgactgactggtgaagggctttgtctgctaaagccagtctgtaaaaactggaataagtgactacttgttcaaaaagtcaaacaccaaagacacatgaccacaagtatcataaacaatcaaggaaatatgatattaccaacagaacaaaataaaggactagtaactgaccttaaggggaaagaattttacaaactgctcaacaaataatttaaagcaattgtctaaaagaaactcagtgagctacaagagaatacagatagacaactaaatgaaatca

SEQ ID NO: 16409 - DNA, 107679 bp, Human
taacatctgctagaaggtgaacatttgtcttgccaaattaagggtgaagctcaactgtatttttgagggcaccatttatccattgtgtattccaaattactgtctacaataagttacactaagtttacaagctattgtttaatttattaaataaacatgtacaaaacaccaattctgtgtcatgcactgagtcaggcacttggattgtaaaatgaaccagaatatagaatacagatgtaacaaagatgaataaaaatgtggagagaagacattatgatataacaaagaaattgaagttaagagacctgcatcgttggttcctgccccacatctaagaaccttcctgcccatggcatgcagtatctgtgaatggtcctaatgaggcatatgtcttttcacacttattttgaaaactaagtaaaataatgaaaatcaaaggtaaactataaactataagaaattaaatggtaatgtttgaattcacttgtcataatttctcctagtacattttctcactgaaatagctataatgcatcctctttctcccttaaaaactccaaaaccctattctttacactaatggtttattgaagtaatctttaaaagtattctatcaccctcaacccatctcatgttgctgataaggaagcagcaatctaaaatgtgaagtgacttataaagatgcccagtggttgaacttcctgatctccaggcctgtactcttctcactatgtcatactgcctaaggtttctttcacattaggaactataagcatgggtggtacattctaaaatcctagggcattcaggaatgggaggagagcagcccagttttggagactaaacataagcaggataccaaaaaggcaggcggccacaagactccagggattctgtctgctaatcacttgttctgtttgctccatagctcctaccccttgctgtccttctcctcttctttgacttttcatatccccattcttgtgttgtcttgataccagcctgatgggactgattggtcttttgatggtggctttgtggctgttgaccttggctaatcaatctcaccttgaattaccaactctccttcaagagaaggaataacaacaagttgacccccttgacctgggaacttgaattcagtccagctgtttggggtagcatagtgttcctaaaaatcaaatttgaatgtcttgcttccccttccctccttggttcctggccccatccatcttcagagccaactgtttgaagacggaaggggccaggaaccaaggaagaggggaaaagaagacattcaaatttgggccaggaaccaaggagggggaaaaaaaaaactgttggctttgaaaatggaaggtgccagaaaacaaggaggccatcaaatttgaatgtctttatactagatctgcacattgtaatttactatatattccgccattgtgtattgaatgctacgagcctttttgttacattgctcataacagctggcctctaataatatttgagttggctattagtggactaaaattttcaggcagatcgggtattttgggggcagggcaccataattgtcagcttactatgagtctctcaagcccaaataattgcctgtagcattcttctcactcaactctacagggtcagaactgagtactgatatggccgagatcacagggttttgcattttgatgttgagtcttaggaggctccagagagtgtaggcggatcaaggcagttcataagaaaaaacagttcataaaaccctgttaaaacacaaccttgtatatgcttgagagtcgtgaaatgccttttctgacagaaatgcctaaattagcataagaagtagtactagttggttctacatgaaggccagggtacccttatcttatttctgaaagaattctcctggaagagacatctgccagagaaggtccaaggcggagcaacagtatactttccctttgccccaacctaatattcactaaaatcctcttcaatacaggttgccaatttggcctgttccatctccaacaatgaagaaggggtgaaattagttcggatggcagccacccagattgacagcctgtgtccccaggtaagcctcattcactttgtttcaaaagcctgtcagtgaccttctccactccagcccttgtgcccctccttttccttctctatttcctcttgctgaaaaaggctactcatcatttatgagctgtttcaagttctacctttctcagaaagaataaaccataccagtctcttcagaattaccatggcagcttggccaggcatggtggctcacacctataatcccagtgctctgggaggctgaagtgggaggattgattgaggccaggggttcaaggccagcctgggcaacatagtgagactccatctctacaaaaaaataaactagctgggtgtggtgggggcattcctgtagtcccagtttactggggagtctgaggtgagaggattgctggggctcaggagttcgaggctgcagggagctgggattgtgccactatactctccactcctgttgactttgttctatttgttttgggttgtgatttaaatgttccatatctatttaccttgtctcggcagctaaatcataaacttgcacatgtggaaagcaagagttgcatttctgctgtatctgtgctaagtcatgagacttgtccagtaaatactttttgaaacccgaggcaaactattatgtcttaaaaagaagcaaacaaaaattaatggtagttgaaaatctcctttatcttttatgtgtttgattgtccttctgaacaccaagaacccacttatctgtagaacgtacagggtgcatggttttaacatggtctttgaccagcttattcctcttttgaagtgtgtggtcatcatgtccctggattgtttccaacaaataggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcaggtaatcatcacaaacaggtcccttacaaggcagctggaggagggtaactgaacgagataaggaatgtctcgcaaatgtcatggatctgtgtttcaggcgcactccttagatctttgagcttttttgatcatctctgcaaatgtgattataacaccctcttagatgcttcggtgtttatgttatttcaagacacggagtcaaggcattaaaaaggaatacattatttaaggtggcttatattcctttttagtgtttggagtttataaagcaggatggcctttgatgtatctgaatcactcatgtaaaaaagggccagggaatatgggattcattaatctacacagtttatgtcttaaaaataggtgatcagttactccaatttggctatgttaagttttgttttgttttgttttttttccaacaagtgaaggtttgtgataacacaggtagagatatcagccacagaacttaccccttagcagggacttggtagctatcaaggctttgagcacttgtctatgaggttgtagaaggaagcgagtgaaagaaaatagaactgctcatcacttgaaattataactttcttctttgtaaatgaagccagactggaggatgctagtagacatgaataactgcagagacagtctgacctttaacaggactcgtggagtccatttcaagatttgtctaccagccagcaaatggacatttttccaaatgcttttgacctaacttatttggcccagttcacctggaagaatctctgtgaggaggaggtcactggaaacatcagccttctttgtgaggtgttaaaagagccagctgacccttggaaattcaaattggccaggtgttgattctacacaggtgtgtggaactcacacctactgactcaggcagtactagccctgatgacctgctggttcttggctgactgagggctgagggagacattgcatcactgttggtgggaaccaggcagacaggacctctgactgcaacagtgtggaagtgatttctgaggggggctgtcatgtttagaaaatgtttctagttgcagtcttttcttttccggaagaaacataataaattcccactggggcttgtctgagaactgtgtagtcaaatctgtagatttgatggataatcaaaaatccagcttttcaatgatggggcaagccaaggcagatgggaacattgatgtaacatgcggcctgtgactagaatttaccttactctctgctgcttgatttaattctcatcaaaattctataaaataggtactactaattctaggttttgttttaagaaaactaagtcattgagagggtaggtaacttggcagagatggtattaaaatccagatcatcctcttttcagaaactctataattctcaatatgtcaagatagaaaggaaatttcctttggtgcttgctgctttcatttcagcttccctttcccacctctggcattctcattccaatctctaatccctttcagaaacctgtcttgttttttattcccaaggtctttgtttttgatgacttgtcaaagcaactattcatttaaatatcaccatatctagagcttagctgataaaagaactcaatatattgtcacttctgcttttttttttttttttgagatggagtttcactcttgttgcccaggctggagtgcaatggcgcgatcttgactcatagcaacttccgcctcccggattcaagctgttttcccgcctcagcctccagagtagctgggattacaggcgtgagccactatgcccagctaattttgtatttgtggtagtagagacggggtttctccgtgttggtcaggctggtctcaaactccggacctcaggtgatccgcccgccttggtctcccaaagtgctggtattacaggcgtgagccatcgcgcccggcccatttctgcttttttatttttattttttgctttgctgatagctgagtcctaatcttgtaaaagatacctccacaaaatgaatctctcataaggtatttggaaattgcttagataggtatgttcgtaatttggttgatggggaatagaaaggtggccactgatactaatctttatagtatatggtcagtttttttccaggataactatggtgctccaaataggagccctttccaaccagcctcagatcacacagccatcctgacagcccctggaaatcttctgcatccccttctaccttcaaatcaataggaaatacctatacattgcctttttcagagaggaatcattttagaacttacaacttttccaacctattctttaaatgcatgcataaacatttctgagggtggggacaagcaaggtgaggaggtcttatctcagactttttcaataggacaaagcttttgctaattttcctcccccgagccctgcctctttgctcccttttctccttgtcattcctttgtgcatctcattattaccagcaacaagaaaaggcttttgcttctgctgataacactgtgcagtccaaccccagtggtacaagtgccacggcatgccatggcaggaaaatgaacaggcgctgtcagagagccagcttggcagggcctgctggagcatgcctttggagttgacaatcagaggcagcaggcacctttccgcagacggggtttgacaaataatgatacagcccactctgtcctgctggtaggctgtggacacagcccaatagctagggaaactacttctcatcttctctctgagctacagccaaacatttacataagtaaactgcaagtttggcccaagagatattttgaagtggcattaatgatattttatgtatcagtttcttcttaggggaatatctctttggtcaggaaactctatttaaaaaacaataaaaacagatctttgtttttaaaagattgtagtttttttaatgctaccctaacttctgtatctgatattaaatttgtccatatgaaatgcaacaagtttggggagcaatgatgctagctattaacattacaggagcaaaaccaattttaagatgtggcctatgcacataaaaaagtgaaatgactgtgtgataacagtcaaactttttcccactttggaaaacctacaatttttaatagtattttaaaataagcatcttggcattaatcatgtgacagtttaattcttggatttggctcacaaagtagtaggaagctaagatctgaaaaagctattaacttgatctcataatgcccaagagttttgctttttaacttttcctatttttttttaactctacagtcttaagtttgttttcttttaaaaattcaccgtgaactttattgctttgaatctgtagccttatggtttacaacagtcaaatagtttggtcatcactgattttttttcataacaaaattatatcatttctaaaatagtaatgttgccaaatataaggaagtttacaataaaatatgttgcaatcaaatgtttcatgacatgtttaaataccacacttgatattagagtgtgccacccaaacattgcagtttttcacagcaatggaataatctctaggatacttttgccttttattactattttcatctcttttcctttctagttgcaacattcctctctctctttacttcatgaattctttctcttcaaaacacctcagaataaaagtgtgtaattgatcgccccttctcaatgggcatgttcattcagtgtctgtcttttgattgcctgctgcctataggccactgtcaggaatgcaaatgtgaatgaagtgtgtattctgcctttaaataattgactgccctccttgatatatactagattagcgtgcttactaactgttaagtcctagacctgaaggcacagggtatgggggtgaggaagttattacagggggttcaaaaatccatatatacaccaagtatggtcttctgaccaaaaagttcatgttcatgtctatgtaaacaggtatggcttttttccaaacacaggcaaacctcgaacgtattgctggttctgttccaactactgcagtaaaatgccaattgcaataaggtgaatcatacaaatcttttttgattcccagtgcatataagttatgtttacagtgcagtgtagtccattaactgtgcagtaggattatgtttaaaaactgtacatacctttatttagaaatacttcatttctaaaaaatgctaaagatcattctgagccttcagccagccataatctctttgatggtagggggggtttccttgatgttgatcagagtggtggttcctgtgtggttcctgaaggatggcgtggctgtggcaatttcttgaagtaagataacaatgaagtttgatgcgttgattgactattcctttacaaaagattctctgtagcatgtgagatgctgtttgacagcactttatccacagtagaacttctttcaaattggagtcagtcctctcaaactctgctgctgctttatgcactacatttatataatattttaaatcctttgttgtcatttcaacaatgttcacactatcatagctagggatagattacatctcaagaagccgctttgctcatacataagcaattcctcatccatgaagtttgatcatgacattgcagattcagtcacatctttaggctccacttctaattctagttctcttgctatttccactagataagcactttcttcctccactgaagtcttgaacccttcaaagtcgactatgagggttgggatcaactttttccaaactcctgttaatgttgatattttgactttctccggtgaatcaatcatggatgttcttagtggcaactaggatggcgaattctttccagaaggcctttaatttactttgcccagatccatcaggagaatcactatctattgcagctatagccttaaaaagtgaattttctaaataataagacttgaaagtcaaaatgactccttgatacatctgctgcagaatagatgtgttagcaagcaggaaagcactattaatctctgtgtatatctccatcagagctcttgggtgaccaggtgcattttcaatgagcaataacattttgaaaagaattatttttattctgaacagtaggtttcaagagtggacttgaaatattcagtaaaccatgctataaacagatgtgctgtcttcagtcttcgttgttccatttatagagcacaggcagagtagatttagcataactcttagggccctgggattttcaaagtggtaaatgagcatttggttcaacctaaaaatcaactgtattagccactaataagagactcagcctgtcctttgaagccagctatgaaagttgtaaatggcaccgtcttccagtagaaggctgtcttgtcaacattgaaaacttgtttgcccccttaatcaatgatcttagctagatctttaggataacttggcacaggttctatctacatcagcacttgctggtttaccttgcacttttatgttatggagatgacttctttcttaaacatcatgaaccaacctctgctagcttccagcttttcttctgcagcttccttacctctctcagccttcatagaattaaagagcattaggatcttggtcaagattgggctttggcttaaaggaatgctgtggccgatatgatcttctatttagaccactcaaactttctccatattagcaataaggctgcttcattttcttatctgggtgttcattggagtagcacttttaatttctttcaagaactttttcttgtacttacaagttggctgtttggcctctcttgacttgtgacatgtcttcctcactaagcttaatcatttctagcttttgatttcaagtgagaaatgtgtgacccttcctttcacttgaatacttaaaggtcattgtagggttgttaataggcctaattttaatattgttgcgtctcagggaataagaagcttgagaagagggagagagatggcaaacggccgtcttggtggagcaggcggaacacgcccgacatttattgtttgccttcttaagtgaacatggttcctgatgccccaaaacaattgcaatagtgacaaagatcactgatcacagatcatcaaaacgataatgaaaaaattttgaaatattgcaacaattgcaaaactgtcatacagagacaggaaatgagcacatgctgttggaacaatggcaccaacagacttgcttgacgcagagttgcaacaaaccttcaatttgtatttgggggggaagaaaaaaaaacccaccaatctgtgatacacaataaaacaagacatgcctgtagattgtttttaataaagtacaaatctatttgaaaacattctgaaccgtagtagcttttacatgtctaccatccatcaatataactactatcatgaagaaactgtgactcattttttcataaaaagggacctgaattggagaaggttgaaaaacactgagtaaactgtaattatatgttgcttgacgacaggcatatgttctgggaaatgcatcgttgggcaatttcatcactgtgtgaacatcacatactgtatttacacacctagatggtattgcttactgcatacctacactacatggtataacctattactcttaggctacaaacttgtacagcacgttactgtactgaatactgtaagcaattggaatacaatagtaagttttgtgtatctaaacatgtataaatattttaaaagtacggtaaaaatatgacataatcttatgggactacctttaagtatgtggtctgttattgactgaaatgatttatgttgcatgactatatcttaaaattttaaaaatttatttataaaaattagtcaattaggccgggcctagtgggtcatgcctgtaatcccagcactttgggaggccaaggcaggcagatcatttgaggtcaggagttcaagagcagcttgaccaacatggtgaaaccctgtctttactaaaaagacaaaaaaaaaaaaaaatccaggtgtgatggtgcatgcctgtaatcccatctacttgggaggctgaggcaggagaatctcctgaacttggcagactgaggttgtggtgagctgggattgcgtcactgcactccagcctgggcgacagagggagactccgtctcaaaaaaaaaaaaaaataaaataaaataaaattagtcaattagtaaattataaaactaatactttgtacaacattattaacctgactatgtaacagattttgctgatgatttgagtaattaatagcaatgtttttgttatggatttctagcctgtgctggtttatttttaaataggtataataatacctataaaaacatatttcttgcctcttaaattagttgcatatttctacttttggatagtcctattaaaaatacgttttcattttaacatattgggtcatgaatgggtttcttagaatttaaaaacaaacttattaactccagaaggattagtatctaatataattaacagacgtctcactatttttttctcaactccaaagtaccgtttctaaactctgcactgaaactttgtccattcttgtattactgttatacaaagaaaatagcagccggatgtgtgattttgacacaaatccttttctagttacttactctcaagggccaggacacattttaattgtcttaagaaattctacaggacagaaagagaagcttcttttaatcaaagttttacatttagaattctctgtcaatattcatttgagtaaacatttctctcagatgtccttttaggtatatactgtgttcacatgtttaatcatgttttcattaaaatgtcatgtctcaagaaaatgtcatgatttgggaagtactactttttgtgagttttagaaatcgaaatactaaaatttaaacgtttcattatttttctattctaatttatagttgaaattaaagaaatggagaatgtagaaatcagcaatttataatggtttgagtgaagaaatcacactgtatgaggtcaaaatggatgttctttatgaaaagtcagttataacttgcaattttctatcctgtgtcctaaaaatataaattttctttctaagtgcttaatttagtaaaagtaggggagatcggtagtggagactaggatttgctggatactctctttctttctttaggaaatttaaaatcagaactagccctaaaagcttcttaaagaggtaatattttattttaactatttatgaactattggttggatttggcagttataattttaaaatattaacaggttacttaagactttaaaaatatatttatcaaaagcacatatttttatgtgttcatgtcttggtgtgttttggagaatactgtaaactgtgttgcttataatcaatagaaatttatgtctcatggttctggaggctgggaagtccaagacaaaggactctgctttctcatagtcttctcactggaaccttgataggaagaggatagaaagagggtagaaagagggagggatctctgaggtctcttttataaggacactaattccattccttaagattctgccctcataacacaatcacctcctaaagtctgcacctcttaatactacccctttgggagttagaattttaacatatgaattttaagggaataaaaacatgcagtttattagttggtgtgtgtgcatgtatgtgtgtgttcagcttatttacaaagagcactaaactttttgaacatttccttagaattctgcttctaaagaatgcacaaggaatagaattacagatctcacactggacatgaaaaatacaaaattacacacttgttaaaactgcaagggaataaataatgtgttttctctatgccattagagagtgaagcctcccctctatgcctgcttgatttctactttgggcaatcatatgaaagttatgcagatcttgactataatctgagggaaccagccacaagactggattgtattttaattgtgggaaactgatcgtcttcacctaatcagttttcccattgcatataccgtgtgcatgacataattttaaaagaccaactgcgtgatatttgtttatttttcctcaaatgttttcgtaatgaaaacatgattaaagaaacatgtgtccaaagctttgactctggttttatttatggacatttatacttggtcagattgacttcatgttggctgctacaacttctaaaaggccctgtcgtgtgtaagtatcaaacttcaaaacaaaggaagggatattctttaagtcagtggtcctcagaatgttgtcttcaaaccagtggcattagcatcacctgggaacttgacagaaactcaatttcttgggctctaccccagacttactgaattggaaactctaggagtggcacctagcgatctatgtgatgctaccagccctctggctgatgctcaggtttgagaaccactgttgtaattataaactatgtcctttacatacaattttagtattattaggcatgcattgagatgtgtccaaggcaagggctcatgagagttgaatcaattttaattggttaagttctgagttatgtaaagtcatctaaatgtgtatgtgtcctctccatagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacaggtaagcatgggtattgggtctggccaaaatgttaatgccttgattagtttctataactgaataaatctgtttcattgatttctgtaggcctttatgcttctaaattgcacataattgtggaatgggtggaatacttgagtgttctctttgttttttgagtttgaatttgaataatattaggagaatgacagttgtactgctttgcatgcatatatttctttatacttttcatatagatcatttgattctcacaaacaataaaatttttctgcttacttaattatctccaattatggatgagataattttatgacttgagaaaattatggtttgaattggctaagagactggaatgaggtcacaaggttagaaaatagtgcagatgtgataagaacttggaatctgtaatttaaccttttcttcatttattgcttgagaggataggaccttaaggaagaactctgaaccagccagtggaaagcataaaggttttagatagtgagtggatatgacgtgctcaaagaaaggtggtggctgctgacaaagagttaggctttcagcatattccctttctttctaggaaagctttacatgcccttcttcaggggcatgtggctgctcacaggactcactgctatggtcaggtatggttacttatgggagcttgtcagagcttgcagatgcattggggtaaaaaaaaatgcttccactgaattagaacaatctacaactctggagaatatataagactggcctgtttttagtagttctcccctcttgaccaatgtcttttggcttcctcaggccttgatttatatatatgagataagatatatagtccaaggaatgagaggaaactagggaatagaaaaagagaatgtaagtccacattggataaggttgttaatgaataatgaattggtgcatatatatgcacagaagggcctctcccctcaaaccctaagggggaccttcataggtttgcctatgagctttggatgccaccaggcatttttaaaatagccatctctgaaaggtcagatatagccatgttccaagttctgcatgatgagatgtgttggtagaaatatgttgctttttatggggaaaagattatttacaaagagttctgtaggtatttgttagcctggaatagcaagtaaaacacaatacataaacacaggtattggtcattctctttaaaatataagcagaaacagaatagtgtggtatcatgttataaagagcacatctagagactgttgcccttggaacatccttacagacttagacttagacataataacaaaaataatgacaagatatgactgcatttgaattagctgagagtcagcactgctttctttcacataagcttgccctttgcattcaattgagcaacacaaagcaagccatacagtatttctttcctcacttggaagagttataaaaaggtatttttttccctaattctccaaattaaggactttttcattagtaacctttagggagaccatctcacatttctgtggcttacagttcccagcccatcagctctattcttgtacaaagtctcagcttcatgtgagatatctgacagagtaacactcacctgggtctgtcactagataaataataccagagaagtgttgaagacctagagacaggactcagttcctgcccactcatgactggtgggaaggacacttgtggcagatgaaagatacagagcatattgccaattttcatgtgactttctacccacagataactcaggcactgttcaaatgacattttagaactttttcttattgtatcttggactgctttgacaacaggagtgccacttactaggtcaaaatctaaaggcaaggacaattgcttagttgattgtaatattttaacataattttcacccaaagtcttgatatgtaaataatgttctggttgatttttctacttttaaaaaaacaaatagtcgttcatcctggattgttgttgctaatcaagatttttgctcttacttgttctgagtttttacaatttttatcctggcttgcaatgattgagcactctgggggcttaactaaaggcacctttcttattttgatgcccatatccaattcctaattgaatacggtagatgagcaggacatttaaattctacttttcaggatttattgaagttaactaggaaagtaaccaggcagagactgaaatagacagcttatatataactttaattgaaaatataggaataagtgtcaaggaaaagtgggtgtcagtggactaagagctagaatacaaaggtatacaatttctttggtatttgtccccaattgttcttctctttctgaaacaggaataatgttattattttgtgaataactagagaggttgccaaagaaatgaaagaaaaaaacttcagctattaactcactgactgctaatgagaattgctggggaatgtgcttgcataaagtagacacgtggagtttgaggatgaccacaggatcagttctgtaattatggttgtacaaagttttgttggtgtgtgtgtgtgtatatatgtgtgtgtgtgtgtgtgtgtgtatatatatgttgtctaaagtgatttacttctaatgtcattgtatgtctgtgctaaggagacataagatatatgtcctcaaaatagaaaccctgtgcatgtccctgatgccaaattatctaccttttgcttagttttgtttctgacttaaacaattttagagccatgttgaattggccacttttctatgtgaatctatcaaattttgtcatgagagtacattgtagggtgagagagggtggtagtgggaaaaaagggaaaaatgccaagaggaaagatgaggagaaagaagacaaaatgtcatggtttttgttgttgttgttgttgccacacctactaggttctgcccattgatttttttgtttgatattttatttttaaaaaattctgtgccattagattcaagaccttgagtcagacatgctcaacctctgtactgttgacactttggtctgaacagttgtttcttggggagagttctggggactgttttgtccattatgggatgcttagaagcatccctggactccacctgctaaatgtttgtagcatctctttcttctacatgccaagttgtaaccaccaagatgtctctagacattgccagatatccttgaaggaagtgggtcctggtgggcaaaataatgtgcactgagcattactgccctaaagtaaagaaataacccaaaatagggacaagttcaaacaggacagattggagcccatgtactgtggacatagtgaaaagggagtggggttgggagtatattacaaagaagaatctgtaaaagggcagaataatcaaacagccttgactgaactggatgttgctgctgaaggtgtttacacacaggcaaacccctgtgtagacagatgaatggctgcatgggtaggtcactgtagggagactcccactttaccacttggctgccctcgctgagtggctggaaaattgagaggtacccaaagagtgataacacatctgtggtttattttccatgaattattttctttccttagtaaagacagtgctttgcttaagagtgcttcttgtcttgatatgaatgctgaattaaatttaagaaaattttgtagattattagtatgctaagaattatagggtagcattatgtacaaatttacctgttcattttctataaaacaatctaggctgatgaaaacacaataaattggatctacagcagacccattaaatacttacatggcatatttgatgggctcttcaataaaacctgaattataacaaattgccaaacagcttagtagtaagtacacgcttgaccagacccatcttcatagatctcgtttacaaagttgggttgctgcaggaggctgaggaggggtgaaagcacattcagcgatatcatatttatatatatatatacacacacatacagtagctcattcttcactgaatggattatattgaaatgtcatttttgtaaatttgatagctgactcaagtttgtggccatgtgagcgtgactaggttaaaagatctgtgagattctgccagatattttttcttcagaggaaacaatagaccaaaaaaaaaaaaaaaaaagaaaaaagcatattttaaaaagggttctatgttatggagcactctgtatgcagagattaaaattccattattttggaaaatacgtgggccaagcagatggtataatttttacttccatgctctataacctaaagttttatacgaatgggaaggtttttcgttttacaacatttctatatatttttgcttagaaagtataaaaggaccaacaaatacaaagcatccaaactggaaatcttattgagagggtacatttgggccaggacaatgcagtagaatgaatccaaggttaggattcagaagaactgttatttgactgctaccaactaactgtgaccttaaacaaatcagttagtgcctctgggacttgggttttttcctgtattgcccaatgttttgtcattcaagaatgggtcggtattaattgtgtaatatatgcatcactgtttctggcttcctggtgactgcacttggcataagcaattattgcccatgagtcccctgtataaaccctctgcaccatctggacgagggccttcattattctccaggcaaaacatatccatgctgctccctctgtcctccctgcaacgttcttcatctcctcctcctcctgctttacatctgtttattgagattcacctttaaaatatagctctagtctcagttggagaccacagaaaactattagtcttttgacatttagtatggtatgtcctcttcagtgtaaatgactgcttacaacaggattgtctgtttttagaggcaagtgtttctataggtacccacagcctagaatggtgttttcagtaacacatttaatacgtaagtattgattaaatgaataccaaaaatgagaactttacactttgtcttttttttctgtagaaaatatgtctaccagcagcctcaggtttgcagctcaagaccaatttctgtgtatcaatgggaaatcatctgattggctttctggcctatgcttccttcagttggactgatttctgttgctagtggaatagagttttatgattggacaggtctgagtgacctgcctatctctctggctggaatatgggggactggagtatgagattgatgtcagaaggaggtggtaggggcagcttattgggaagacaaactattaagtattagagataggaaggactatccacagtctaagttacttcggcatgactaattttaagtcggaagtgtaggaagaatgagaaagaagcctcatccagtaaagagcccttaaatagataacgtataatttgtctcaatgtcttttttatatgactaaaacctatatactctaagtattgtagaaatctgataagtttttgaagatctgtataatttttcctaaaagcaaatgcaaggttttggggctcagaaaacaaacgttactttgcacagtaagcatgtcagtttcccatgttccattcccgctcttggagcaatgtgatgagggcagatggattctgcacatacagtggaggtctgtgctacaggtggggaaccacaccattatgaatctaggagcttatttagaaattggtgctcctcctgagggcaggaaagaaacacttcctctctctttttttgagatgaagttttgttcttgttgcccaggctggagtgcaatggcagtctctgctcactgcaacctctgcctcctgggttcaagtgattctattgcctcagcttcccaagtagctgtgattacaggcggtcgccaccacgcctggctaattttttttttttttttttttgtattttcagtagagatggggtttcaccatgttggccaggctgatctcaaacccctgacctcaggtaatctgcctacctcggcctctcaaagtgctgggattacaggcatgagccaccgcgcctggccacgttttttatgtaaacaaattctgtccaggaggtagccaagtggttaaaaacttttggaatataaatgcatggttcctagttttatccctcttttgaaatgtaaacatatctggagaagctgtctataaatctctctccaggttatttcactatcttaggactgttaacctttgaaccaggttaccagtattttcattcagacagggttgaccatgcagaaacatgaaaatatttcctatacactagtgtgtttgtaaatgatgtgttctcccacaattcagacatggtcagctctctcagcataagaggctgaagaaccacctcagaaaatacgaccataaccagatagcttacaatatagaaatgtaaatgattccttctcaaaagaaaagttgcttgaactctctcataagataaatgcaaattaaaaactacgctgagaaaccattacccatcagaatggcaaaaatccaaaagttctataatatatatactctgttaaggattaggaaaagtcatcttatattttgcttgtagatgtgcaaaatggaggaaatttgacatcttctgtcaacagaacatatttaacatttggaaagcaatctcacttttaaaaatctgttcttcagatgtactggcaaaaaatataaaaacgtatgcacaagattatttattacaagactgtaggctagaaacaacacaaatatctagctttagggcactggttgaataaattatggtctaatcacacagtggagtagtatgcagctataaaacagaatggggaataactatacaatctctgactatatttttaggttaaaaaatgaggtggaaaaagtatgtataacatgttccatttattttcaaaaaaggtaaattatataacacaggaagagaaagtaagatacaaaattttattctaacaataaaacccttaacgtgaaggtggagatagggtacggtaaacataggaagattcacaactgcatgtgtgtataggccataaatttggggtgacacagcagaacaaacagcacttctctagtgcctgtttgtcaaagtacaaccaaaaaaaaaaaaaaaaaagacatgaatctccagttcttcatggattcagaatcctgggaactggagagtacatgtgcttctttgtcacttcaaggacatcagagaccagcatctgtggtaatggcagtgtagtaaattaggggcctacatattgtgtctagcagagtcagtgctggtgtccactggaattggtggtctggatgctttaattgtgcacaactgaggctgtagtaatgtcctgtcacccagattctctgacggaggggaaactgccacatcagtgataggtgtttgaatcagaggaagaatatgctaacagccactcatttggaagcacatgtggtacatccttggagtattccagaaatagttttggtaatgaaaaaatgggaacctttgcatgtagccggagggcctgaaataacaggtgaacaaaagaacaacagaagtactgtatatggccagagtagtctccagatgacctccttgccaaattttaaatttgttttgtagagacaggtcttgctatactggctagagtggtctccaactcctagcctcatgtgattctccccacctcagtctcccaaaatgctgggattacaggcatgagcccatcccacttggctcctggtttgcctttctctattttacctttcctctaattctacctgatttcttccttgtcagtgaagtcccctttctaaccagaccagagaagcccactcttcggtgtacctgttactcttattatctgtgttactcatttggaacctaccatatactgccaagtatttcatactccttgttacccacttttctacttacgtttatatctgtcctagtgtttatatctgtcttctgtccatcttagtacctgaggcatgtgtgtatgtattgactttttgcatgtttttgttaaattttaacctcttaagatctgagtctacctctccattacctgcagctttaactaagagttgaaactcaaagatgtcattaatataaatgagtaacataatgacacagttaccttattctgggggattaaaccctccttaaatcgcatacttaatgatcaagataagaatcttttaagttatgtgcaataaatttttagcaagcactttattacatcttaatgcaatctaagtatttaaacatcacagatgccaaattagactgtatttattaagctaggttttgacaaacactaagctaaataaggcatcatgctcatgctcaatactttattcgttccttaagtttcagaattaaatgtgccatccttttaagttataaaccatttgtgattatttttgaaatgcttattttaaaatagaagaaaactttccaagcaagcattttctttcctcaggaaaaggaatttgtgtctagacaagagcagatggatgctccctgattcttttagggtagttgtcgtgaatggaatttagagagttttttttttttttttttaccccctccttctaggcagtccttcttcatcttttatcaaacaattcatctcatgggttatgtattgccttctggaacttaaatttgatttatgtttgaaatatacatttataattttcccaacatgaatttatggaaatggcagcctttagaaactcccacagaggtaacagatgattgactcggatgaaagaaagtccaagaatgtatgcaggaagaattgggactggccaagatgatgatagttgtctggagaggtagaaacagctgacaaatagcagcaaatagggagcagattaagccagggtactgttgttcttgctcctggattccaattttcaacttcgaacctgatgtctcaagacagaagagaagctagtatatcattggtctaggcagaggaagattgaaatttagagaaagtatgtaaggtttatttctacattgcctctgctacattttaaaaaagcatttgaagacacttaagatttaaattcaatcaagtgatgtaaattaaataattaaagtggtgtaaatatgagatagaaaggaaatagtttcaagagaatattggatgaaactgggtggctgagtagaaactgtgtttctactgggctaggcaagctgagtttgaattgttttgtttttattttctggaagttactactttgttggtaaaggctttcaaagactttctttcctcatggatctggggaggtcataatggaacaccatgtttaacattggccttcttggcaagcaagataaaaagcaaagttctaggagcaagtttatcaaatcttgtcctgagggcagattatttcacaggaaattccttattaaaaatgcaacactgtcaccaggatgatacggggctgctgaggggagagaagggcatagaactggggaagctcagtttgcaaaacaaattgtaccaacttcccggttttcagattcagcactaattggtgtgctgtgtcccattatgctcaccttttttttttttccatggtgaatcgtgtggttgtacctccaagttctttccaaaagagactaggtgattttgcctggtagaaacaaacagtgtgtgcatgggtaaatgcagaaagtcatggtgtgaagacagccccaagaagcatttactgtggctctttcatgtgctaggcagtgtggtaatcatctgacatgcatcctacttgtttgtaagtgcctccaaagcataatgtatttgtgttatttaccactcgattcccgattcccggtgcctagagtactgcttagatttgcatataaaatttagtaataaacttgttgaatgtatttctgatctttatgtaaaccctgaagggcaatgatcattatttctgttttatactgagtaaactgaggcttaaattggtttaataacgtgtaaaattaaatatcaagattcatttacacattttcctggaaccaataaatatgcttgaaacgtagatcaagcatcgttgctacaattaaacagaaattttcatgtgtcctgctagctagttttttaccaatatttttacttagggcatagctatttttactgatagttttacttatggcatagcatactacattagttatatatttctgtgtaacaaattacccgcaaatttaacttgccacgtgggcttttctttagagcagcttacaacatggcaactgtcttccatcagagttaagtaaccaagatagtaagaaaacagaagccagcatcatttttcatttcagaagtggcatcccatctttttttgccatattctgttggttagaagtgaattactagttccagctcacattcaaggttgaggggattacacaaaggcatgaataccaggagaagaggaatcactgggggccctctcagaggcatctgtcacacatacatatttgcaaatacatgaggataggagagaccataagggtaatgaatggcataactggataaaacagtcctagggtgtgtggacaaatcccacaacatggacttaataaggacatattcaaatgctggtataatagccctattaccttgtgcagtggcatttagagcacaaaagatccactgaggcaatatgaagccatacagtatgtggacaggaggggacagaggaataacagagctagatcgtggagaaggaagggcctagattcattcaaggtgattggagaagtgggttggagtcaaagagaacagataagagtcagggaatggtacatagacaaagctggtacataattcaaagatcagtgtgcatgccaaagggaataaaaaactaatggcatcatcaggaaaaattctatttgacttaggtttagagattcgaacattaattgaagaagctctttagcctgtggtgtcagaagtcataaccaagattcgagtgcatgtgtgtaaaattaggggtggaagtgaaagctctgaacagtgtacgaacccttagccaagggctttaatgagattccagccatcctcgtacctcctagggaaggcacacacctataaatacatatggaaatgaaatagtcactatttgcgaagtagacgtatagatccatttgcctagtaggtaatgctcccacccaaacatctctaaaaagattctgagctgaggatttttaaagtcccccgtgtaggggtgaattgggggaatacttaaagaccttctattaatttatgatcatgacattcgttactaaaatcactaatataaaatggtggccagcttctatgatttgtcatctgttcttaagtggaactaaagggagagatgtgttatggcttcagtttggggtagtttctacttctacattgactgtgaattggaacttcagactcggtcttcttacaactgattatgcttcatggatgtgtggaattgtcaaggcacaccccgtgccttatagatgccagtcagagtcccctttgggcaactttagggccccagtagttgatatcacactctcttttacccttttttcctctcttctgtcatctaattagggggcctcctgaataatcccttagcagtgtctgacaggaaccatttttgggaaagaatactttacctgtagaaataacatcaaacatcacttacctggtataggggacactggaatggccccacagtgatcctccaaattaatattttctggctccaattactctgatttttccctaatctttaccgaattccaactgttacagtagaggctcagtgactgtctgtgatggggggaggatattgtactaattcctgcacaggaattagctgcaattccatccctgtcgtgatattttatgttatttttagattcctttcaatgctcttttttttattttatgttaacagttactaaactgtttatctctctcgaacaggggctttgtctattttcttttctctatgctccataataaaatttgtgcaagaaacacactcagagtgtgttggatgactgcatcaccacagttgggtgacccctgtgcatgcagatgtgcttgactggccttggcgaactagttgagaatagaattatgaatctttcttgctcaatggtgatgctccttctgaagaagcagagtcctgaaagaatcctgagctcaggtttctgaaaggtccctacagaccaaacccagaatgcccactaatcacttgttaaatgactcgtgatactttttaataaaattactgaaccaatgctaaatgatgggcagaaaaagagagacttgttatgtgaaatgtgatgctactcactttgtccgtgaaatactggatgacaaaggagttcttcatcttaattttccccatttattcctgtcctattcttttacttcttatccttctctacccaactggatagattgtctgtgctagaagcaggacaagggtttaaatgcaaagaatgaagcagagatggtctctgcctgaaggcgattcatatgtgaaacagttgacatacagaaataccgatgaactagcctaatacagtatactgagtgctataatggtgtgcgtgtgtgtgtgtgtgtgtgtgtgtgtgtgtgagattaggatgctataaaattacagagaattgtagagaactgtctactttgggttctgaggattaaagaaggcttcacaatggcaattagttctacactggagattgaagattgagtaggagttcacctgggccaaagacgagtatgtacatttcagtatgagagaataaatcattcatggatatgttgctgtgggcccatttcatatttggagatattgaagttaaagtctgtctaactggaacatttgagaatatgtggtaataaggggtgagacagaaagacacaagaaccatataggcagataatagatgctttttgtgtttgtttcttgataaagaggttttatagttctctgtagtatagggaatcattggaatacttaaagcaggggtaaggaccttttatatacctgagggtagcgaggttacctgactcttcatctctgctacctttggttgaccttgcattttgccctttgggttgtcagcagtcctatttgaatatttaacacaacttctcattcatttaactgactcaccctgtgttctgaaacttcacccctgacgtctctcaggagaatttattccagaactttctcacctctggtttaggatctcgatcaacactagaatgatgcgaccttgatttttatatgcatacttaactctgatttcattactcctagggatatcatcgttttgtggcctagtgtgtgcgctgcatacagaaatatagctagaattcaaaagtttatctctgaatttgatcaccctttcagacataagctattaagaacaaatcagcatttctgataaataactgtaaagtggtgcctacagtttttggatgtaattcagaaagcagaaagaagcttctatttatattcctatatcaaaaactctgttaatacacaatgtgtgcatcacaaaggcaatgctgcgttttgtcctaattagtgagaggcagaagcagcatcatatttgaggaagtttgaaactttttctgtctcagtattacttttggggtatttaggtttttttttttttttttttttttttttgagatggagtcttgctctgttgcccaggctggagtgcagtggcaccacctcggctcactgcaagctctgcctcccagattcatgccattctcctgcctcagcctcccaagtagctgggactacaggcacccgccaccacacccagctaattttttgtatttttagtagagacggggtttcactgtgttacccaggatggtctcgatctcctgacctcgtgatccaccctcctcggcctcccaaagtgctgggattacaggcatgagccaaggcgcctggcctagattttttagacattaccaaagtattagaaaaattaatagtcaacctaacatcttaggttctgtcaagatgggtcattgttctataaacttttgtttttatgtctcatcactctttctgttttgagacggagtctcgctctgttgcccaggctgaagttcagtggtgcgatcttggttcactgcaacctctgcctcctgggttcaagcgattctcatgcctcagcctctcgagtagctgggattacaggcacctgccaccatgcctggctatgttttgtatttttagtagaggtggggtttcaccatgttgcccaggctattcttgaactccagacctcaggtgatccacccaccttggcttcccaaagtgctggaattacacgtgtgagccaccgtgcccagcctcatcactcttaaaggcagaataggataagaccgaatgagcgaagagcagcaatgtggagagcagaggtattggtgattaaagaacagtagcagttgaccaatccctaaataaatattgaactgtgcttaggattggtctcagagaaagagtttcttaggggtcagacccagaaaaacactgacttatggtaaggaaaaaaatagatgtcttgtcagttacagtaaatataatgaattgaatgagttcgagttttatgttttactggccaaagaatataataagatggtttaaatattaaggctcaattgcactctgagcctctattttaaaaataaagaacttgtaccctctcccctatcgtttttttcttccttgaaaggtcgatggtagttctgttccaatctcttcataaaaattcattgtttctgccacttctgacaaccccaggtcaataacactgttgtttataccaaaatcctaccatccaaatctcactagagagataatgtatgccatgctggtgcaaatagaatcctcttctccaaactgtatgtcacagcattactagatgtattctgagttgcagagcatcccctatgaagtccatttaggttttagctttctcctctcacccttgcgggaagtatcaggccaggaggtggttttagcgagatggcaaaaaccgcatttatttttgcaccaacctaatagcatgtcaccttctacgttgtcctcctccccatctcttcctcagggtgaccttgccacaaacaaagcaacaccataacctttttcacccctttatattcgagaaaggtcttcatgcaaatagaggtgtgttcatgcaggttggggtctgagcggtgggcattttcccactcaacttcttagttggcagttactaaggcagaatattaagtgtttgatcacagtcataatgtctgagggacttcctcacttaatgatattgttcagatcggtttctatcatgttgtgggccatgtgatagaactttattttttcagagcccagttctataagaagtacaaccttgagaataatttgatttctttttaaacatgtgaattatgaaaagattcaaagatacaaaaagaacaaagactaataaaacaaatgtctctccttccatctcaaaggtaactactatatttaaagtggtatatatccttttagaacatgtaagaacatgtacaaatgtatatgtttaaataatgcacagttttcatttgtgtatttaaaaatttttcacaaacgatgtttcttttcctactcacacgatattgtttttcccactcgaactttgacctcagggcttattcactttaatatattgactgtcccctgactcacatccctaagtctgttttatcccacccagatgtactgtctgtggatctgcagttagcatatcaaagtggttcctgagttggaggattcagaatagggctggggtagagcctgtagacagagctcccttaaagcaattattttcattctcaggttttgtataattttcttcttaactctttgaatatataacctagcaggaaacaactgtctctatggttatagagacacaaaaacatttttgtgactccaatgtacaattacttacccctcctaatcagcatctctttagaagttaatatttggccaagcccctagagaatgccccaaatcacagggagtggattttactagattttgtcaaagcacttgccgaaatgatgtgtaaccattgttctcccatctgtagtagaagggtaccattgtgtctgcatgctcaatatgattaatattattatgctttaatttgtttacctatgcctataagtatgaaattacatctcattgtttgcattatttctctgattatgggtgaagtcttactgtgtatttatcagcaatatggattgcttttctgtgaactgagtgtactaattctttgtcaatttttaatatttttccgtattgatttgtgggattagtctatttattttatatacatgtaggagcactaattctttatcagttatatccatagggataaacagttttatgcctctgaaagctcccttgtagtattacatagaactataacatcactgatggtcatacttatggcaacgtagacaccgtggagtggcattaatataactcagtttaagaaagagggaacttgtaattatatttaagaagatacttattctcaaattctaatatgtacaaaaataatttcatgctcactattgagtcatttaaaaaagtttattcccaacacgaataactcaaatagtctgagtttaatgcagtggtttttagaaatatagttttatttgattcatatttgtggcagtacagcttaatatttcccaaattcttttatctaaatatagcttaaaagcccaaatgaaaaattcaagtaatatagagaaccaattatagtaattcatccatagaaggagatttccccatgcatgctgtggtttcggtaatttctactaaagtgtgggcacacagttttcctctaaccctgctgtctccccctccttttttaagtctgtcttttcctggtagaaatacatttttccaggaatgttttatcttgaatactctgaccctacagagtaaagtaatttagcagaatttctcacagagggattaaaatggatattaaagtatccacagaggatgaaagtgagtataaagaggaatcaggcatgaaagttcaggaatggaaatagatgaatgatgtttctattttatcatccttgtaaataaaacgaatatgcttttggctttcatttactatacaaattgattgttacaggataaaagctgagaaaattgaattataatttttgagaatcagtgaatcagcagcatcttttaagaagttagtggaggtgttccagacgctccgctgagtttactttccactaatctctagggtgtgtgcaggatccctgtgaaaataacgaagtgtcagcattttagaaatttatatacgtatgctctttcacatccgggtggtcctggtaagatggaacactttatctttgagcccattggtcttctctttccataggacattctgctgaaatgtcccgtgtctgtctccctcttttctattacacactccttccccatcttcccttgctccaccctcccctcccccatgtctcaagtccagcatttctgacaaaagtgggaagggttgtatcatttcatccacatttgattgtgaagccatttgggttaaggtctgctactcaccagctatgactgtaacatccgatattagttaaatatttattgatacttccaaagggccagattccacccaaaacttttttgcattttcccactgaatcacgaagtagaattttattacattttatagacaaagaaacaggttaaaacgtggccaaggatttacagtaaccagtaaccagcagcaaccagcagaaatgcaactcagtttggggttagggtaacatgaaaactatattcacacactacaccacactactgtgggcaggttttaaaaactttgtcttttgcaaaccatcaccatgcatagaataacaattgggaaagtttcctttccctgctcctgaggtaactgtcataaagactactaaattgggctcacttcaaactggacagatgagtgtcttgctccacttaacttttagaatgcccgaggacctgccacttcgcccaagagctggaataagaggtagtgagagagaaattgcctaatcctctgctttttatttttaacccagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcagggtatgtgaggcctctgtagctcagagctggtcagatctcctagtaggaaactaaagagctaactgtcttatttattatttattttgtaattactgagtttaacttggtaagctgtttggctccttattagtcagacaaggtgagctttatacttatgaagggatgagtaatatcaacaagctcaagtgagcactgaatattctgaagggcaacaccctgcctacttgttgcatgcattacttcctcagtttcatacaacctttaggcatacccctgctattttccatttgtatctcttgctaacactcttcccatcaggatctgaagaccatgggctggaaagaaatgaagattacacagcatagtagtgtttataataacacataatagtaacagttattatcatgcaactatgaagtgatacataattacattctctttgtataaaaataattcagacattataaataaggctggatagcctaacatcaaacctcttattacccactccactatcttcccatcttcagacttctgttgttaggtaggtgtgtcttccaaaatgttgtctaaataattaatatatatattcacaggcctagaaaatatatattgtagttgatttaaaaactcatacagcatcatttgcaactttttgttcacccacaaggcacattcacatatgtctgttaagacatctagctaacctcattttatttaactgctgtataatccattataagatgacttttttctccttatcttaccaacagtttagcatagtaatgtccaaacatatttattagccacataataatctttatttcttcaaatatactgcatatgcaaaagcacatttattgctattatatttgaagcagaggtggggcttctgcagttctaatcccaaaagcatgctgtccagtagaatggtatccacacttgtaacttaaaatattctagtaaacacactacaaaagcaaaaagatgaaattaattataattttaaaaatttatttaaccaaatgtatccaaaatatcattttgtggcacactatggtgttttgtttggcacggagcctaaatctttctctctctttctttctgggtgtgtgtgcgtgtatgtgtgtgtaagagagggagagagatgcctagaaatatgggagggggacagagaaaagagatataagaattggaagagagggcaaggaaggatagtcagccttttaggcccataagaaattagatcatttttgtactaacttgtgaaataaagtaatagaccatgagaattgtattttcaaagcatttggtactaaatcccactgtaatcctcaagatatattccctcttttgccatttttctgctttgctggccttcacatgtttgtcacaaccattcacctaggaggatgagaaagtttatagccatcattcacttactaattcatgagctgtaacacacacacacacatacacacacacaattttagataaaatgtcgtatctttgtcacataaagtgtcatttctctatctcgacatttcaagtagtttgattagacggatttcacaccacttaaaatttaggaggagagaaatgtacagtatgtacaaattgttatttttaaaatccttctccattcagcacccaaatggcttcattttgcacttaaataatttcttggttttctttctgaatgtaatgattgagtctactttaaaaaatcccttgtgctaaggaagataaacaataagacaagtagaattgtttctttcccaaaaaatttgaccatacctccttccctcccaaaggctgcaaagaaagatttttcttttcccaaaaacaatacagaaaggatcctgaagggtcaaattctttatcatcttgtctcttggcagtcaatacatatttaatggtgatgttggtatccgagtgcttgaggccagctccaggcaaccctctgaagtagacaaagcttgttcttactgtattccagcctcagctgtcaggacctcccttttctgttggagcaatctacccctcttccatgaaaccattttttttttttttttgcttcttcctgaggcttgtccattgggatctgttaggcacataggaattttctgattatccccacaaagtggcttaaaaatatatatgcaaatctggcagaccaacatatagtcatttttcatttcttacagtagttagtgttctacaaattcactgtgaacacgaaatttgtgaatcttgaatcattgcttctaggagaaatacagggttaggttactgtgagcttctggccacacttttatcaactgatcaatacttaaccttgttttatgtgagtttgtgttcaaagacaccttctttaatatgtattgttttttgggggagccgaggcaggtggatcacctgaggtcgggagtttaagaccagcctggccaacatggtgaaaccctgtctctactaaaaaaaaaaaaaaaaaaaaaatacaaaaatcagccaggcatgttggcgtgcatctgtaatcctagctacttgggaggctgtgggaggagaattgcttgaacctgggaggcggaggttacagtttaacttcacgtctcccaaactgtgtatcaaggtgccctggagcattgccagatattttaaaatttcaagggtagcacatagacatctcttgaattctgtatgaaatatgttaatcaacgtagcctcttaaggtgtctagttttattaattagaaatagttcagtatgattaaaaattggtaattctgtcttggttattcatttatttgctgaaagcttattagatgtccaaacttttggagttgccctaaatacaggatgaacaaagcagacaaaagtctctaccctcacaggatttctattcctctggtaggagacagagaataaacaaggaaatataatgtcaaacattatgccacagagaaaaccaaagtatcctaaaggggatagagcttctggtgggcatggatctcatgaaaggaggtacctgggtggcatttgagaagatactgggagaaggaagaagaaataagccctaacggtactcaggtggagcatgtttccggcggaggaaatgtcaagtgcaaaggttggagccaggaacttgacctagagacctaaggaccttattgaatgagttgggagccactggagggttctgagcaggggaatagtgtgatctgacttagaccttaaaaggaccaccatggccatgctggtgagaacagaatgtatggggcaagagcagaagcaagatcagttaggaacctccagaataatccaggccaggccagacttgctggtcgccaatcactcctgactagggagttttttcattttgttgttgttgttgttttgtttttacctttggatctctaatttgattttctagtctgcagcccattccagtggtgttgagctctgttgggaaatcctacctcatgcatctctcaagctctcctgccaacctatattctcagccttctcccagtgaaattctcatacacatttgggccgtttctttcaatggttcttattacattttatgaaaaatgagaaaatactgaaggattcagagtcatttcaccgggactcatttgtaaaatttactcaacaactcacatgtccaggtgaaatgactgaatccttcaatactttctcactttgtttctctatagaggctgttgcagaggaatagagcaccagcagcaggtgaacgggtcctgttttgcaactgacatgtggtatgaccctggtcaagccacatgatctccctgggcccctgtaatgggcacaagttaatctcatagacttttaggagagaatctggagtctgaatacttggtgccattttacagatatgacccacttccataacaaaacataaaatagtggaaccacgaaactaggagtagactttaaatagtttctgtttattgaaaaaagccttcccaaagagcacatagaactttcaccctcagtctctatcctccagtacagcgaactgtttattttatttattcctttaccctgtaacactatctaatgatagaagcgtaatcttcctgggcccatttgcagaccctctgtaattttccatgtttcctttaattcatggaggtctttgaccaactaaaaaatagcactcatagttttaaaaatgtgtaattcaaaaaagaatgccacgagtaggagacacactcacatgcaattagcaaactgcacatgcacagaactttttatatggatgggctggatgggtttgttgcgtgtttaaggtacatgtaaatagcttaagctcatctatttgcctggtggtatttgtgatggttaaaatcatgggctctgaaaccgtcaacttgttgcccgcctccatcacttgctaggtgtgatgctttggaaaatatactcaacagttctgagcctgttcacacacctataaaatggtgattacatttatttcattaggtttttgtaaggatcaaattctttagctgaatgcctgtcccatagtgggtggtaaacaatgattgccattattattgctgttgttgttattaggtgttatattttattattaagcacagtaattatcaccatcatttatgaatttagttaatttttatggttcctaaagcattttcctatacatctaagcttaggagtcctgtggggcagaaagtgcatatagcaattataatctccgttttatgagcagggagacacagaagtagtgaaactaagtgacttgccaaagacatatagcttgtgaatggcagagttaggtcaaaacatgcaggtcccctgagtcctcgtccaggttaatacctcttttgattttaatgtttttctttattttggttcttgggccattgtctcttgaataaaaactcatcattattagccttatgctgccaggttgggtttgtcattgactcatctactgaatgcacagatcactgaaatgtttgggcacagtactataagaactgtcatattctgcttatttttgttgaatgagatttttcgatttactttttctctttcaagaacttatgacaaaaagcgcttgtaatcttgtcatctcatctgtcagctgaatttaccaacttgctataattgtcccacagtacactgcaaaagagggagaaatgatcagagaatattgtctctgtccacaataaaaatacaaccagttacttgaactgggctctgcctactgtagccctgctttagttaataaaatatgagaacaaaacctctttcttctctccttattttaatattcctatgaaagtaaacatctgtagatgactgagtgaatgttaataaggttgatggtgagagagaaggaaaaacaagagtgatatgccaaagcttggaaaattactaggcataacgtgctattggcacgaaggaccccattttatgcctgtctgaccaatctcaagccttcatcaataaccacacctgattaattacactgtggtagccaaagaaaccagcagaataaaaatgtgcccttttggatggggaatgggcaactacatcatcggtattccttgtggtctgctcttttcttttgaaagacaaagccctggaatgtggtcctactgtatgccaagaggcagtctgtggaagaccatcacctgtcaggctaatctcacactgattcactcactcacttttgtgcaccatccttactaccgttcgaatttaacctcatagagttagcaaagccttagagcaagctataacgtctcatgcctcagttttcctacctggaaaatggagaaaataatgtctacatcatacgagtgttaagaaacctgcgtgagttagtgcctgtaaagcacttagaaaaaacgttgacagacacatacatggtaagcacttaatgcacagttatctattattattgccattgaagatggaaaggtgttttgttcctgggcttatggattctttcttatcttttccttatcactgactttatagattggaaaggatcttgatctaactctactctttttaagcaattttataacttcagttcttgctaaatttgtaacgtgaataaactacaacaaaaactaataatgagaagtatgtttggagtcagacacacctgggtgtttagatctaacttctggttctttattaactaatttagggatatggggcaaatggcttaacttctttgcaccttgtattacttacctctaaatagagaatgatccctaatgtcactgctcatctgagctaaattgataatacatatgtaaaagttatttaatcctttatgggtatgtggtaatcagtagcttcatttcataaactttgttgaatgaattgatttaaaaatcctaataataatgatgggccaggcacagtgactcatgcttgtaatcctagcaatttgggaggccaatgcgggcagatcacttcaggccaggagttccagaccagcctggccaacgtggtgaaaccttgtctctactaaaaaatacaaaaattagccaagcatgatggtgtacacctgtaatcccagctacttgggtggctgaggtacaagaataacttgaacctgggaggtggaagttatagtgagccaagatcccactgctgcactccagcctgggctacacagtgagaccctgtctcaaaacaacaaaccctaagtaataatgatgacaaacatttaaaaaatacctactctgtgtctgatactatacagataatacattgcctaatcttcacagcaatcatagaggtagctactattatcaacctcaatttacagaggaagtcaaactaagagaggtaagatagtttatttatgagcacataggggctcatattcaggcagtcttgactctagagcctgtgcttataaccgttataccttatggctttgtgaccaaatcagatattccatcaggtctagcctttggcctggagataatcaacttttttgtttatagagcaaaagtggcattatagaagtataggtgtaaattttgttgttgatggatcttttctttcaatagatttggatgggtggaaataatacacagatatcatttttcttaaaattagcatatcactgcaagttagacttactatacctgtatgaggaaataataaataaaatatattttttaaagtaaattagggcagcttgatttttctgactgcattccggctaatactcacccacatagctgtgtgggtgctatgtaggatgctataagctctgtttgctgggggatatttagcctttgcaatgaagtgtgtggatgggggtgaagattatcaatttaagtatgctgacttatatctttttgtctttagaccccagaagaactagaggatgattctgactttgagcaggaagattatgatgtgcgtagcaggacaagtgttcagactgaggatgaccagctcattgcagggcagagcgcacgggtgagtggacacctaagactttggcttggcacacagggaccgtgtttactaaaatggtttgagggtatttctaaactccagacacgtggtaccccagagattcatgggtcagaaatctgtgctctcatctgaggttgtttatagcaaatcacattttacacagtgaaaataaccaccactgctcctgattcctctaactcctctcttttgctatcactggaaacatagcaaccacatcacagcaagcttttatgtgtataattgattttgttgggtttgggtactagaattagatgatagactgataggggacactggaatactcaaattttgcattggcacagtcaccattgttcttcctgaagtctccaagcttgtcaacacaagaggcaatgacaaatgaggaatcagggcactactttgtttatagctgggctgttgctccatacaatggcctatgttctatgatatctaagaccgtatcttttgaaattggttcaaggccattagatagagaactttttctttcctcatgatgcctgtctactcccatggtggtattcctagatctgtctgccatatgatagaaaaatagagacaaattagaaatattcaagtttaaggcaaggatcaggaagcaacagagagagtaccagctctgcctgacatttgagtactccatgatactgttcaccaatgcatttggtctaaagagcatcctaaatttggatcaatctgatttgctgtatcacccagagagtaggtgtacgtaatcaaggccggtggtaagagatgaaatctttagagactgcataggacgatgaaattttcctccccttaagggctcagtttccaaagagtaaaaacaatcagattatagtataactgagaattagatattctaattttctttgttaagttttatttaaataaaagataatgaatagaaagcaagaggttgagaaagagaaggtaatttaaaatagaaattgggaaacgccagaaagcccacactgccttaagaattatgaaagaaaaataatcagaggttaaaataaagaggacttgagggagatgtttagtcaagaaagactttgtgtctaaaacccagtttctcttatgtgctttatgccctgatattctcactcaacaatcaagtgacccaaaagatataaacaaacattaataggagggatgtgaaggttaaagaatattaaagacaaagcctttgatttcagacagatttggttttgaattataaagggcagcattagaaccatgctcaaagctacatgttgcttgatttttcagtttcagacctctctctaaaatgcgaataacagggttacctgataggattcttatgaagatttaattacttaatatttgtaaaataataggcacaatattagacattcagtaagtgctcgataaagatgaccgtgataattatcatcctttctaagagaaatcctttccgatcacatgatggtgggacaacagaaaagttggcatagagccccctatttcaaaaattccttgcagactctatttaatcccccctaaaatgttgaaaattggaaaggtcagtaacttgaaaatcttttgactctgtgttggcaaaacgtcagatgaattaaacagtcaattcatcttcagaattaagtaaaaccagcattgttatgtcactgacaaagggcaattttgagtaattcatccaaacatgaagcaattcaaagtcaatttaattgactaactgcaactcagtatacatacagcctagtatccactgactagttttcttaaagacaaagacaggttgtacaactcatcttgctttataagcaccatcttgtcaaaatggcatgaacagtcccacttttacaaggaagaatagagtcgcaatatacttctgtttcattgggaacctaattctagtctcatttacattagacttcaagtcaatgatgatgggtggaaatacaatttggagactcctgtctttatcatctattatttcttcacactagtgtcttttctgagagtttttttcagcatgaattataaacagggtccaagatagtaagaacagagcactcctacaaattcagcacttgctcatttgactttgaggtctatcatgtggtctgtacgattaagttgcagcagacagcattacttactgagtcagcctattttagcctgtaattatatgatgacaaatcagagacatggaattatggctgttaagttggaaataagagggtgcattgaattgctgaaatgatagatggtcagacttttgaccagcaaagtgtgctaagttggtccaaattttgaaggaggcgaactttgtctttgacagaggcatttgctcttccctgcagcaagtcctcccatgttaatgatattactttgtgttcacatttagagaaagtctccctttctaaaaatggtaaattaatctataagaaggtttgagtgggagataagcttttagtaaccccatccaacattgctctcaaattctggaattaaagtatttcaaaaatgtcctttatatgcccatatctgctgcttgcctacaacattctgagggagaggagatagggggcggggggcggtttaggaggggggaatgaatgggaatcaatatggatggtggtgatctgataaaatatggaggtgatcttaccctttgatcctagacatgacataatataaactgtttctccacagtctggcatagttaaaataggttagtgacaattgctaggcacttaaccttggtgatacaatatattatttggagtcacacagacctgattttaaatatggacttagtgaagctgtgtgactttggggcaactttcttaacctctccacacttcatctcctcgtatgctaccacataaggtcgtagggagaattccatgataaaatgtatcacaggatttatcatataaatatgtaataattaagttggtggtaatggtgatgatgcttgtggcttgagctaatcattcattagaaggctgactaaataatttcacctaaaagagttggatcattcaggcaatcatgagagtttttacttgagttaatgggacaactacctcaattttccaattcacttcacagctagagactggtaagaatcaaaggacccactccttaactacttattatactgctttaaagtcaagtaagtagaaacaggcacattgagttttagtccctttaattgttatttataaacattcttgtacttgaaacttaatgttagcctcttgctctaggctaagaaatgaacacttgtcagtttggggacccatagacgttaaaaatcatttttttctctggaaattggaagataattatatcaaaatctccttgagatttaaattgaagaatggattcagtgctatctgaatggttgtttccttttatcagtgattttcacttttagtgtaataggtatagtttataacaatcaccgaaaaatggttggtggttcagaggaaaggctgggagggactctggggtagggggaaggaatccttttggattaatatctctgataccactaatttggaaccccacatcaggcagatcaacaatttggagagctgtgctttgctactgtgaaaagcagaaacttcaacctgtcctgggtaatcatatcatacaaacaaaatctgatatgttccctttcctcttggccatgaagataatttttctcatgttcccttagtttgagggaatgaacaattgcatgttatgtattttatattgagtttgatttcaatgtagctggcttctatttttttctagctagaatggccttaatgtgttaacatttcaaactgctgagttacattgataagacctaattaaaactcatgtgttgaattctaatttgattaacttgcaaatttcacagtttgtgatctactgtttatagataacctttttttaaattccagtttcagaaaaggtcaattatgaatttttaaaagcaagagcattttaagaatatttaggaagagacttcagctcattgatagctacataagcagaagcaaatggaaagatgctttcacccaagtcacacaccattaagtgtattatgcaggtcgagcacccctagagtcaaaataatatcttcctttgcaaacttgcattggaggggatagtttttcttcagaattgtgtccttagaatgtgtgtgtccgttctggcaacttctcttgaattatgttaatgcagtgagtggaaaaatgtttaagcagtcaaaagatgtttattaagcttctactctgggcaggatatggcagcctaaaccctagggaagcatataaagaagttagcagtagggcattaataggaattaattagagagcaaagcaaagcagttaatattcaagtgctaaattgtattatggagatgcaagtgctatagttgacagagaagtatacacttttcagtgcacaaattaaccttgtgttgggacaatgaaatgtgcattgcttttcatctggggattgaacattgagtctgggagtctgctggtagttttacggattctttttcagagaagcacctagcgaatgttttaaatgatgctggtttaggacctgtgaggtctaagtaaagcatgattcgctcttctgtatgaggaggacaataaaccaaaaacagcaataggtcatcagaaaggaatagttaaggaaaaaagtgcgtatataatttctgtaaatcaaacatatctcaaatatagtggaatagctgtcttgctatgaacacaacattgcaaatgtgagcttacaataaactcttgtatatcaagcaccttttcaaatacagtttttaaagctactttatctttcaagatatagtattttagatatcttaatagtattcatacaagtctggatttttaaatatggattaaaatttacacgtacacacgcatatccaaacatacatacacatgctatttaaagccacatacatgtatccatggaagtcagtagatgtggctactagtaagaagcatctgggcagccacgggttcaaggatacctttagtcaaatcagacaccataggcaactcatgtctatggcatccaccaggatgcacagtgtggcgagcagtgctagtgatatcagtgacccttgccccacttggttgaggaccccaggacagtgggtaagttgcatggccaggcacaactgatgatccagttgtgtagagtggttaagaatgatcttagttcaggtgggtttgaatcctattcctagagcctattgtgtgatattaggaattctatgaatttctctaggcctagatattattattaaaatggggatagtaatagtatcagaatgattaagtagattgttatttgacatacataagcctcagcacagtacccagtacttgtggatatacataaggaatcataacaatcttctatttgtagatagttgcatagaccccgagcccatccctttccctatagcaactaagaaatgagccagaggggtagttggaaaggcaaattaatggcagcagttataatataatgttaatgataattctatacatgcttactttcattttatttgaaaaaacacatattatttaatttgctgcccaccatcaccttttgaggtaattatttactatgcccatattctatctgaagagatcaacgatagatccatgtaacagtgaagtcttaacccatgtcagctacagagcccctgttgaacccagttcttctgagctcacattgcctgatacctctattagaccttagttatagtccttccaaatttattcgctcacacagggagaagatttataatttaggaagcatttttcttgtgttattttacttgttcattgcagaaactgcagtcccccaaactgtaccctcttggtctgtcttatggaaaatatgtgcatcctagaagcaggggaattggaagtacctattcacattcccctgtctgtgaagcaggttgcatacagttttgggaggatgtgatacggtgatgacagacatttcattcggggcttgctacctaaatggtgtttaacaaatatagttgattctcattactcctgatagttatgttctataaagtcatcatgaacatttaattagcaaatatttaatcattggtcctaggggaaatacagcagtagattcctcagagctgccagtcaagacattttcttcaactgatcaataagtaactatgtttaatgggtgtttctgtttagacactttatatttttgattcattaacattgaactcacagccaataactctgtaactcatgcctgattgaagcttaactaacacatgtgttttctccataaggcacatgcccgccttctcgtgctcggggacactagacgcacttcagcaccatgcttggagccattttaaacagcaaagttactaacaaaaagcacaaagatatgaaaaatgtagcattaaatagactgcaaaaagtacacttgtttacagtacgagagctgaaaaaggaaggcagagcattgccttgttcaacctcatctgggaatgtgcatgtcacgcaactcaatttttttgctgctctgcccacatttgcaaatgaccacgaaaatgctacaagccttgattttggggttacaagtatattttagagagtaggcaaattggcaaatgaagaatccatgaataagaagactgcagttctcctttttctacattttcttacctagcagttattgaaaatgaacccatgcttcctaattttatcctttatcccattataacttttctgcctacgtactcaaaggctttaacaaggagccgcaggcatgccaccaccctaaaggagatgggggagggctgagagtaggcacaccgtccctggagtgccctgggcaggggatttttgttgggcatctctctgtagacaccttcacttacactcatagaaagtagccccatcctcccccacttggatgctcagatagtgtttaaaattcctatcctttccagcgacagaaggccgtttttctttttttcccttctctgaacagatttcagtgttgaaagaggtgcattctttcatctggtaaaagtttcctgagaccaaatataaaaattgtcaagaatagcttcttttgaacaaacatatgccatcaaagcggcagagaagttctgttattgccagtgcgcacgtagctttggatatctctgtatttttcatatatgggagtgggacggggactttggggagcttatcagcctgtgctcgtggcctccctggaatggagaaagacgtgctttccggaatggcagggtagctcataagcctttgcagggtctggctctgccatccgcagaaggcagagtcaacatacggtctgtacttcctttgtcaccgtcactcacgctttttctgtaacccacgcaggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaaggtgaggcccagagccagggagctgaagattttttcattaaacccagaagtgtagcagtgtgtattagcatgtgaaagcctgctgaaaaattaaaatataccaacgcaaggtggtggtattataaatttacatgtataagtcaaaatgatctgcacttaattcctagcagataggtatatctttttggtcaaggagaatagattcaatgttgtaattattgttgttataattatctaccctaaggcagtcataaaatcaaaccccgagggacgggtgactcatctttggtctgtgctattttgcaatatgcttaagtattattctgaagataaagtgaatgatttgttaatatacctttggaaaaatatgtacctctgtgtgtgtgtgtgtgtgtgtgtgtgtgtgtgtgtgtgtgtgtgcgcgcgcgcgcatgtatacatatagtatgttgtaatattagcttgtgatctagcattaatttaagctcacattttattcttacatattaagaatcagatacaacaatctaagattccattgttttcacagagaaattaaagttgtataagatttatttcctttagctctgagctagtacctttgacaaatcaagtgaccagtcagaattttgtcaggagacttttcttcaacaagggttagtgctcttttctatcattgcattttggtctcttctttaaaagaagatgatatctctgccctttcaacacaaaggacaaaccaagggagagcaaaactcagtaggaacctccctgaattttgagtcagaatatcaggtgatttgggggcaagtctcttactctctatttgcgaaatggtgaaataacacttgtcttatcaacttcagaagagagttttaaaatccaaagagataatgcaagtataaattatgctgttatacagatataaactatggttttactgtagtgtttttttttctggaaaacacacatatgcaaagatgttttaatgatttaacgtggcatttgttattgaaataatgtaagatatatgggaatgtcaagacatcatctgatgggtgacaactttttttaatggttgttgaatgcttctaatgagaaaaggctagaattgattataagttataatttaatatggaacatctctgcgtcaccccctttgcctctggccaatatgtactaatgacatagcttggccctttttcccaatattttaaaattgttttttttacttcagtggaatgattttactgttatgaaggagccctttgagacttttaaatgtcattgtattcattagaagttcatatttgtacatttggttagtctttgtggacttcacacatttatttcacaaagcgtaacagcaggaaaaaagtctgagccattatttcagcctgaaacttctacaaatcagacgattatggcagcctcagtcactgtttctcaaggcctgtgatgacttaatttgcttgctttcaacattttattagtactttacctgatggttattatccagtccattaatagcatcacttgaacaaataatctcagtaaagtgaataatgactctggtcatgttactagttttgatcaggagcacattttataattctctagattatataactgtggtcaaggcacagttatgaaagatatatttgaggggtcttgttacatggtgttaaataagacacatgtctgttagtcaaagtatagttttaaaagtgagaagaaggtgtcttcagtttcatagggatttcatatcattatgctgatttaaataatgaaatgtctagggagctactagttacaatttttcccactgcatgatgagtcgttttgtgttctttttgttagggcaaagggaggagtatagtaatgaatgactggagaaccagagtagactgtgcgtttgaaatgcaacacaggaagttgaggcttcattgctggctccatctgcacagcctgtttttttttttttttttttttgcaaacagacagctgactagtgcctttctttgtggcctctcacctaagttcactatatttgaccttatacattgttattattgcccttccacttgcatattccacttcaaggaggaataattttagctccataactctaaacattcttaagtaccattttctcttatttaaagaatggatgtagctgattaggaattgaaacttggccactctccataatgtgtatgtgtaaagggcatgtgggtacacaataccctggcatttattatcttgttgttttattcttatcactagctaattcattaatttgattcagtaatctcaatgatattcactccattgttattaaaattggaagggttctgcctcattatatgtgtaataacttcttcatggaagataaaactgattaggcctcatgtctttttcccactcagttcttgacttccatctcatggacaatggcagaagcaccatcctgcatggagtgaatgcatgcttttcttttcatgtcatttttcagaaagaaatcgcatgttgctagtcttgtgtcccaataacaaaaggcgtgcagatagcaacagctcaagtttaattgtacagcaaagagcaaagctgtttttagaatcaaacttaagttctaatcttcaacagttttgagactaagaaaaaaaaactttcagagtacaactgactgtaaaatactgagcactagactcaaaaatcatataatcattctatatttcccaaacttgattttctggcttacttcacatgctcagtacctcagcttagggagcgctttactggtctttcagttccaattctctactcatccaggccacatctgctcagtgaagggcaaccatccagcttcctttgcaccaaaagtttcgttagttcctgttttcacaaaataaaaatccttgtgtttgctctccaaggcctacctttcttgacctttaggcttctgtcctaattttgtacatgtttaacatctgaccttacaacctattccaaaaagtacctggaatagttcaacttgtgattctgcagttccacctgagttctcgaaattccccagattcactcagctgttctactgtgctgtcttcatactgcttcagctgattagtgaaatgcagctcattagtaaaatttcccaaacatattcagaagcctctgaaaagtgacttttatggttcgatacatttgcaaataccctttttatgtgctatatctcattggagagtcacatttggtattaacatgttagaggtattgagaaggcataaaaaatacgttggattaactcagaatttgaattttgaatattaactatattaactcagaatatactgaggcatagatttttcaccttagtacttattaccttctcacaaaataaatgtgaattagttcataaatggtgatgtgacagcagtaatgcggtaatacttttccttgactttcttttttggagtgaccacttcacgggaaagactccagatactgacctttgcatcagaattacctatgtcctaaagagagaaggtttcaagaatctatataagtagagataattatatgacttgatgctctttccaaggaaactaaaaacatactccagatgggacaatatgattgctcctgcattaagaacatgagattacccatagcatcttttacaaacccacaaaatagaaaatctggtctaaggtaggaaaacacaagggctgtgggtcgcaattttaaaatggggagatacaaccaacgtggccagtcttcttgtcgatattgtcttccacggataggaagactcaaacttctgacgctttcatggatgtgattttttttttcttttgtttttttgtttgtttgtttgttttgctgttggctatttgtttcttgtttcagtccccacctcacattatctaaatgactgtagctcattttgacttgtgctgtccaatacagtagccactagccatatatgactacttaaattgtttttctattatggtatacatcatgaagtttaccatctcaatcctttgtaagtgtacatttctatggcattcagtacatttacactgttgtgcaaccattaccaccctccatctccagaacatgttcatcttcctcaacagatactctgtacttactgaatgtaaactccccatctgccttccatttctatgaatttgactaatacaggtatctcacatcagttgagtcacacaatatttgtccttttgtgactggcttatttcatttagcataatgtcttcaaagttcatgcatatattgtagcatatactcaaatgcgtttccttttaaaggtttaataatgttccattgaatgcatgtaccacccacattttctttatccactcatctcttaataagcacttgggttgcttccaccttttggctattatgaataatgctgcactgtacatgagtgtataagtatgtaagttcctgctttcatttcttttaagtgtatacccagaagtggaattgcaggatcatatagtaattcttttaaatgtttgaggaatcacaatattatttttcacagtggctgcaccattttacattcccaccagcaatacacaagtgttcaaatttttccacaatggtcaaatttctccacatccttgccaaaacttgttttctgtttttttcttgatagtagccatcctaatggatgtgaagtggtgtctcatggtggttttaatttgtatttccctaatgattaattatgttgaacaactttcctatgcttattggcattgtatatctcctttggaacaatgtctatccaagtcttttgcccattttttagttgggttgtttgtttgcttttttgttgttgagttgtaggagtccttggtatattccggatattaatttcttatcaggaattacaaattcctgataaagaattactattttctctcattttattggtttctttttcactatttgttgatagtgttctttgacacacacaagtttttaatcttgaagttcaacatctttttttttcttttgttgcttatacttttggtgtcatatgcaagaaattattaccaaatccaatgtcatgaagttttctcctgtgttttcttctttgagttttatactttagttcttatggttaggtctttcatccatttttagttaatttttaaatgaggtataacatgaggactgctgctgcttttgcatgtagataatccagttttaccagcaccatttattgaaaacactgcccttttccaagacccaaatcttagcaaaaatcttagtacctttgtggaaaatcatttgaccttatatatatatataaggatctatttctgaactccattctattccattggtctctatgtctgtctgtatgccagtatgacactattttgattatagtaagttttaaaatcaaaaattgtgaggtctccaatttttgttcttttcaagattgctttggctatttgtgttgccttgagagtccatgtgaattttaggatggatttttaaattttggccaaaatgcctttgggttttgatagggattacagtgaatctgtagatctctttcagtagtattgacatcttaatattaagtcttccaatccacatttattgaatgactttccatttatttttgtaatttcaacaatattttgtagttttcagcatgcaagtcttctgactccatggttaagcttattcctaaacattttatttttttgatactgttctaaatggagttattttcttcattttcttttaggatttttttatttactagtgtctagaaacattttgtatcctgcaacttgcctgaattcaattattagttttaccaggactttttttaaagaatcttaagcattttctacatgtaagatcatgtcacctgttaacagagataattttgcttcttcctttccaatttgaatgccttttagttctttaacttgcctgattgcactggctgggatttccggtactatgttgaataggagtggcaagagcaggcatccttgctttgatcctggtcttagaggtaaagcttttattattcaccattgagtatgaataaagtaagctgtgggttttaaaattttcattaagatgaaataaaactgaaacactgtttgacagttttttttaaagctaaaaacctgtggtggtatttctgaggtctctgttatgttctgttggtgtatatgtgtgttttggtaccagtaccatgctgttttggttactgtagctttgtagtttagtttgaagtcaggtagcatgatgcctccagctttgtcctttttgcttaggatcgtcttggctatacaggctttttttgtttcacatgaaatttaaagtagtttttttctaattctgtgaagaaagtcaatggaagcttgatgggaatagcattgaatctataaattactttgggcagtgtggccattgtcacaatattgattcttcctatccatgagcatggaatgtttttccatttgtttgtgtcctctcttatttccttgagcagtggtttgtagttctcatagaagaggttcttcacattacttataagttgtattcctagttattttattatctttgtagtaattgtgaatggaagttcactcatgatttggctctctgcttgtctattgttgatgtataggaatgcctgtgatttttgcacattgattttgcatcctgagactttactgaagttgcttatcgacttaaggagtttttttgggctgagacaaggttgtttttttttttttttttgagacggagtctcgctctgttgccaaggctggagtgcagtggcgtgatctcggctcactgcaagctccacctcccgggttcatgccattctcctgcctcagcctcccgagtagctgggactacaggtgcccgccaccatgcccggctaatttttttgtgtgtttttagtagagacggggcttcaccgtgttcgccaggatggtcttgatctcctgacctcgtgatctgcccaccttggcctctcaaagtgctgggattacaggcctgagccaccgcaccaggccaacaaggggtttttctaagtacacaatcatgtcatctgcaaacagagacaatttgacttcttttctttctatttgaatacactttatttctttttgttgcctgattgccctggccagaacttccaatactatgttgaataggagtgatgagaaagggcatccttgtcttgtgtccggttttcaaagggaatacttccagcttttgcccattcagtttgatattgggtatgggtttgtcataaatagctctcactattctgaggtatgttccatcaatgcctagtttgttaagagttttcaacatgaagtgatgttgaattttatcgaaggccttttctgcttctattaagataatcatggtttttgtcactggttctgtttatgtgattaattacatttattgatttgcctgtgttgaaccaaccttgcatcccagggatgaactcaacttgatcatggtggataagctttttgatgtgctgctggattcagtttgccagtatttaactgaggatttttgcatcgatgttcatcagggatattggcctcgacaaccatctgatctttgacaaaccagacaaaaacaagcaatgtggaaaggattccctatttaataaatgggtactgggaaaactggctagccatatgcagaaaactgaaactggaccccttccttacaccttatacaaaaattaactcaacgtggactaaagacttaaatgtaaaacccaaaaccaaacaaacaaacaaacaaaaaccctagaagaaaacctaggcacaaccattcaggacataggcgtgggcaaagacttcatgactaaaacaccaaaagcaattgtaacaaaaaccaaaattgacaaatgggatcgaattaatctaaagagcttctccacagcaaaagaaactagcatcagagtgaacaggcaacctacagaatgggataaattttttataaattacccatctggcaagggtctaatatccagaatctacaagaaacttaaacacatttacaagaaaaaaaacaccaccttcaaaaagtgggcaaaggatatgaacagacacttgtcaaaagaagacatttatgtggccaacaaacataaaaaaagctcatcatcactgatcattagagaaatgcaattcaaaaccacaatgagataccatctcatgccagtcagaatggcgatcattaaaaagtcaggaaacaatagatgctggcaaggctgtggtgaaataggaatgtttttacactgttggtgggagtgtaaattagttgaaccattgtggaagacagtgtggtgattactcaaagatctagaaccagaaataataccattactggacatacacccaaaggattataaatcattctactacaaagacacttgcatatatgtatgtttattgcagcactatttacaatagcatagacttggaaccaactcagatgcccatcaatgatagactggataaagaaaatctagcacatatacaccatggaatagtatccagccataaagaagaatgagatcatattaattgcagggacatggatgaagctggaagccatcattctcagcaaactaacaaaggaacaaaaaaacaccacatgttctcactcataagtaggagttgaacaatgaaaacacatggacacagggaggggaacaacacacactggggcctgtcaagggttggggagcaagggaaggaagagcattaggacaaatacctaacacatgcggggcttaaaacctagatgacaggttgataggtgctgcaaactaccatgccacatataaagctatgtaacctgtacattctgcacacatagcgtagaacttaaagtataaaaaaaaaaagaatctcaaaaaactaaaaagggatttactacaggacccagatattttgctctcagacatttatccagagacgtaaaaacttgtattcaccccaaaccctataccataaacaattacgtcaggtttatttgtaatagtcccacactggaaactactcaaatgtccttcattgggcaaatggttaaatggttaagcaaactatgttacatctatgccacagactactactcagcaataaaaatgcatgcaatgatttggataaacctttagataattatgctgagtgaaaaacagttatctcaaatatttcatactgtatgattccatttggatggcattcctgacataacaaacttgtagaggtggagaagagattcatgattaggaatatgttaggagtgggttaaatggtataaacagtatgagagaaacttgtggtaatagtacggttctgtgtctcaattgtagtagttacatgaagctatacttacacaagtgcataaaaaatagtgaaagatgaatattccctatggattttaccggtatcaatttcctggttttgctattgtactgcagtcatacaagatattaacatgagaaaggctgggagaagagtgaataggacatttctatacatatctctgaatttccacagaatctgtaatatttcaaaataaaaagttaaaaatagaagacaaacttaaataaaattaaacttagttcctcagccacactagccatattttaagtgttctataattacatgtggctagtgactccatattggatagtgcagaattatagaatgaacatcattacagaaattctgttaaaattgctataggcactcggatgtctgaaggagctttagaatccacttgaaacctatgcgatgatagcattaaaagaacatgctacccttgctacataagccaaattcaaggtcttctcttttaaagatatggttattattccacagttattcttcagctaccagtaagggcagccacacaatctgttatgtaagcaaaaggaaatgagtaactttggtcccctacctccagaaatggcacaactattttttttctatttcccttctcttctgttcatgatgtggggaaactgggtcatgtcactaactttgtgctcatttaaagaaacctgggccttgaaactttcttagaagggtgttgcatcatgctcagaacacatatgagatattcaggatttcccagatgattcaaataattttctttattttacacatgactttaactgcattttagtagttcaaaattttttttaatgtttatttattattatactttttagggtacacgtgcacaatgtgccgattagttacatatgtatacatgtgccatgctggtgtgctgcacccattaactcgtcatttagcattaggtatatctcctaatgctatccctcccccctccccccaccccaagtagttcaaatttttatgaatatttagacaatagaatttggtagttgacaatttttctcatgttatttttctgggtatttttgcattctgtgtttatattttatagtaatacatttacttatacagaatttaaagataaaaggtaataaaatttaaaaataaaattgttcgggaaaggattaacttttcaatgtattgtccagggacaattggttactggttggaaaaataaagagtgtgattcctatctcaccctatacaaaaggcataaactgtaggtggatttaatatctaaatataaaaaggaaactttaaaattttagaataaaatggaaggatattttcaattaccttgggataaggaagagcttcttaaaggaatgtatgaaaagcacaaacggtagtgtaaatgatgaatacatttgactacaataaaattaaaatttatattttaaaaactgtaaaaaaaagaaacctaacatatagaccaagactaggagtaatttgcagtataacaaaagatcagaatccaaaatatctgaagagcttagataagcaatttagaaagagtcaatagaaacatatgcaaaagatttgaaaagacaactcagagaaaatatataaatcattaataatgatcaataaatgatgaagagactcagtctcctctgtcataacagaaatgaaaattatttttttaataaccatcagcttgacaagaaaaagtaaatacattttaacatctaaacgactgaacatatctacagaaaaataaatatgccactttccgcctccttctgggctcaagcaaacctctcacatcagcctccgagtagctgggactataggatggtcttgagcccctggcaagtgatctaccagcctctgcctcccaaagtgctgggattacaggtgtgaggcacctgtcagtatacgactttaattaaagtaacttgtacaactatcacccagctcaagaaaccttcataaaccttttctaagtcccaatacctttattctcgactagttgtaactattaccttgagctttttcaagatctgatgacggtctacaggggaaaaagccctgaactttgtagcatttgctgatgtccaggaagtaaatattcccattatggcagatttcaagctcccaacatttcaactggcttgcccagttcctaaaaacctaacaaataattctcgtatgtataagcctactccagcactcatgtcaattctgtcatttcttcgggttttttcttctttttgtgtgtgtgtgtgtaccacctaagtgagcatctttaaatagttttgttttagttgcttctgggaatatcaatattatgtaactgaatgaaattactttccttctgatattctggaagagtttaaatagcattgagattatcttctctttaaaggtttagttaactcctgtaagaaaccacctggatttaatgacttttttctttctttcttttttttttttttttttgatgagttctatctgacaactttgtttcttccatggaaatcagactgttttgatttttcggaatctcctttctggtctgttttgataatttatattctcctagaaacttatttcatctgttttcacatttacttacatatatttgagaaagcagctttgtgatacatttttttgttttctaaggttattgctgtcttatcttttttacttttggatatttttctcctattatttcttgatagtgttctaaatatattttctatatctttttggtttagagctagttttaggatttatccataatttctagtgttttgttttctgacacattaatatctgtttgtaattttattagtttttttccaacctcttctttctgaattcttgagccatctatttagttagtgttttttgtaacttcgtgtgtattaatgtatgtagttaaggctacttgtttttctctgagcacgttactttagctgttaagaatgaatcatatttagaaaaaaagtgtactaaattatgattcaggacacacagacttccatcctgtttctctctgtgcgtagcagtgtcatttgggcatgttactttgtcttcctccctagatttcagcttccccaactggaaaatgagaaaatatttgatctcagaacttctattttgctctctaattttatgaaatataccctcatacccatgttgcgactccagtaatttgaattgagtctacaacatgaattctaaagtctcaaactttttttttcctaacatactagtaagtctatgaactgtagtctctggtgtaatcaaaaagacatgcttcttttcattctttgtctacaatatgggggcctgagcatcaagcagattcaggatctatatagacattcttcattaacttggaacattttgtcagaatcaatcagctggtggaagttattatggaacgttcatgaggaagcattttccaagatcctttgaaattcttgaaatacacaattgttagcaatgcagaatcaaacagaatgcagtcttattgaatgggttaagatgaagttacaacaaatattgtgtcagagtaaacatcagaaaatagattttctaaggtctagaagttacaaagaaatatgcaataatgagaatattattaaacattgacagattctgtatccaagtgttccttaaaaaataaaaaccatttattttgcgctaataaaaatatgttagggaatagcaaacagattgtcacagaatgtttaactcatccatattacataaaattcacaagtgaaattactgtctgcattttaaaatctaagtagcaactgcaaaatcaaagtactttgtggaagagttaacgtcactacaacaaaatgaaataccttaagttgtgtgtctgtctttgtatttaaacattaatagaaacccagtatattttacttatactgactaatgtagaaaaatccaagaaggtgagttagtagagaaatggaacaaaatatcattcatttacattagtttactgaaagacattttgtcttctattttataaaatgttattatgtaacaatagcaatcattgccctctctgtataaccctacacggtctgaataaatcccttctgaatagtttttctgtacagctcaccacatttctaactacaggaatgtaatcttacagccttaaaaaacacattgatttttatgcacataaagagaccaggttaattaacgatgctaaaaatgataaacataatttattctttacctctcacaataagggaaagaaaagttattacatgctatattttgtttaaagatttatgatgcagcataatttccatttcccttataataaatatttaaaagacatataatattaaacacttcacctaattgcaaaccttatatgaaaatattagggtgatggtttggaagcacaaaaacatttactgtcactcagtgctttgtacgttctttcataaatcagtatcggaagcccacaggccaacaaaactctgaaattctggccaaacagttcccagttatgtgcaagagataattgcttctcaaagtgccaaactggacttaaaatttaaataatagaatataaatatgctggacatgagtaggaagataaagcatatgcatttattttggctagagtctgcttaaaattttgaattttttacttatgacctgtataagcttggataagttactagatcattttgggctcattttattttctaaatgggagtgatgatacctactttgtagagttgttataaagtcagaatgaggtagtctgtacaacagcttttggtacacggtaagcaactataaaattttcatttctcttgtgatgatcttttataactggccattgtttagaaatatagaacttaatgtaaaagataaaatgtgaacatgcacataaaaatgtgggaaaatatttccaaaaacgactactaatatagaaactggagttaagcaggaaaatattcaaaattcgactaatgtggccagtgccaaataaaatacaacactagactcctggacaaaggatatggtaggttggtctctttcccgtcattaagtggatttctaattatgttgtatatgttgtttcagaggcaaaggcccattgaaaaatacatctgatgtcattaatgctgccaagaaaattgccgaagcaggttctcgaatggacaaattagctcgtgctgtggctgatcaggtaatagaagagggaagggtgggcacatgctgagtggagtcactaattagcacttgggttttgtaactagttttatgcaccctataaaatgcctctgaagaatgaatcagaggggagaatcactgatattttacacactggtatctgcctctcctgacactgtgctagtggcaaacgtagatttagctcaggagagaatgctaaggcttctgaccaaaattccttgagaaagaagaacatactacttaggagacatcagcccctgaagagtcacggattgtcccagccttccccattcagaaaggcaactatactgcataatgaaggggggaaaagcaggtttttaaattttcattgttaggctcttggtttaaatatattttcagagattcctacctaatgccctcttttgtttacttcatggtgcttatcacatttaaaaaatatatatttattattgctttacttttattttctgttgcccccaggaaatttaggttgcacattttaactgcctgacagaatgaataaaggagagaaaagagcaacctgccttgtggtcagggaactgaattagcagagctttagggatgtgatgggtcatgatttgatggtttctttaaaaagttgtcgcggactctaccaggagtagaatggaaactgggggtaggacagtcaggggcatttggagatcaaagggcagaaacaggttgcagaatctgggagaacatcatgtttttaaatgtagaaataagaaactagaacttcaccttttcttatttaatatggctctcactctaatgatattcttcataataacttatgctccaccataaacgggattattccacatgatcaagaaccttcagatttcagctttattctaacccagactcagaagcatcagagataaatgaaattctcagagtatctcttaatgctttcaaaccaaactaggatatacattaaaagagttctcaccttgaatgtttatttccatacttttcgttttatttggcttgaattggaactttaaaatcctgttctaaatgttttgttgcaattatggtccatttcttttaagagtgctttaggtagtagacttttccaggtaactaacagttatccctataagcaatagtgatttacagtttgaaccactttggatggattgtatcataaaatataagttttggaaataaaatattatatatgctactatctacatggaaatattaacatgaatttgcttagtatactgcagtacattgatgcaagctggagatactgaaagagaattgcatccttctccatatatggctctagtctctgatgatctgatgatttttgagtctttgtgttgcttattgtagttttcctccctcattcctatatataagggttgctcctctaaatacttactgcctcagcatcccaggctctaacatccttcattcaagtcaataccaaattcacacacctttaaaggctgaaaaaacaaaacaaacaaaacccctcatgattttactatcaggattgcacttaagagtcaagagtcaacgaattctcattttaattttattttacatttaagatggctaatccaagaaatttttttaacttttgacttttggagaaatgcttattggttgagataactcaagtactatgagaatttgagaactgcttacaatttgtaggtgttgagtgttaacccattgctattgcctaatttcagggcaatatcaaccatgaggcttcacagcataaactgagggttttttttgacagacttccataagtattccagaaagttcatgtagaggagggaagagacaatgaatttacttgaaagtatgcatacaaaaaaattaccaactagaaaaggccacattctttttctgcagatgttgagaagagttgggatgtgtagagtgaccagaaattggccatccaccaatttgttaggaaggacttcttgggagtgaaaatgagcggagtttgaatggctgtttcattatactttaaatctcaatggtcaaaagtatttcttggcatctttaggcccttcaagttcaatagttttggttgtgacttttgtttttgattttacctttttgggcttttattttcaactatgcaacctaaagcataactcaaaacagttgatatgtgaaaaacacatcaaacacacacacacacacacacacacacacacacacacacacaccccaggatacatttattttgagattcagtgacagagtatttaaatgctactatttcacagtgactcaaaataaacggattaagtttaaacctaatcctctttgtggcattattattgtcattagctgtgaaataacttgcaatttttgataaagaaatcttcagaaaaaaatgttatcaaattctgcacctatttccatgatttaggagttattttccttgattcaacatgcctttttaaatgtgtattttaactgctttggtttaaataatagaatagaatgagtattatcaaggactggattggttacatttattttgccggaaaatattttataaagatttgagatatgcatgccatataaactttttacggactgttgcatttttaattactgttccattgagatagaactttcagtttaatttgctgcaaggtatttgtatcaaaagccttgtcagccctctggggagatatcattttaaagttaatccctttccgtgtatgggtccctggagtaggataaatattacagtatgaagtacttgtaagaagctaaaaacagtctctgtggaattctttcttgataaatgcagttagtgaaaaaataccacaatggtaagtgttaaatataaaaaatatccctttatcatttattcagtagatggttatatgtaatcactggctttacagtattgataaaagaatttcctttcttgagcttgagggaaacttagctcagagtctttctcccatcctctcattctaaataagatacttcagttgtggctgtaggtacttatttcttatagtattaaggatctggtgattttatgtcctttacaagtaccaaattgatacagaacaattaaatggcctggaagtagctcaagctgaacctttgatagcaaaagaaatatgtaggcatctcaattcctcggtagccattggcaatgaagcctcagaaatgttttcaggagtcatgtcaatgtctctagaagtgttcagccaagctctgtgtgtgcttgatggacacccgcctacttcggtcataatgaaaatccaaactccttagccagagttgactccggtgcgtccatcaaaggactctgttgctactcttatgaacttctttcagctggcttcagatacattctgtcaaatctgtttttcttacagtagtcatgaaccatttcagtctctcatttaaaggcaggttattatgttgcttacattttgataaatattaaattccaaaaagtgtaatagattttttataagtgaatgatacatttattagagaacaaaggaaacaaattgattttcttcccccaactaactggattgaaactgtccattatgcttggcagagagtgccacacaaagtgatttacttttagcatcctttggtcctctgcattaaaataacatttcacatagtgaaagttgaaggaaactgtaaaatatttaggtttctttagagtttagaagacagcaggtaaaaatactcataaacatgtatagaagtcccaataaaactttctggaatatcttcaattttcttctgataaaattttattaaagtagagccaaccattctaaactacagtctgtggcctttctaaaatgcactgtgaaaaagttaagttaaatgaatgtaattaaggtatatgacactgaaaacttttcttcctgcagcttttctataacaaatgttagaaactgaagagtacttactaatcaagatcactcttttaatgttttatagtgtcctgattcagcatgtaagcaggatttattagcctaccttcaacgaattgccttgtattgccatcagcttaatatctgcagcaaggtgaaggcagaagtgcagaatctgggaggagagctcattgtgtcaggggtaagctggacttgggcttcacaatgtaaagttcccaccgttgcacttccaaggcaaacattcttggcaacagtactgctaaaaacaccaaactacagtgatttatagggagggctttttttaaataaatgttatcaccattattccagaccttacaataactcacaaagagcaatttgattttccaattaccctgtgtttattctagccttgtaaaatctccattcttcacaagaaaactaattttgtagtctggaaactcattgccaagctgtgactattgtaattatttggggcttttgtatatttactcattgtgagtctacttccttttgttagtcctagtaattttcattctctgttcaggagccagcctctctatgtgtggattgtgttcacatgttagagatgatgaaaacaataggaattcattcatcaggttccaatgcatactaggttatcagtaacccttgaaagccagaagatgtttgaatttaatacaggttgatgtgctgttgccaaaaactaacataattgtcgaacactaacaattatatattctttgctcaatcactgcagtgtttcctttctcatgaaaatataattatctggtccatttttatcaaatgcatagaaataagttcaatgaatatttagaagaatcacaatttcttggcaagatttccaaatatgtgttgaggttcttcaccttggcttcttctcctccctcaacccctttctctcaacacagggtgccatttgttgcaaattatttgcaagtccagaaatgtggctctgacaccttagttcttttcccagtcagacatgatgatgctaccatttcaagtgagtaattaccaggcacgtaatattatcagcgtggtgaataccttatgaaaatcagactagtcacaaagctcaggtcttcctgaagccatttttggaaatttagaagtttggccatttggtaaaaacacgtgaacaaatcattcttgaacccaactgtttttgttcccatattgtttgagttgcagaaaacatagctgggaaaagaactgatctggcttgcatagagacaccatctggaaagcctgtttcatgcagtcccacctagagcccagtaaattggctattttgtgcctcttcccaaagcacagtcacctctttgcatttccaaaatgatcctgcttcaacattcttcagcaaccaagagcaatctgtcttgcaatgtgtcctttctgccaagctggtaattaccaagattctctcgccaagaagtgatcaaatcattgcatcttccttgctgcctttcttatcttcagccttgatggtatagtttcccataccactcagctttcatgtccatctgtatatagcccctgtggaactgagtgctttttgttcagcttgccttgtgtgctttcatttgttactttccaatcttattatttacatggatgcgcaaagcatctttgtggatctcagactccacaacctcatctgggcaatttttactagcagagccgctctccatcatcctctcagtacccattgtttgtcactgcctccaaagcttcatttccattgtctttttctcatttagatgtagtccaaaccatcactggcttttatcacttgcactgttggcttttatagaggtgtttgagattgggaacaccatcaagaagcctgttcccttctttgagtcttgttggtaaagttcataaatccttgcatgggagaaggcttcttttagaagaatgttgttcaacttgataattattctgaggcaaatgcattataaatatttgctatatatgctctgtcatgggcctgctcttggcttcctcatgatttattccaagcttgattgctgtttggtgccacacctacatctatagtctgctgtctttgccaattctgcctccatctttttcttcatgctccttcactgatggccaatggagaaaaaaaatgaatatgcttactgtgcaaaatagccacaaatgactgctttcaaagttctgaaagagtcaagaatgtgagaccccatacacacacattttcaatgattttgccaagaaaattacacccatttattctgtcatgtggcatggcaaagttgctgttttttttcagaagaagccatcatagtttaatgtacaatcaaaaaagaaatacttaaatcttctttcttttttccctgtgtttatacacatgggattcaaagccacggcttctctgaaatatatgaaagcccccaggaaagttacatttgttagaagtcaacctctctacccaaacagaagagatttggacatattatttccattttgccaagaaaaatgattttgatgtcaaaacagagagccacgtttttagtcttatgctggcatgatgaacatatgttaagcaaaatgcgcaattatgtcttatgtcagcgtgtttttgttttatgtgattctatgtatacaaactgagaaaggcctcttgtcttgtgtctgcttttggcttgagaggtggggacagataattcaacaggtcacggaggagaatggatacaaaagctctccaggcatcatgacggcgatctggagaaataaagcagtccaggatgtgtttctgtgtatgctcatccacacaactgctatctaagaaataccattggtttcctacctggcaattaggtttttttttttgtcattggcttaaacctgtctcaaccaaaaagtgacattcttattaaatctcaaagtagaaaatgcatttgtgagccaattcagcttaacccggttactaagggagtaatggaaaagaaaaaatatgatagaattgttaaagtgaaagtagaggaaactgagtttcagaagattaaaccgtctataaattggctttatttatttgcttagtttaatgtttgcttgaattcttaagccagtttacaggcttttttgagaaaaagaatattgaaagcagaaagaaagataaggaggggaggggagggtagaagagaagaggcataaaagaagaaggtagaagaaaagaaaaaagaaagagaaagttaaagataacatgtcttgaattagtttagtgcaagtaatgtccattaaatgtgacagcattatcttatgggagaaaagttaagccatatattttttagtatgtaaatactattttgaatacaaatatgttccagtatcataatatgggtattacctgtatatttaattatcatgtttttgactaatttttgtttgctaggtttcacagggtttaatcagcacctttaaagttaaaaatggagatgtatacatggatctggaaaaataaaaatcattccatgacctttaatattttttagctacccaaagatttatacagagcgtatgattctgaacaatattagaaatactaatgtaggacttttaaattagcatactgaatatcaaacattctgataaacctaataaagcctacctaaactgtttttttaaagttaaaagataacaggagcttcattataacaatgaagtcagaacataacagcaataaccctactttgatgaggaattcaatgttcaggatgtaatttatggccaaatgtacacaaaaatggtacaaattttaatagattttattacatataaatgtctctgtattaacaaaatatttgagtcaagtttggaggtgaggaatgctagttgcttaagtccttgggctgaatgaatggattactgacctattcctgagagattgagaagcttgccctaatatgtacttttgttctttgccatttaaatatctcttttccaaatctgaattcctctcaattgggtttaggggagaggtttgacaaggtgagcaagtttaacttgggacactggtaggatttgaattggtaaagagaagattggagactgaggggtcaattatagtaattcttattgcccacgtttcacattattttaaaaaattggactctaattacaatcaacatgaatattcatgatataggtaatatacattcctaaaaatgttggaaactgataatattcaaatcaactctacctgacactgtcatatattcaaagatgcatatgtgcatacaaacatacaaacacagagcacaattgatttgatatttactcttataccctcaataaaccttagtgaagtggtcaggaactgaacaagattgataagtataaactatctgatccaatacaaattagggaaaagaaaatgtgggatatattttgtacaataatatatatatggtttgttgagatgagaattacattgtatttgaagagcgttgtgttccttttatttttaaaaagtgccagtattttgtaatgagctaaaacagccattgaaacaagaattgcatctaattgtgtagacctgtacattaagcaacctttttttcttaatttttatatcttctattttgtctatagtcaattcttcatgatctccatggatcaaagtgtaacagtaatgaaaaaaatctaaagtgctagctatttcaatttgggtttggaatgcatgttagtgtttcatttgaacaaaagggtagatgttctaggaattcatagcagttcaaaataattttatccagaccttccgtgcttaaaggaccttcccttatgtaggaaaagttgcagtgtccaaacctagagagagtaagataaaaacaaacttcagattgtaaatctggatgttaggcatagtggagaaattgtgacaaatgaaatgagtagttaccttttacagagtaaatggcagtagttctttgcatatactttgctagtaaaatgagttgttgcatgattccatattttccccaaaatccattccccaatctgttgatagtgaaactataaccatttaaattctgattcctgcattaagtcttccttagttacattcataccagtatgaatggtcattgatttctgcacaacccaaattatagacaccctcagagggaaataacctttctatggtttttttcactgaacattcattcccccagagtgttaaaagtgacagtttaccaattcaagacttgtttttggaagaaatgggaagttaataggaattttaatgagaaagtaaaaatttctttgggtgctgggcatcatagaaagctttgtgtcttttgcactgcacctgtgtctgttctctgaattcagacagtcttgtacgaaggagtctggtatactgctccactatagaaagtgactcttcagttacattttctgtgatggtcaccctaaacttaccaatataatcagttatggccattaaaaaaaatcagttattcattgatggaattaaagcagttggttatctaactgaattgtttaatgcatagggaaatactatgttccaatatactcattttaaaataagaaaacatactgtgttgtggcaaagctaggatgcaaatcaagcaaataactcttcttaccttaactggagacatggattgaccttaattcgatctactactctgtggatggatttgattgtgtcacctaaacttgtgggctgacgagtaatttctattttagtttgagggcattactgcttgtaacagcaggagttagtagctttaagaagagtgtcccctgagatatcagtgccattacttgtcattcaatcagtaaaatttcattcctttgggtcttagaattttttcaagttttgagatgctctaattaaaagaagaaaggtaaataattgacaacttaatttattatcaattaatgccttagatttcagttgatattctgagaatgatttagtagccaattagcagtaatactttttgaaaacttggaaattggacacatgggaggtacctggatgaggggaggtgattgcatatacagttggccttctgtatctgtgagttctatatctgagaatgcaaccaacctgggattgaaaatatttggaaaaaaataaaagtaacaatacagcaataaaaatagtacagataaaacacaatgtagtacttatataatatttatgtaacatttgcatcataataggtataagtgatctggagaggatttaaagtatacaggaggatgtgtgtaggtttcatgtaaatactatgccattttatatcagagacttgagcatccttgaattctggtatctgctagggtcctagaaccaatcccccatggataccaagggatgactgtatcttgggatatgtgtaaaacccagacaaacctatttaagaagtattattttataaagcttccccataagacatatcctaattttgactacttgttcatatatgagaatagtctgatttcattccaagattttttttaaataatttaaaaatacttcaaataatgtttcaaattattattgctttgagaagtgtcttaaaagctaccctctccccagttttgaaccagttttggatctgtaagagcaaatccaaatacgttcaatgtaatgtttccttacattgaaccaaataattatgggaagccaaagtgttgagtgaagacctttatttagaaatggtgtctgtaaattcagcccctgtaaacacttgaatttttcagttctcagctctagtcaagaaacagattatttagaattggttacttaaatgcattgtgattttttttttcttgtttctactggggcttaccccaggaattcctggactgaagtctgttgaagaaaaaagttgatatgtgaacaaggtgatataatgtgaataggcaaaagagaagggatattgaaatcatatgctaaagattatctggggattttgtcattgattttacacatctttccattaccttagctggttaaaaataagatagaatccatagcaaaactgagtcaggatttttttattcagtactggatttgataacattttgacaataatatttttcttaaaatacatcagtttccataagtcgtttctaatttccaatggcaaacaatcagagattcaaagagctgcatttatttgttgttcacataagaatattttctgattcattcactgaattcaacatttccattgcatccctactatgtaaaaggcacggtgatatattttgactgagttgggaatttaaagtctctttatctctaataccaaataattttcatgaaaaggataaatttttctgtcccttgtgtttttattagactgtgtagtctatgtttattttttttccatttagtttctcagcttactgaaatagggttttcagctagaatagcagagtatctgttgatggctatttctgtgcattcgttgttttcttggtttactatatgctagaaataaaagtgtgtttaacttactgttgtctacattctgtccctgcagattattttgtcaagtgctttttccagcctaagttaaatcatttataaaatatgactttgagtgcagcccttagaaaagaaatatgtgccactttatggcccatgtatcttacaaataagaaagtttccggatgggcaatgtggagtttctttgttcagatttcttttactgcatcggaacacattgtcttactctatcttaaatagtaattttccttctgggctataaatatatctcaaatacttcatcctaattctattttcttgaaggcaagctttcttaattcagacttttaatcttttcttttatcatcaatactgtatcttgttttattagttttctctgaacaccttcatctgtgcagatgccttgctgataatgaaattgactggaactctggctagatgtcctgtcaaatcggaacaacctgtctcttgacctctttcatccattttctttggcaaatctcttttgcaactgagaatatcctggagaagttatggtcaacatcgtcttttaagaaccatgtacgtttgtcagcccaaatttctgtatgtgagacgctaccataaaacaaaatcaaaacatctctttatccgagaacttccaatttgaatctgctgctatccacatttattggagcccctcttattgagatatttctcttcaattataacattttgatcaacttacatgaaaaaaatgcctgaccttgtcttccatgatgaatgcatctgcagattgttcttttggaatgcacatgttattccacctgacttttctcaatcttttgtgctaagaagctaaacaactttttattaacctcaaagatttgagaccagccctacatctgtctggtcagaatgaaattactaccgtgactataataatggagtcttgactactgaaatcttgcaaacacttcatatcttgtcttaaagggctacttacccatttctgaaatatcatgggaagtatacagctaatctacagttggagtagagcttagttttcatgaaaaatgtcaagaggctagatcctgagatttggaaattatctgatcctggcattgcatcctgtatcaaaggcagttttattattttaactaatatcatatataaaggcattattataatatcacaatcaatcatactaaattcacctaagaggtcagcacagttcaccactctgcatccttttgatgcagcctagttttgcattgggttcctgaagtcattttccatttccaaagagacaataggcaattataagaaatgccaatagacaatctaagttcagtttgttttatttcaatattttaaaagtgtttaactccatttttattttaatatcttaatgctgggagaattgtaccatctgtattgggtagtaaaaacttaaggtgtttattggaagaatggacaattgcatcattaatcttaatgaactttaaattttttatgagatgatccaagtaagtttctaatacgtaataatttttaaaactgagaaattgtgctaagtgactaatttatttcctacaatgggaaaaatcagaaaatccctaacttataaaaccaaatgagattgttataaaaaatcaaagataagccaactagtcaatgatccaatatgtaaaagtggagagaaaataaaacttcatagggccattaattgcaaaatctcacacacaaaaaaagctgttgaatatataatttgaatttagacttagaattgttgaaaataaaaataataaatgatacagcaaggaaaatatatgcagagtatcattgcctcttctgttaagtacagaaaaagtcaaatataggcaaaacacccatctttttatatgcaagacttttttttcttttctatttactttaattctttaaagacattctttaaatgtctctaacatttattttgaagtgaaaaatggacatgatgttgccaaatccataatcagtttgaatttagtagcttctgtgtttcaaactgctctctcatctgccaattttgcttaattttaaattgcaattattgtaatacacttatgtatttagtacgctaagaatgatgggcttagaaatagaattatattggcttaaaacagaaaaatcccaaattaagatttttgtttatctgtatatagaaacaggctttggtttttagccatttatgatgccataatttgcaagctattgttttgaatgtctaggtttcctaaatttttttctgtggaaagagatggtttcacttttcatgtattccactagtcagatgaaggccttttatgtggatggtttcaggatgtgcctgctcttcaatagtgtctgttacttttgttttgccataatcaataactttgagtattctattttaaactcctaaattttcattgaaaaaaaatactttagtggtctacatactattctcatgccttttcttgtttttctatgaaaactagacttggtaaataaagctatgactagagcagaaatcgtccatgacaaaaacattttggtcagttggcatcactgggtcatgtaacttgacctctgagagtgacagtgcatttttttatgattgcagaaaacttgccatttgattttttctacagttctgaagatgaactctaactactccttttagttgtatatttgatacacgcagaaaaagtcaagattgtaacattttatattgaaagaatcttatgaaaagactctaaaggtagaaaagggcattggttattggcttatcctttaaattatgcccctcacacaatccacccttgggttaaaaggaacagtcaaaagagttgcaattgtagcaacaatgaatgcattagtccttcagtgatcccaatgaaagaggtaagtatccccttagtagaggaccatgtacagaggttggatgtgcagaggccaaaggcttaaggaaggtcacacagcagggcgatggaacttccaagaaagacatcagggatccccacataccgttccaggctttaagagctgcagcccttgccttctctcttggtgatcttcaacactttaaataggggattcaccccctttgagccccactatagttgtcccattcagtgcctgacaaggcagggtgcatcttcattctcctcccacatggttcctttatctgttcaagagccaatgagaaatcgaaatggccaggccgcttaatgtcaagaaagcccatatgtatatctctttcagcacgtaattccttcatatacctcttttttcccaattacccattccctcttccactccctaatcccttcccaagtagggtactttttttttttttcttttgctctctctctcattctctcttttctgtatctctcggaaatcagacaggagttcagagcactttcactaccttttatgaggtagattgtgatgtcatagatgggggcagggctagtcaactttctacccacctcccaacctgtgctgagggagctccgatcgggagtggaagcagtgattcctccatggtgagtaaattgactttctaatctaatgtctttcattgtaatcatgaattctgaaggcaggggggattggattttagggaaataaaaatgtgcccactgaaggcctcttaatattaaccaactttgggcaaaggacttatttattctttatgtgggtcagaaattccacagcacagatatatcttcaattgtggtctaaacttgagaagtgaaaaaggtatttttatttctttatttctcagtctttcttcccattgggactgaaagtcatggcatatgtggaatgaatccattctatagtctctttgtgagcttcactaaggaagggtagtcagaaggatgtattcttctttgtttggaagatttcagggtcatgaaatatcctttactcatgtttgccatgagaatcagtgggcccttctaaaactgtggaggttaaaatgtgcatgaggatgatacatgaggattatcaacaaatactttgggtgttaacaaataaaagctttctaatgcagtgactaaaatgttcattttttgaaaaaagttacaactcctgcaagtttaaggtcacagccatttcaaggtgtcacagccagatttactacccatttttgttgttgcacgtcctaaccctgatgctgtttcatagggtctcttgctagttaagaggcatgaaaagctgctattgtttcatttgggtttctatatattgctgattagttcttttatatgccttagtatttagaaagaaaagatcaactggagcgggcacttttctccacttctttcctcgttctctcctgggtacctattaaaactatcaagatgcaagcttttgtataaaagggtaaagggagttcatggaggtggttgactttttaagggatatcaaagcactagggtgggtgttcttagaagggtttgaccaccagaatgtgaaaccctgtttttttcttagggtgggatgaaagcatcctggtgtggattatgagtattataaaatatataaagagggtatcatcccttttttttttcctaaatatacatccctggttggctagccatgatgaacatttgtgttggagaattggtttcggtttaaaaatgaagagtcctttctgtctcatcaacggcttctttgttatgcataaatccctgacccccaaagttatacacttttatatttaaaagcactacagctgatactgccctctttagtaccctggggctggggaatgggttttgaagttatttgatacctaagttttctaacctaaataagtgactataacagtaaagatttcaggcctgataaagaaaggtagggccataactggccaataggaagattttgatgacagtcccctgcaggcaacttaatattgcaatgtgggcaataatgccagagtcttatatgttggtttatccctcttaagtctctgacctaccttccattaaaagtactagacccctgaaacccaggtagaagcaaaccttcagtgacagaaaaatctgatgtctaatcatagctcaagtttttaatgtcttttatcaacccctcatacagctgccaggtaagaaatgctcatattttcaaacccttgggacacaatcatctttaaacttcgtgagttaagaacggttgtgttgtgcgcttgtgcaaattcagagagtctatcatggaatgcattgtgcatgcacttatttatcttcatgtgcatgtttcatttatagtgatgttcagtgttttttaaattcatttcgtatgtattaaaagtttaattttaaaatacatacatatattgtgctctaaaggagacagtgaaatggagtggaggttgcattaatttggggtctgaacacttgctatgctagttctatctctgcgcttgacttgttaggtaactcaaagcaaattacttagatctctcgggcctcagtttttctcatctgtaaaatgatggtagatgatcaaaaagagatattctaatgcatccctgctctaaaaatctatggttttatggtatattattgaagaaatggtttatgagaaaatgactgaatagttgatgaaatacagtttttattttgtacatacaattattaaatccagaaaaaacattcagtttaaacaaggttttaaaatgtgctgcctacctgatatactgctatttggttaataatagatgtggctgagccatttcttttaaatagacaacgtcatttgattaatctgctaaatctaaaccacttagaaagttatatataaattgatacctgaagagaggcagaatccatgataggtagctacataatgattttggaagaccgattcatgttttaactccatacctttgtgttattctaattattggggatgtaaaaaacatttactaggtaatagatgtagctgatcttactggggcttcaaagtttaaaattacctatgtaatattgcaggaaatcccaggtggttttggaagggttgataagtagggaattggtgagtatggaactatgtactatgggggataaaaaagtgtaaagccttgctcctgaatttgaggaatgtgcaacctctttgaggagtctgtacatgtgccaagtgccgacttggaagtgaatacagtaagtgccaaaataaatatccctgtggcctgggtgggctggattgcactggggagtcttataaaaagctgatacttttagctagctgagaacagaacggtttagatgtttgtgttattgtatataaaaaggacagggaagcgttccaggtcttcaagaccacagaattgtaaatggagctgaagatatatcttgtgttcagacatgacatgtgtcaaaatcaaaatgtattgcttacagttcaacctcatactttttctgaacccctttcccctaaatcatatgctgactgtactagaggagatacatgtctttggaagaatttaggaggcagcaagtgagtgaattgagtaattataaagatataatcaggcaggcatttggtcagttacacaaaactccacatgatcactcacagccacaactatgcaagagaaatacataacaggcagaggaaggaaagaggaagactctagcttggagatattctggtattgtgataaaagtggaaagagatcatcatttgggggtatcattaacagatttagaaacgtcagatggtgatggaaatgtccatcagctaatgagaatccgtgtaaccaagatgactttataaagcaaacaatttccttgggcactaagcaagaataacatcagtttctccatcctttaacagccaatattgacaaggttttaacactaagtaaaactgaacatgattatgcaagtctccttcccatatactcttgggaataggttattgatttgggtatgatttattcacactgacgaagaacacttaatttgaaagcctctctgttgctgtagacttgcagaagatttgcggtggatattttgcctcacgtagggaaaactgtttttgtatttcttgccattcgagtctcttccaagttattaccttggccattctaaaagactggaattccacgattagaactgctttgttacctagcccctttaccagattataagaacttagtaagtaaaccaaggactcagtttagatcacccagtgacatggcttctaatttcctattgtgacatcagaattagcttctagaatttgttttctcaggaaatcactttcaaaggctaaatttttctgtttggggatggtgaagtagtatgatcaaaggtagtttaacaaagcaagactactagcgctagtttctaaaaaaaaaaaaaaaaaaagttcaagcagaagttagattatgtttgtttcaagagaaaaatgatgaggatgacaactgttctcctttcttcctcctaagtgtctctggaggtcattttagaaataaagcatcagtcagagctataattcaacaaattcattgagtatgtaatatgggatattccctgttctacgtatgatgcattcatagaattagcatggaaaacaagcacgtgaactagtaactatgatgatagtaatcattttaaaagacatattgtgaccatttttgtagaaaaggataaaggggtgtaattttttttgagccttcacacataactgaataggagttttccaggtggaaggagagggaggaatatctcagaaaagaaacgaaacatccataacattgaggtatataagtattccaggataactgaagctgaaaatgtcagagagggctggaaagatggagaaaagtaaaagatgtgaggttggtgttggacatcaaagaaattcttctgaccatgctgagtttaatgagtagcattgaaaatgatcaggattatctgcatgccagctaagcaaggggtttgggggagactactaaaatgcacgatcctgggccatgttgcaaaaacttcttgaatcaggaatggtagggagtaggttcttggagtctgtaattaactaccccatcccactccccagcacacaacaggtgattcattttcacaccaaagttttagaatccctgcaaggcaacagaactgactcattctgtttctatgttgttagaagcagtttcagagtaaaaaattaaagtatcatgttattaaaagattttgggaaaaatagtttagggtagtataagcatattctcaagaaaattggtttaaattgtggttaagcatgagaactaagaaagatggttattaaatataatcagtgatgctattgaatctccttgaaagtgagacaagaaactgtaaacattcaagagaccatccttcatttttctttgtcatgctccaatacaaggagttaatgaagattgaagctaagttgttctacatcttccaagttgtgccaagataagagataggggcaataatccagagtaacatttgtttggggatggtattcttttgtagggccatttgacttctttaattaagtgaacttccttggaaaaaaaacgtgtatgtcagcattctcatcatgactggaagaaccgaactttcatgcccatgcagtatatgacctatatggtctatgttgaaaatgttaattatgtatgtttaaatcaatagtcacttacaagtgctaaattctttgttgtttgtttttctttttttcgtgaacaacagctgttaccttacacccatcaatctgtgtagaaagttagagaagtggtaaaagacctaaggagagggagatactagaaaggaattttacattttactgagacatgaaaatgagccctggttgagaagaaagtgagtcttagttcacagcaacaaggattgattctaatttagccccctaattgctttgcatacaacgtatcatttccagattgccagaatcttctgtatttattttttttatttgagaatagctttgtttggaagtcgaggattgatggggaaccctatttttaattgttttctgccgttaatttcagtgtcttctcttgggtatagatactgtcactttctagaatcagttgactggtaggaggcagtgcctgccattaagtgaacaaactaaggttgacgacctaaggatatatgtatctatatctaggtatctagatatagatatatgtagttaattttagttcttacagatatctcttgccaatgatctgtggctctgtcattgcccttgttacaccaactaaagcaaatacaaccttgggtggttctaaaaagatgttccaggcaaaattatttacctcaaggcctattcttttacctaaataaatgccaagcagagaacagcaacagctatgtggttttgattgttacagatctgaagaatataagttaaataatgttaaaattataagagtgatattgctattaggtgtgaatttagaaaccaactctcttgtacaattgatgaaactgggcaacattcttaacctccctgggcttttgctttttattagaatagcaatagctactcagagggataattgcccatggtaaatatcaaaatatcaacagttacattaacataaactgaaggattagtatgtgccaggcattgtatgaagcatttaaaatgcactatgaaatatgttttttcaattgtgctctggaggaaatactatcatccccattgaaaatattagaataatgaggttcagaggagttcagaaacttcctggaggtcacaaagtcagtgtttggtacacactagtgcttcaggaagacttctttgatattctccaacagcatggtgtactctttctgtcattttttgtatgacacttaaatgtcattatatttctctcaactagtctgtaagctagttataacagggaatatgtttgaatgctcatttttttccctggttccctgcataatgaacacataatctatgcttaacacattagcttctttatcatcctttcttccattgtagtgagttatcacacccaaaaagtcccaataattgattttgaagtctatcagtcattcatactttcattcatttatttctatgtgaaagcatctgacttcaaatgctagatttcgaaatgcactgtttaactaggatttggggccaaaaatcaagtaattaaatgcaattatttttctagttaacttaatttctttataatttactctgttaaattttcagatatattaaaccctttttaagaaaagattatgccatagaaacctacagaattttttcccaaaaagctgaatgaatcaaattagtaatttattgtaaaaagaaatttgaaagtaacatggttgatttcatttgcccccttatgcaaaggttatgacacacaaattgttatataattatatataaatatgaaatattttaacttaagtctactaaatatttaatgcccactattgtattaaaaatttgtatatagtttcaactacaaatgatgaaacatacaactagagttatttctctctcacatggaatacatctgtctgtagttcagggagagtagagtgaacacagagtcatcaaggactttgacacctcctaactttatggcccatctattctcaagttcatcttttggtctaagatgactgctagtgttccacctttccaattttcatgtaggaagaagaggtgagagggttaaaccaggtgcttcctagctatgttagtaccctctaaggaggcttcctggaaacttccacccctctgcccttcttcagtttccactttcatcaccatacatatggtttgctgcaagagagactggtaaacacaatgttttagctcagcacattgctgctctgattaagattgagatgccactaaataaagagaagggcaaatgaatattagatgagcaaccaagacaggatgctaagaataagaattaaattacccttataagattcaattcgaagtaagcaagaatttggggaatggaaatcaaaatctattcttttttttaattattagactttaagttctggggtacatgtgcagaacgtacaggtttgttacataggtatacatatgccatggtggtttgccgcacccatcaacctgtcatctactttaggtatttctcctaatgctatccctccccgagccccctaccccctgacaggccccagtgtgtgatgttcccttccctgtgtccatgtgttctcattgttcaactcccacttatggtgagaatgtgcggtgtttggttttctgttcttgtgttagtttgctgagaatgatggtttccaacttcatccatgtccctgtaaaggacatgaactcattctttgtttatggctgcatagtattccatggtgtatatgtgccacattttcttaacccattctatcattgatgggcatttgggttggttccaagtctttgctattgtgaacagtgctggaataaacatacgtgtgtgtgtgtctttatagtaaaatgatttataatcctttgggcatttacccagtaatgggatggctaggtcaaatggtatttctagttctagatccttgaagaatcgccacactgtcttccacaatggttgaattagtttatagttccaccaacattgtaaaagctttcctatttctccacatcctctccagcatctgttgtttcctgactttttaatgatcgccattctaactggtgtgagatggtatctcattgtggctttgatttgcatttctctaatgatcagtgatgatgagcattatttcatatgtttgttggctgcataaatgtcttcttttgagaagtgtctgttcatatcctttgcccactttttgatggtttttttcttcttgtaaatttaagttctttgtaggttctgaatattagccctttgtcagatggatagattgcaaaaattttctcccattttgtaggttgcatgttcactctgatgatagtttcctttgctgtgcagaagctcattagtttaattagatcccatttatctattttggcttgtgttgcctttgctttttgtgttttagtcataaagtctttgtccatgcctgtgtcctgaatggtattgcctaggttttcctctagggtttttatgatttttaagtcctacatttaagtctttagtccatcgtctcagccccaaatctccttaagctgataagcaacttcagcaaagtctcagggtacaaaatcaatgtgcaaaaattgcaagcattcctatttaccaataagagacaaacagagagccaagtcatgagtgaactcccattcacaattgctacaaagagaataaaatacctagcaatacaacttgcaagggatataaaggacctcttcaaggagaactacaaaccactgctcaaggaaacaagagaggacacaaacaaatggaaaagcattccatgctcatggataggaaggatcaatattgtgaaaatggccatcatgcccaaggtagtttgtagattcaatgctatccccatcaagctaccattgactttcttcacagaattggaaaaaaaaacactttaaatttcatgtggaaccaaaaaagagcccacatagccaagacaatcctaagcaaaaagaacaaagctggaggcatcacgttacctgacttcaaactactacaaggctacagtaacaaaaacagcatggtactggtaccaaaccagagatatcaaccaatggaacagaacagaggcctcagaaataacaccacacatctacaaccagttttcccaacactatttattaataaatagtgttgggaaaactggctaaccatatgcagaaagctgaagttggatcccttccttacaccttacacaaaacctattcttacaccttatacaaaacctattctttgtagttttttgaaactcaatactcatatttagttgttccgcaaacagtttaaaaggcttttttttctacagtttttagggaattaagataggtaactcctgcctacagcataccagcttttctgggaggtagagggctttgtttcccagtagccttcccttgctgagttatactggcagatagaagctgccaatgaaggctttgagtggcacgatgatccccatcatatgaggaatctgaaaagcactgggaagagttaggcttggggtgcagttcttgcaagtgtatgccctccattgagtggaacaagaactgaatgctgactttcagtagctggctatatgacctgagcaagttgcctcacctctctgagccccattttctcagctgtaaagtgaaaatgatattagtatctacttcattgagttattgttaggattaatggtattgatgtgcaccatacattgagcacagggtccagaatgtaggtgtactaaataaatgagtaggtattttttgttatcttctctccccacaaaagactatatagtcttttggataatattggtgccctccggttcttatatcatgtctaccccaaggaaggtgctggacataacagcagtgagcaaccaacgaatcaaggtctctgctgtcatcaagattgcattcttttgtcactgggagtccttgaggaatcaccgacagagaggggatagttgaaaatacagaagggaataacctcaatagaagtgaaacagtgattgtcacatttcactctgtaaaacgaatctcatgggtagccaaccaaaatggagattcctgaaatccacagttctgaaactcagctctgagaagggatcaggaatctgcattttattcctaaatctttcggatacagatgattcatggatcacacttttaaaaaaacactggtctaggaagtggaggaaagagaaacctataggctatagtgagaatttctccagacagtttaatccctttcctagtcccttttctaggaaaactgggtttgcttcttcaggctggttcagtctagcctcgtttggataattctttactatagggagcttgttgtagttatccactgtaggatgtttaagaacatctttggcttctcccaactagatgcctgtagcaacttttcttctccagtagtgataatcacaaacatctccaaactttgctgaacgtatcctggagtgggtggcaaaattacccctagatgagaaccataggactggttgaaatcttgacctttcacctaggataaacatactgctttaaatggagcctttcaagtcttccctctggaagggtggaagatggcagataagatagttccagatttagctgccaacctcgtttccagccaggtgtcagtgggtggaggtacacttctctaaaagtcaggcccctgagagcccaccacagtaatcctctagacataacctttctacaaagtacagaggtctagatctacctctttgcctggttatccccaaatcttcctgtcttagagcttatgtatttctattcccaacggtaattaagggtttcagtgaaaatattgtctgaaataaaagtttaaacaaggtaaaatggctttcacttcttactttttacaaacaagagtattgaagttaaaacaattgttttcctaccgcttttttagaaaaccttttcatatgtcattacatatttacctagtctctctgtctctctgtacattttaaaatttttgctcatgcctgtaatcccagcactttgggaggccgaggcgggtggatcacaaactcaagagatcaagaccatactggccaacatggtaaaaccccgtctctactaaaaataaaaaaattagctgggcatggtggggcatgcctgtaatcccagctacttgggagactgaggcaggagaatcgcttgaacccaagaggtggaggttgcagtgagccgagattgcgccgctacactccagcctggcaacggagcaagactccgtctcaaaaataaataaataaaaataaatagttaaaataaaatttttacatggtgagagaatgagtaactacattttaaaaaataagaaaaaactaaagtgatagttaaaataatcattttaataatgttaagaacataaggctaaggatccccttgagattcaaattgcttctgtgtttgttaatatatattatgatgatgagtaactctgccatgttgaaattagtgctgggtgagcccttcaaaccaagcaagttgtaggtagaagctgaagaagttgcatggcttagcattcgttttttaaaagaaaattggagaactgtaacaggcagtgacttcagatgtaacagaaatcatgctttctttcaaagatataccttcggtataattgaagaatttttcctggcattttttaatgtatcagataaaggaataatgatgcaacctttacatcttgtaataaatatggaggtgatttaactttgtcaaaggctagattcacagggactctaagatagcaattgtgccatgaggaaactttcatcttaatattaagcatgatttttagtaggtacaagatactgtatcataccatctccagccctttaatgtttatctttgttccttggttaaaagttgtcatcttattggaagttaaaggtagtacttttttttcaaagaagttttccaattgcatgaacttgaggctttctttcaaagaaaccactaatttttttttttttttttttagcaacactattatgcatttccagtccgctgaggattcgattcctttaatctgttgttttgaaagtttcttgtataactcagcctcgttgcaagggaacagacaatatgttgtccatccatggaggctctttgttggaccaaagagatgatatttccagttttagattgaagggaaccctttggcgcttttgctgaattttccctgaagtacattcactccaggagaaacagactagaaggttccaattaggccaagccctggcaggcacctatatggagaagtatcctggcttattaggagaaccaccttaaatgccctttatttcatcttttatttaaaggcagttggaactgtggtatattgataaatgcactatacctgaggatacaggtcatgcgcttgaatccctggtaattgtctattagctagcaagttcttcctccctaagcctcagtttcctatctgtagaatgatgcgcctaaagtgatgtagtactttttgttgttgttgttgttgagaattaagtgatagtagcatataggagagatctaattggttgggagggtcaatatgttttgaatctggaaaaaaaataaagtatattaaccaatagagaagtactaatcaacttttattgattattaaattgatgcataagaccacctgactgataaataattgatgttcaggggcagcctgcaccaaggaaacataagagaatccttcacagaacagaccatccataatctccatttgtacagcgaatcccagcatgatttatgtggttctagccttagtggagaacataccagcataccagtaaaggtgggcaagaagctacttattcataaagactcagaaatctagctatggcaacatgaccccccccaccccaacacacacacacacacacagtcttggaggacaatgcagtaaataagtaactaaagatttgattccagaataaatggcaaccagatttaaggtggaatcaccaaggacaggctcatcaatgagctgacagctcctattgtaagaatggtctaccttcagtttttggttgaatttctttgtctttttgtgctgcactccaaagccaaatttgagggccccaagcatgtttcctgtgttctatagtttggaaactgtatttcctgaccattctctgtaactggaaaaaaataagatcgtaactaggctaccccacgagtacttcaggtagaagaagaaaacttcttttagaagtacttttctcttgttttgctagggcttatcatgccctcatgctatgctggtcatctgttggaataccctctcctgtggagccaagaccctgggactgaggcaccgaggagttctaataaattaaaatgaagatcccaaaagaacttcccaaaggtacccagaggtgatgtaataatcttttatagtcacagacttctctaaaatttaacaagtattttattttctcacttggacctcagaataactcacaaaagtatattgttattaacccccttttacagttgaaaaaataaatagaaactcaaagagattacagagtgtccaaactttcacagccagtaagtgggacagccaagacttagagccagtttctctaatgtattatcttgtgctttgtgcagtgtaaggatggtgctggtatctctgtgctctgtagactagtggttgaacaagaaatacagggaatagcatgtttcagatggtatagatgataacaggtaatatgtattaggttcttataaattatattatcagcctcacatcatttcgtggtgtgtgctgcatgacacattaaaagattatgttttaaaagtttttaaattttttgataaataagtggtatataacgtttagggataaggagaattagaagttgtatttaattgtatttaatcaagttttctgtgaacatgtagacagcttttttggctgctggcaagaaaatgaaaaagtggaagatgatgttccctgcaatttgactaattcatatctcaggtgaatcctgatggcaagattgggagtttgtacaacttttctccccttatggcttaaggaagttcacctcatgactgcttcgtcacatgactcacgcttgtgaacagttaaaacacatcataaggcatgtttccctccacataaatggcatcaatagccaggaataaagacttagggcaggaaaagcctatggtagatctgcctggtcaaagaagactgcatgttctacccagaaatgaattttatgagccttcaagtagaccaaaaaaagttaacttttctctatttcggttttctcatatataaagcagcaatgatggtattcaacttgtacatgttatgaagattaatttattaaggcaccagcactatacctagcaaacataattctgtgcctcttagatgctggtgctattaatggaggagatggtttttaaattgtggctgtcttttgagcaaagactgatcttgaaatgcttacatgcaaggtacagtaagaggaagaagacatagatacgtattgcaatttggctgaagtttactttctcttttatttctccaaattttactctcctgacaatctcatgtatttgcaagaatgaataggtagtaagaatggatactgaactaggcattgtgccctagctttgtgtctttggacaagcctttcacgtcctatttccccacccataaaattacaatgcttcaacatctcggcaaatatttatggaggactcatatgctaggcactgttttagatgtttgggatataatgggaggtggtgaacaagaaacataaaaatatgagtatataagaatattaaaatagagaaagaatggcaaattaaggcatgaggatggaaatggagctgcaatttgaaaagtatggcttgggtagttttcaccaagatgctgatatttggataaagttcagatggatgtgagggagcaagccttacaggtatctcaggtggggaagagttttctaggcagaagaaatagtaagcgctaaggccttacattgcaaacatgactggtctttctgagcagtaaacaagaaaccagtatttaggaattgagttaatgagagcaaaatcagaagtattgggccccatgtgaagaccattttgatagatttggatttaactcagtctgtgattgggaagccactcaaggttgttgataagataagtgatattgagttcatgtaacaggatcgttctggcttccatttgagaataaacggggtaaagggtgggaagcaaggaaactagttaggggaagcttttgtaacaagccagtaagaggttctgagaagttggccaagtggataagagtgaagaagatgaaaagagatcaagtaatagatatgttttgaaaatattgctgacaggacatgatggcagattagatgttgagttggagaaaacaggtatagcataagattctgggtgtttaaccaaagcattgggaagaactgtgttgccaataactgagatgaagaggcatgcacgagggtcaggttaggggcaagggtggagttaatcatagagctctcactgtctctggaaggttgggaacagtctacaagaaaaggcttacggatgcttagatcattctcttcatgtcaagaggtggtctttgtgaagataactcttgcaagaacctgaagtataatttagatggaagatagataatagaatggttacaactcattgttaaaagtaataggaaacccctacctgcatctgtgatcgtgtacacagtaatcatttgaaaattatttgaatgtgtgttaatgttagtggtggatttacagctcacaatggaaaaagcagtgaccaggaaaaaagaaaatgatttggagggcattattctgtgtcaactcaaaaaatattttaaagaagacagaaaaagttcaattattaaaaacccatggatcgactgctcaaatttaaaactaatttagttaaaattactgatttttaaactattatactaaagacctcttatgagcccttaaatgatgatagcatttcctcttaattctaatttctgtaatgaaaaaagagttgaaattttaggttaatgtagtgaattattttatatagctacatatgtgtctaacattttacttcaattttctgtgctatagttaagagctcattcgttatgaattatgtgaggagaaattatattagaggtagaagtgatattaatatactcttaattggagcaatgattgcacaggtgacatgagtcaaatcatagccctctcctgtgcagttctgttagttagaaggcccacactggatatggtaaatggttttatgatgattgctaactctcatcaattgctagtgtttgactgagctatgtgttgagaagaatgctgagaccatggctaggatcagtaggaaaaaaggacctgattgattgggcatatctgttaaggataccaatgaagaaatggcagtaaatgtgtcacacactaatcatccttgttttattggttctagaaagggcttagagtattgacaagtatgggttgtcttaaggatgcccattgctttttttttttttttttttgatatatatcttcttgccttttcctggcttttacacccattagcccaggcactgtccttttcaataaccttggatttgttctttggaaggtcttttcatataacctgccatttgctactttatttggttagtaaatgtgtgcagagcaggaccaaaggcagcaagattgttgtacttatgttctggaaagctagttggatgagattttcaagtaatcctaaagaatatgtagattcgaaactgggaatttattggtagacttagatgctgagataaggtcagtcttagttagagatggcaggtgctggcttcagtggtttaagaccgaataaaagattaaaaattatgcatttataacccactttgtagcaaaatacagttaaagatttaggaaacagtgctagggaacccaagtgtttgtgttttgaaggagataaacacagagctttgggagatttggccttcagtgtttggtaggcacttccaaacaagaagggggctcccttttaggggtagtgagggatctcagctggggtctaacagtgtatacctgagaatcgaatgaggtaaggtggtgtcatcctttaccaggtaacaccatttggtttttaatatgagatatttataaatgatattcttaaccaaaatgaatagctggaatttggggaatttaaggtccttgaagtggtcgtataaaatattttatatagactatttattttgatgcttcccaaattacatgtttaaacatcagcttcccaggctagattgcctttcctccaccttctagtagagccaccttgactctctattatcagtattccttaccaagtcctaaatgttcttagatattttaggtgtcacatttttacataaaattcctatgttttcttgcactcagtcttgactacccctttattccatctaaaggattcagtagtgctagaaaagatacataagtgttggtattttcctattcccctcatgaacttctccattccttatccctaaaactgtaatattcaggcactgagaccaagccaagatggtggtagcttcagtaagaagagagtttaaaaaaatctaaaatgctgaatgggggaaactttgaaaggaaaagaaggatgaagatgtaggaaaagagaaacataaattttttaagaccatgtttggactcacctggtgatttaaggaaagatgggtcataataataataaaagctgagatgtattaagggcttaccatgtgccaggcactcaacttcagtggcattatctcatttaatgctttataatactagaaagtgctattttcatttttaattttaaagaacttttatgaggtagaggtaagtttagtggttgttcaagatcgtgtagttagtgatccatccagtcaaggtttgaactcaggctttaagtctagagtccaggtttccctcagtaggagagatgaaaacatgcatgtaagaatgaattaccagtgacagagagtgcacaggagaggaagaaagaggtggggaagaggtgatcacaggaacaaaaggggctggggtcccaaggagaggcagcaaacattcactgggaacggaatctctctgctctctcctcatcctggacctcggtagcaacagagcctttgactagttatttccatacacctgatgaggagaggatcacaggctgcatgggtgtttacttcccccaacatatgaataatgccacattagaacatagctcctagggcttagatgagaagagaagtgaaagaatgaggaaggatcgttccagatcttcagattttgctaattttccaggcatagtactccaccaacctgcacccaaaccgcagcctttgactcttctagtctacttttctctcagtgattatgcattgcatgctggagggtaggagccattttgcaagttattaaatggccttcagtacttagcagcagataccatgttcatacaaggttaggcagttcagaaagggtggggtcatttagtgactttgatccattttatgaaaacatatttctcatgggttcctagataattgttcctcttacatttgtcttctggtcatgatgatatcacctagggagggagaagggtagaaatagagggatcaaaggtagtgatgctctgctagctggctctcctatcggtaaggcaaaaaggaggcttagctccttgcataattatttatgagacataaaccttgggtggtcaagacatgctgatgcacagaatcagagacaagatcaacagttaatgccttatgtattcatgtgacataaggactgtctgcccaagaatatttcccaattatggggggggtgcctgaaagcccattggctcttctctttgttgcataattcctcatgatttttttgttacatggaaaccaataacttagaggaggtctctggcaggagatcctgaagggttgggataagcgagggtgctgaaaggaaggcaaggaaagagtaagtataggaaaagaaggtggggactacctggataaacaggtggccctgttccgaactttccaagggccaacctgtcagtactcccacttatctttgagatttccatgttagaaagaatgccttgtttcgggttgagcaaaaactgtttcacctttattggtgagaaaaaaaatggctctaagccatatttaggaaatttgttgactataattaagatttcatgggcgtccccaaggtttacttacccataattgaaaaaatgcaaatgaagacagttaatcagtggactggccgactatgaagcactactacctatgtaaatgaattaaaaatgaagacacaaaatatgtccagttgagaaagttaccaaagagccaagtggtaaatttctcagcaaggctgtggagaattttttcttagcctgacagcctgcagtgccttcctgccaaggtctttgccaatttaatcttgagccattccatacagatttcctcacaactggccttcagcactggctggttctctggcattacttaaggaagccctgaagaaaagataacagacctctttgtcctcttttctgtgtaattgatccactacttagagctgtaaaatatttgctttacaagatcctgttatcaaatggaatttgaaactctttaggagttatcgcacagaatttcacttatcagggatcagtatgtgttgtaatattaactcttttaatgtggttttgtttgttttgagacacagtctgtttctgtcacccagggtggagtgcagtggctccatctcagctcactacaacctccgcctcctgggttcaagtgattctcctgcctcagcctccccagtagttgggattacaggcacctgccaccacgccaggctaatttttgtatttttggtagagatggggtttcaccatgttggccagactggtctcgatctcctgacctcaagtgatccgcccacctcggcctcctaaaatgctgggattataggcatgaaccaccatgcccagccttgatgtgtgtgtgtgtgtgtgtgtgtgtgtgtctgtgtttttaacaataaatacaacatatctgtgatggtcacttttacctctaacaccatccttccttgttaaaatatgcaaccaatttttatcacctgatttaaaatcatccccaaaatgttttgcatttctgttaatacttaaatcttctccttaatgatttcattaattagcaactcataatatggtattagtacaaaaaagtgcacaatatgtctgtaaaatcagctgtggaaataaaagcataaatgcaacatcctttagataaaaatatttgtcggccgggcgcggtggctcacgcctgtaattccagcactttgggaggtcgaggtgggcagatcatgaggtcaggagttcaagaccagcctgaccaacatggtgaaacccccatctctactaaaaatacacaaattagccaggcgtggtggcacacatctgtaatcccagctactcaggaggctgaggtaggagaatcgcttgaacccggtaggcggaggttgcagtgagccgagattgtgccactgcactccagcctgggtgacagcgagataacatctcaaaaaaaaacaaaaaaacaaaaaagtcagtatcagacaatatttgatagctaacaaacaatagaaatcaaacaattcaaatacagaagtcgtgatacaatggatgatatatctgtgccataaacagaatcaagtttttttggacaaccctgttaaaatgtctgctcttgggaggtaaataagtttcctttcccacactacttagcagattctgaaggagcaaggtgcctgagtgattaataatgcctgccctggacactatggatgagaatttgtttgatgagaaagagtgagtagactccaacacagaaatgagagcttgctatcaaggaaatgtctttctgtgaacatataaacattctgagataacttaagtgggaaaagatgtgattaggctgaaccttttcaccatgtctttgtttgcttgagttatttattaccctggactttctagaggtttttaaaaagtgttattgatatagactctggaaaatgtacgcaggtatttcaagatatttcaaacatgtcacagtttctaaggacatcaaatagctcttcaaagcctcatggatttttaaaacatgaaatgttcttcttggaggataataggctccaatgctctgggtttctaacctctaattcattaacagcaaagctgacttgtagcaaaatttttttttccttgcaagcaatatgtgactcctttgagggagataacagtttaaatataaataaatgaccagctccagtggaaagattccagtttccttgaggtgtttgctttcaatttattgccaattctcccatcaaaatttcctaccctgaaaacctactctaggtctgaacatgtttagaacaacccccttaaaatcgttcttgttcttatatgttaaagctatgctattcccattttaaaatattgcaaaaggctaaagtggactttacacatatttagggaaatattttagcattatcaaactcattagtgttattggctctgacttacaaaaatgaaaataaaatagcaaggcccaaatggaactggttccttcttccaggcatttctaagccatttgaagtaatcaaagcaaacacctcagttcttttatttcaaaatcaccttccagatggatttggcttattttattctatttagcttagccagcggtcccatgacatttgcattatttttaatccaatgacagattgctttgtgatttggattttcatgaactgccatttatgtgtcattaatttttgttagtagatgatcagcttttttgaaaaaagacatacaatgtgaaaattgatctctctctccatgcatattgtaaatatatgaattcagaacacacagtcaaatcctaattctcttctttaatcgtatgcccggcctccacaagttaacattctaagacatttactatgtcatgtcatctgcaatgtgtcccctacttgttttatattatttttcacttttgacaatactattatttgtttttaaagcaagctgttacaaaatagcatttattttatttctatcttacctcaggaagttcaccattctgaagggtaaaagattgctaattacttaactattccctacttaaccaaggaaggttattttctattcaagtaaaatacttgttgatgacgttatatcttagattattaaaaatatcttagattattaaaaggatattaatattgattttaaaggtcttattctgagaaattttttggtaaatttattgaacttttgtgtatggatttaatctttgtaaaaacagtaaggaatatgaaaggacaaaatcaaacatgttatacacctacagtatgcagaacatcaccctacatgaaacaattgggaagatcaatataagcaaaacatgatttttttaatatttactcccataaatacaactggacctctgataaatcacctagatgtaacatacacacctcaaactcggtatgtccaaagttatactcagcattgtagcacttcaacatcctttatatttccgcaatctaggttgagagcattgatgtatactaagttggactagttaggtatttgagaattgtccttcctcgtcactgttaaccattcagtcaccaacaacctcttattaaagagtgtttagatatcatgcccacaatgaagctgtttcccttctcctatccctacttgactcaaggtaaattgctattccttttgttcatttagcatctcgcatcctactaaaacactgtcatacagtgttaaaacctttagtttgtgtctatttttctcattgtattgtgagctcttgtgtttcagtgcttatgtctatttgtgtttctatacccaacacttaagcacagtagttggcagaaagtattcagtaggtgtctgaagaaatacttggatgatgtgtagatggaaaaatgtagggatagactggaggataaaaagtcagtgataattcaacatttcaagaggtgtagttgcactttcctttgaaagaatgtggttgacttctgcagtcgaattctgtttctgttgaaactgaacacctgttgcagcataagtcctgtttgaatgaagtagcatgcagctaaggacataggctttcagaaatattcagttgataacataagctgtagcaagagtcatttcaaatacttattacgatgttcttcagctttggtgatataaggaattaggctgcacaaatattgataaatggaagaatcacaattcagataagtctttgctccagtctttctgcccattcaaaacacaaaatgaggagagtatagggaacagaaatcttttagaagttgagtggtattaagaagagtaggaatagaggcaggggaaaaaaagacaatgtcctatagaaaggcctataaaacagctctcctgcccctatttgcttttcatggactgtaatagcacaagatgggaggaaacatctgttttcttttaaacatagtattttgatgttttaagagaatcataataattagcagaagtctaatttcctgtggttagggacagcagatacctatgggatggaatagggagaatgagtgtagcagatcttggtagattttgagggctgaggattcatctgctctggatggctctgggaaatagcatggaggaatggtaagatcatgggctcagtggttagatggcctgggtttacatcttggcttcaccacatgttagcagtgtgataatgggcaagctatatgcttctaagtctcaattggtcaagccttgtctcagggctggttgtgagatagaatgaaataaacgaaactcagggaactagttcagaaaacagcacatggtctaatttgttaaatgtatgcccttgtttttaaactagctgaaaataagcagtttctcttaggttagatacaggaacttaatgggatatcctataggaatataaaaggcccttaaccaggaaaagatggatatgtctttctgctgaaaaggcctgtcactgtaattcaggtcagcttgaggaagggctgagaggtggttgatttttgaggccattttaaaactagcaagactggaccaggtaaaggattagatgactaataagagtagctgagccctgcctagtataaatgtgcttcagaataatggagcaaatccaagacaaattagcagagatcagtttccagtgtctatttatttccataagggtgactcaaggccaggaagaacaaggaagggctgagctctgggcagcaacatacctgaggccagaggctatagtcagcaaggatttgggctatgaggatgagactaagaatcacagattgtgagagatgaagcacttatcagacatagccatgatgttaaaaggatgttgccaggtttaggggacaggcttccagcctgttcattagtagaaaagagttcattttggataggcaataactaaaaaacaagacctgagagatcaagtgatgcttcgggggaacattgctccatggtggggttcagatgagtgggccttggagagagatagtagtggtcctaatccctactttgccaatgactgcagggacaacaacttacgttacctccctaagcttcaacttcctcacttattaaatggggagtaataatcattcctacttcgagaatttttgaaaattaaatcacacaattaaaaggactcaatgtcaggcgtctagtaagtgctcactgaattttgattattatgaaaacttatacgtattcacttacctatcttgttgaaaacgccatcattacaataagtcacaaaagagaatgcaactatgttaaataaatgttcctaaacttggtatttaaaaactgttgccatgcagctttattctaatatcttttctttaggaagtgaagttttagccaaccttgccaattggaaaacagagttttggcaccatcttggaaaggcataaagaaacccatttttaaattggaaagaattgtgattgtgctgataatgatctaaatcatgaaagtgcatctacagaaaagggcaaaatgtaacctttggaaattcaactttttttaaaagtcaaattttgtattaactttaaattgggcttattgtttgtggaaatatttgttccagttcagttggctggatctctcacctcctcactttaccttgctgcaaattcaagatctgccttagcaggtggcttgaataaaattcttggctttatatttcaaagctatctcactctcaaacagtgtattaggtttatttacaggattcctgcatcaggtttgaaaggcaaaggggttctgaagaagagacaggctctcatatttttgctgcagaattaaacaccatctatttgaaaatggaatctgtggtaaaaatctccaaatttacttgtaatcccttctcttcagatcagctcaattctcccaagactcactctttggggaccatttaataatacaagagcaatatcatcttgttctatttctactaattctgttgcccaaagcaaatcaatgaaacgtccctgtcatattttaccctttatttactcatagcatgcgatagaattaactaattttatgaattaacattactcatttttgaaacctgacagacttacagagaactgtgcattggccaaaggtgttaggtatttagcttctaaagaaactgtgacttatctgttcctgattgttcccaacattttgctgtctcatctctgtccttcattatttacacttctacctgggggtaagatgggaaagacgaaaaagtaaaattcatgtgagataactggctatgatattaccaaacttgtgtatgacggaagtcctgaaatcactggataaagtaaaccatcaagacagtctttaggtttcattaatccagtggttctcaaactttggcaagtatcagaacctcctggatggctagctagttaaaacaaagattgcaaggttttgattcagtaagttttggattgggcctgataaatgcgatttctaacagattcccgggtgatgctgatgctgttgcacctcagggactaggctttgagaatcaccccactaattcatgcttggcttctctcctgttaacatgaataacctagagtttgcttttccttagctatctttagaaatttgggctgtataaacgaaagagtatggggttcagcagtgattttggtatacgtgcattttgtatggcataatagaagtgatcaagtaagtgggttactccatccatttggttgagttaattcacaaagcaattatataaaacatcttccattgttttccccaatggtcagactacaagcttttctggtgatggaaaaattgagctcatttgattgacatttttaaaaacacagcgcaacattaatttagcttaaataagggatatggaacaaaaagcagccaaaggaacagtatcacagttgtgttagatacaacttctgataacctcaatactgcgtgggacatattttgttaataagaaatgatacgaagctaaagtgaatgccagtcacgtcagatggaagaaccataagatctacagtctctcagtttaaacactttcttagtcacctagcccccagaaggcttaatgcagctacagttcatgaagttcatgaattacaggctacacaacaaataatctctccaactaggaacagcatacttaagaacatctttgcttccttcagttaactgtaattgatatatctcattagttgatgttacaagaagtttgatgaaagatcagactatgctcaaacatccctgaggctggaatgatatttgcagttcagctgttaattcttttctttcactagctcacatgtagactcctggctgatggagagtctaggaaatgcatttttgagcctcaccaatcctgagctcaggatatagaaatagtgtatagataaataggtacttccattggttgggctataacattgagacataaccccagcatctgtgatgcaggcagtgaagcaagaaggttgaagaagatattgaatgatctagtatacagtacataccacactaactacttaaagacagaaaaaaggtaacccaaaatattcctggcctaaaagtctggtgatgggcctctaaacctattctcaagttgtgacttgtcttggcatttttaaaagccatcctatccaacaaggtgacagtacagatgagtagtatctttaaagactaaaacctgtgctagttactggacctctgcatgtatcagctctctcattctaaaagggcatgacgataatgcctatattatagagttgttaacaagagctaagtgggaaaatacaaatttctcataatagtatttggcacatagtaaatactgaatatttcattaatgcatggatgagaaggtctcactgaatgctatgagatcctgacataagtatcagtatttatataggaggtatactgaggacctgttaatagttaaattgatactccaagctcaattaacacctcatagaagcaagaacacccatggattgttcttctgcctaaatgactgtatcctcaccaaccctgagctcaagatacagaaatagcctatagatagatacttccatttcttgggccataaaattgagaggtaaccccttataactttttttctttagtgtctgccaaatgcttgtccaacatttgagtaaatgtcaccattgctaattaccctaatgtaataatatgagatgttctactttggaaaacttttgttaccttggaattcctacctgctaagatgagggctttgccattagctgtattgagattttaaaaaccttaacttgtgataatttgctccttttcagcaatactatttatttgcacaaggaaaacattattttaaccgtgaaagtacatcaccattttgtgaatttggggcctccattaacccacatgtatctcattcttttcctactctagctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttcttttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttgacatctcaagtatgttttcttttttaattttttaagtatgtacttaataaagattagagcatcatcttcctgaaaattcattaaaaaaatgcattatgttttggtttttagagattagtaataaaattttagagattagtaataataaaatagatgatatccaaataattgtcatttttagagttcacatatttattttgtggtttgtttttccacttgttttcattcactttcatactgcattgaaaatgacagtctttctttgtaatagaagagccaattaatttaaaaatattttactcattttagactttttccttttaagtaagttggaaaaacaggacctctgtcccattattaaaaagtggtgatagtatttcaactatgaactgagaaatggagaaaaagtccccaaatagtcacctgaattctccaaactcctctcattggaatgattgctacaagttatcacattaccatgtctccaaaaggcttctagtaaatatgcatgtttctttcttagcaaagaagtgatgataacacaatgggagtcatgaacacctaagcttatgtgcaagatcccaaagggaaggagctataagggagttgtggaaggagaaaaagcttaatctaaaatcttatttagaaatgattcttctcaaacccctgcttactactactggaaaataacaccaccaagactgagaacatttcagtagaggagacaccacggaagccgtacactgattttcaacactaatcattagatcacagataactaactagcctgcttcattaatttgcataaacattcagagggtgccactgacacacactcacagatatttaaggaaggccttaactgagccaggttctaggctgagcgcaccactagttaaatgtatgggtgacttttctgttagcacataaccatgacataacaagaaaccagcatgccatttttgcccaatgacctgaaaacaaagaaagacagcttgttcttggcagcatatttttgatctaaggaatctgagtttctcccaaacagcaataaaaatacccttttgagaagtttttcctgacaagagccactcattctgtttttctcctccctaacagatgcttagagaaatggaaagatctctttagcctccccttcttcacaggatctagggaaataatagaaatattaaggggttaaagacaggaaagaaaagtacatcaacctagtgatgatgatcctatagaaagaaagagtcaacacaatgccattcagaagtccccaaggaaatgtaattagcataattaactttctggattcatacattattatttattgggtcaaatattttgcagaccagccaagaagcttttgaattttaaaagtttcttggcaaatcctgaaaaattgccagtaggtatcagaggaatatatagagaatgcccttgactttgacctataaaacattaaatgtttcaatgcacgcttatgaacagtgtttatgtgtgtgtgtgtgttgatttcagtgcttactgagtaagcatcatcactatcctttccatcattgcttttgtgatcaaggaaaacagtaactattcagaaagataaatatagacacttagttgaaaccattaaagcaataaagaagttggtaaatttcttgtcctcaagaaaaatacagtctaattgagaacatattacatagacaaaaaaaatgtgccaagaaatcgtactcaaaagtaccaaatgaatatggtagagaaattactgtgtggtgctagtgaagtcaaacccattgaagactaaagtagctgggtaagaataatgcaagaagcaggacttggaaatgagaaaataaatacattctgaatgaatgaaaattataaatcagcaaatttggcaagaggggt

SEQ ID NO: 16410 - DNA, 15203 bp, Human
gcccgaggtgctgtgcatgggggctcctggaatcctgggaagggcagaaagccttggccccagactcatcgtgcagcagctctgagcagtatttcggctgaggagtgacttcagtgaatattcagctgaggagtgacttggccacgtgtcacagccctacttcttgggggcctggtggaagagggtggcgtagaaggttccaaggtcccaaactggaattgtcctgtatgcttggttcacacagtgcgttattttaccttcctctgagctgctaatcgcctgcctctgagctgggtgagataaatatcacaaggcacaaagtgattgtacaataaaaaaatcaaatccctcccatccatccttcagtctgccacacacgcagtctacgttacacacatgtcacgtaaagcaggatgacatccatgtcacatacatagacatattaaccgaaatgtggcccttcggttgcatatattctcatacatgaatatatttatagaaatatatgcacatatttttgtatattggatatatttatgtaactataaatttacatgcgtatggatatgaaaataaatgcatacacatttatgtaaaaaaatttgtacacatgcatttacatatgtaaatacatacatctctatgtattaatgtttaaaaacactcaatttccagcctgctgttttcttttaattttcctcctattccggggaaacagaagcgtggatcccacgtctatgctatgccaaaatacgctgtaattgaggtgttttgttttgttttgttttttgaaatcgtatattaccgaaaaacttcaaactgaaagttgaataacgggcccagcggggaaataagaggccagaccctgaccctgcatttgtcctggatttcgcctccagagtccccgcgagggtccggcgcgccagctgatctctcctttgagagcagggagtggaggcgcgagcgccccccttggcggccgcgcgcccccgccctccgccccaccccgccgcggctgcccgggcgcgccgtccacacccctgcgcgcagctcccgcccgctcggggatccccggcgagccgcgccgcgaagggggaggtgttcggccgcggccgggagggagccggcaggcggcgtcccctttaaaagccgcgagcgccgcgccacggcgccgccgccgccgtcgccgccgccggagtcctcgccccgccgcgctgcgcccggctcgcgctgcgctagtcgctccgcttcccacaccccgccggggactggcagccgccgccgcacatctgccgccacagcctccgccggctacccgaacgttctcggggccagcgccgagtggatcaccggggaccgcgaggcacccgcgcgccgcagaccccgcgcgggctggagcacccggcagagcgcgccacagcgccgtggcctctgctgcccgggctgcgccagagccgcggacgggcgcgcagagcgccggggactccggagccgatccctagcgccgcgatgcggagcacctactgcaggagatcgggggcctgggacgcgctggccgaggtgtgatcggaccccaggctagccacaaagggcacttggccccagggctaggagagcgaggggagagcacagccacccgcctcggcggcccgggactcggctcgactcgccggagaatgcgcccgaggacgacggggcgccagagccgcggtgctttcaactggcgagcgcgaatgggggtgcactggagtaaggcagagtgatgcgggggggcaactcgcctggcaccgagatcgccgccgtgcccttccctggacccggcgtcgcccaggatggctgccccgagccatgggccgcggcggagctagcgcggagcgcccgaccctcgacccccgagtcccggagccggccccgcgcggggccacgcgtccctcgggcgctggttcctaaggaggacgacagcaccagcttctcctttctcccttcccttccctgccccgcactcctccccctgctcgctgttgttgtgtgtcagcacttggctggggacttcttgaacttgcagggagaataacttgcgcaccccactttgcgccggtgcctttgccccagcggagcctgcttcgccatctccgagccccaccgcccctccactcctcggccttgcccgacactgagacgctgttcccagcgtgaaaagagagactgcgcggccggcacccgggagaaggaggaggcaaagaaaaggaacggacattcggtccttgcgccaggtcctttgaccagagtttttccatgtggacgctctttcaatggacgtgtccccgcgtgcttcttagacggactgcggtctcctaaaggtagaggacgcgggccagggcccggggtgggtggtgggtgggagggggatttgggcagccactgcggtagagcccttccttacgtccaggccagaagtaaacagacccctctccagtccacgtgcaacggagccctgcaggggctcccacttccagctgccccgggcgaccgtaagcctcaccctcccggcccgcactcttccacccctctttcttcccctctccctggaatacttttggagctgttaacacttagatgaggtgttttatttatttatttatttatttttaatttttttaaaaacttttttgggtcaaagaaatccctttgagagggtagcccctgggtttcacccgttagctgagaacctgtccgctctgccatggtgatctccattcttcaagtgtttccgggagacttggtttctttgctcagagccgtgtcccatttaggaaagtactaggagtttggggttctccctacttgtttccagaaatgcgaggggtcagtactgaaggatcacttggtactgtgtttttaacagctgacacgtgcattaatagatattcaccatttacgtaatcccgggaagatacatgtgtatcttgactgcactgtggggatgcgggatggagctgcctttcgagacacccctgagggtaggggcctgggacacaagtcataagtggcttcagaagttgtggccttgagcttacagggtctggaagctataagggtgtgtgtgtgtgtgtgtgtgtgtgtgtgtgtgtgtgtcaggaagttctatacagtgcctctaaggaagtcacatgcaccatttatgtgtgtttatatgccagacagcgctcagcactccgcatttgggtttgtataggggacgcagggtgtcagatcaagcggtggttttcccaggttcccggcattggctgtcagcgctgtgtcacacacaaaaaagtgacagtcattggcgctggtttggttgggggggagggcaaatcccaaatctgatgtcagacgagctaagcgttggatgggagcgataaatcatctggttcaggaacttgggacccttcattatcccaaacgtttgagcttcggtcggtcttacctagactcgtgagtgtgccaagccaggagggcatcctggaggaggcacgccagccaaatgggagaccgggccgcgggggcgcgaggggggaggactgggcggggaactcgggtgactcacgtcggtcctgtccgcaggtcgaccatggtggccgggacccgctgtcttctagcgttgctgcttccccaggtcctcctgggcggcgcggctggcctcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaaggtgaggcatggagcagggcgtgggggcggggagtcaccctgcaaagccctccaccgtgggcagactgcagccgtccctgtagaggcagcttggccggggcaccagcggacgtttccactcttgcttctgtactatcgtttctgaatctgattttaactcactgcttgtgtggtgggggagccagggattcccctttagtaactccgcaccctcttcctggcttgcagccagaagagctactcctcctggaagaattggagagaaatcaagtgatggggaagatgagggcaaaaggcatgcctctagtcagctaaacgtgcaagaattccacagagggaaaaggagaaaaagggaggcagattgagatttctttaagtctgtttggaagcttttgctctataaatctgccgcttaagccagggttttagggtagacagagccaagggcagagttttcagagatagtattgaaaaatcaaagcccagggccccaaagtctttctaatttatagttgatctgggcctggtttggaagattttgaatcccaatctaatccccgtgggagatcaatactacaatcaatcttattgtttccacaatgactttcttgtcctgtgcttaaatctgagataggctctgagtagagacaaggcaagccttcagataaaagcgtttgtagcagctgcctgtttttttttcatgtgcaccgaaatgtggatttttttttcttttatgatactacatgtggtttttctaaggtgggatatttctgcttgtttcatcagaagggcatttagtggactggaaatgtcttacagcagctattgaggtctgctgtacctaagttcttagagcaattagtcaaaaatatgttccacttcaattctttttctacacttttaaatgcttctttggcttaatacatttaaaatagagcatgggtttcttcaattcctagaaaagagtacaaaagtgtatatcacagagcaaccacttggcagatatttggggagttgggagtgaagttctctttcttgcctttccctgcttaggtggtaaatttcaagtgggaaatttacactgataatagactaatgggaaatggcacttccagatgttttctcccagtgtgaagggtgacttatacttgtgagagtatttgttggtaatgggaataagtcccaaaggcaagccacatagcagaagatacgttctcattgaggcagctacacattacgacggggacactgaattgatcatcagttcatttacaagcacatttctaagtgaggtgctctctgctagcagaaatcagatttgaaaggcagtaagatctcactccactctttcagaattcatccaatgaaagcagaaatcacctgttgtcatatgtaaaatttgtgtgtatgtgtacattctgccatcttaaccctgaaatgattatagatccagctaatcattcccaggtaatgctgattagaatacttttttttttgtataggaatgtaataagaacaactgttttagacacctcttctggaaatttagcatggaagctctcaactttatttttaaggcctggaagatgctgtgtctctgttacaacttaaaaggaagatcatttaagttagttaacacctaaaacattccattgtgtgaggattttatcagtgatgtctgcatattctcatcattcatctagaagtggtttgatcagaactaaacaggctacacgttattcaactgtgttattttaacttaaaaagcatgcttgagtttataaaatcagaatttatatctttgtgagtgtaaatgttacctgagaaacagtacagaagtgaccaacttgattaaaatcaacttgtaataacttcaggtcttaatgcagttagataatggagaaaagctatgtaattttgccccaaatttcaactaatccatttcttgtctcattatgactaatatatcatccttaatctggatggatatagcacttttttcaagactaatcattgttgtatacacccaggatttgcttttgataaacatccttgtgccatgcatgccacgaaaaaagtttttggtaaaccatgtgatgaaggttgctggctcaagaacagaatttagtttctacagcattaatgagcatttatttgaaaaaagaccataaagacccaatcataagaattacctgttgggttttctttgtaggtgtgatcgaatggtttggtggaattactcgacgagatatcatgatagcattctttcaaccaatatgagtataatgcgaccatatcataggggatctgagacagaattatcagttgtatttttcctattgaattttgtctagtcctttctccagtggcttttatttgggagaatatcagctttgctaaaatgttattgttttcaagatcattaaaaagtgcttcagctacatagacctttggaaactgccattgaacatagaaaagtcagttctgcaagtggaaagagtgttttgtgtattgctgtagttggaaacacattgaaactggttgacttcactggccctccaaaaagtctttatgcttttttgtcagatgggagagagaaagaccaggtgcttcttgttctcctcactctgaaggacacagtcttctttctacatgaaataactggattatttgcctctgtgactgaagctttcaaatagagattaaccctctttccacaaatataattattatgaaaatatccatataatagaaaagttcaagaaataactattgccctgcattagagactttgtggcacaaattcccccgtgcaaacaacagatttggacacatagatccaccaaaaccaatacttacctggtatggttccctagtggccccaggtatttcattgtcattacagaggccacattaagtaggaaaattactctatttggaaatggttgttgagattgaggctttggtgtccagtgatacttccttggcactgacattttccgttccacctgttttttagtggttcccctaaatttctcttaatccctttgcagtgaactattttgcgttcttagacttgctctttgtgtattttcactgagacaataagagaatatttcatcattccgaaggtgttggtgttaagggtgggcagaggccaaatcagggttgttgatgacaaccatgctctctattcctttatttgccattcccttgttgtattttttttaaaatggaatgtttttaaccttttgtatttgatattttttttctccttgatcagttgtctgttattttattatctggaaaatcttatattatactcagcctctttcattttgtgttagggcagtgacttccagccttactgattgccagcatatccccaggttttgttgttgttgttgttgttttactggagattttttagcccaaagtgtgttttaaaatcctcgaagcataacggtaacttacttttttgataaaacttaccatactttatttagaacaaaagggcagccacaaaatagcagtggctccttataaaatagacacattccagtgggccccgtcacttttctgctcatttctgtctgttctgtccatcatacctaagtcatatatttctgttcatttagttgggacagaactcacccaatgttatcattgtactaaatataaatgtgcccctaatggttttgacttttgcttaagtttttgagtcctcatgtatgttaggtagtgccatctagtagccagaaatttgggaactggctgggcatgatggctaatacctgtaatcccagcactttgggaggcttaggtgggtggatcacttgaggtcaggagttccagaccagcctggccaacatggtgaaaccacatctctactaaaatataaaaaaatagccaggtatgatggcccatgcctgtaatccgagctaattgggaggctgagatgggaggactgcttgaacctgggaggtggaggctgctgtgagccaagattgtgccactgcactccagcctgggcaacagagtgagaccctgtctcacaaaaacaagaaacaaaacaaaacaaaagacaagaaacctgagaagcgcagtagattcaattatatatatctacttttaatttgctagctctgtgaccttaggaaagttacataacctctctgaactgcaactgtttcatttacaaaatggagataatgatagtttttctctaattggtttgttgtgagataattcatataaagctgatggtgccagattacactcaaaaaaagcattcagctgtcattatcattatgacttcttttgttaatgttatagcctttccttctctagggaaaaggaggccagagtggacctaggctgactgagagaattcagctcagtcttttgaattattttgaggtagaggaatgattgatatagtatagattattaaattaggacttcacttttggagaaaaggtcagatatcattgttgtcttatttttcttcactttcccacatttttgcagccatagctccatccatttggttaagaacttagaagctcacaaactcgggtcaaagacaggtcgaaatcctcaaatcccttaagaacttcagcttattcaggaagggatatttacagaaaactagcaattgtataagtctccaaaaaagcatacattacttgaggatccatatatttttggcatcctcagggttgctgtgatgatttatagaaggtttgtttatttaatttactttatttcaaataggttttaatttttgtacccttaagaaaagattcgtactcttccctggcagattaaagaaaatgagcgtatattccctaaccttggccagttactttcctgggtttgagggtttctgtgaacgtctaacttacctctgtgacctgtttctgcaaccaggggtgttgcaatggatgcttttgtcttgaggatgggacctttcaagaaacagattcactgaggtgcagtgggaaggtcagagaaagatcttcgtatcgcctattattatttgctcgtctattttttctcctttcttaaggccactaactgattctcctttgctaaggctgcctacttccactgagaccttgaaccacatgaaattgttgttgtctgtgtttctggtcaaatagtggcaattttgtatgattcaatcttgtcatttaattttttgggaggttattattctatttcataccttttttatacccatcttctttacttcatttacctgtccctcatacttgacttgtagcttgtcccttcactgtcatcgtctggccatgtgggtgtgtacgtgtgtgcgagagagagaatgtgtgagaatgtatgtttctttatgcattgggatttagggtttttcttgcaattgtgatttctctgggcacttttgttaatatagctagtcagcgagtgctctagataattttccttgcctccccctctttgaaagaaaagagggtgttcttagatgtattcttatcagataagccagtagctcaggtgctggtctggctttggtgtcattggggtctgaggttgctgacttttaccttctctgctgaaaaattaccttcagcagaaacgtctgaattgcaaggagaaggagaaaaaaacaggccaaacacagtccttggtactccttgggagccactgagaagagtccaggttcaaatggtcagaaggttattttaatgattgtgtctggcctaaagtaccattagcttccagtggagtttagaatgtggatggatcctgaaaggtattccccagaggtttggattaataggcacaagggaaccctaaaggactctattggcctgatactccccatatccacgtagaagagctttagaagaaccttctgttctgagaccctggctgggcccacccagagctggcccattcaactcttactcctttgccaccactaatggttcttctactagtttttatattatttaacaaaaaggcactttaaaaatgcactcctggcaatctatactggaatatgaaaaacatgctgcaaaaccttgacactccaagtgtggtcttacagttcccagaatcccctccttgaggagctgctagaaatgctgaatctcaagcatctccccagacctactgaatcagagcctgcatctgaagctttacggtgtacaagctgttttatgtgaaggctgaagtttgaaaagcactgcattaaagcgttagtttggtataaactgccctgactgaacttggtgtgtccacttagcttgcatgatgactgttgctttgatgatgaaggcttacacgggtagatcctttgagtgagtgatctgacatgattctcctttgctaaggcatctagattcagtgcacaacttacagctgtttgtctttaggggaaatacaactgtaaaattaataaaaacatagtctcttcttatgataacatggaacgatggcaaaatagattttgttagcacttgggtaggaattctgaatgaagcaggcaaattctgttggcagtgaaatgataggatgtggtaaagttagaataaaataaacttaaatgtctcaaactctcatggtatatactaccagtttaataataatgttgtacctttgatgatttgcagactacaagcattcaaggtgctgtgttatatattacttgcttggagaataatacttcttaaaaattgaaattcagaaattttaaatcagacaaagcttttgtgcatggcccacttaaatggctattttgaaataatgatagtggatatagaaggattattctgtaataggatgagactgttccttttgtcatggagatcataatcatatttttgtaaatttttattatttttttggttttgtgtccatcctgcacactattactgggtaggtacatggttttttaacatggtttatctttcaaaactataaaggcattgcaaacagaagacaggtcatttatttttcttccaaaagcatctaaaatgagattttgatatttgaggtcataaagaggtgagagaacagacaacagttgggaaagctatttctcttgaaattgtttggccttaattactacagtgtcctagtaccacccatacgtttccaaagaagtagatccctgtaaatgcctttgtctctggacttttgagtaaaatagtagggtgtgctttgcaaaatgtcatcgttgatgttgagtttcagagtctttaattaggaagctgaaatctgtatatcgagatttgtaaatcatctaaattgcagagtaatgttttagaatactgcttaagggattggcattaaagccttttttaaaaaagaaatgcaataatttcctcaaatcctcactcattagacctctactaactatagtgctgacttttttttttttttaccctaaagtctggaattccaaagaaatgcttcaccatttcccccattattatagccacctggaagcagtattcatgtattagatcaaaaacacaacaaagaattatgaaaggttgtttcctggtatgcaatgcatgatgacatgaacttacagaacagagagaagggaggctccatgtttatttaaagaggaaatttttattttctggttacctacttttacatgggttacatcaaatcccacgatgaggtttaaaaattctcatagataatcaaacgtcattacttggcttactgaaattcagacttttcttttttcttccctgtttttctctatcaaattagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagtcttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttagaaaaaagaaaaaaacaaacaaacaaaaaaaccccaccccagttgacactttaatatttcccaatgaagactttatttatggaatggaatggaaaaaaaaacagctattttgaaaatatatttatatctacgaaaagaagttgggaaaacaaatattttaatcagagaattattccttaaagatttaaaatgtatttagttgtacattttatatgggttcaaccccagcacatgaagtataatggtcagatttattttgtatttatttactattataaccactttttaggaaaaaaatagctaatttgtatttatatgtaatcaaaagaagtatcgggtttgtacataattttccaaaaattgtagttgttttcagttgtgtgtatttaagatgaaaagtctacatggaaggttactctggcaaagtgcttagcacgtttgcttttttgcagtgctactgttgagttcacaagttcaagtccagaaaaaaaaagtggataatccactctgctgactttcaagattattatattattcaattctcaggaatgttgcagagtgattgtccaatccatgagaatttacatccttattaggtggaatatttggataagaaccagacattgctgatctattatagaaactctcctcctgccccttaatttacagaaagaataaagcaggatccatagaaataattaggaaaacgatgaacctgcaggaaagtgaatgatggtttgttgttcttctttcctaaattagtgatcccttcaaaggggctgatctggccaaagtattcaataaaacgtaagatttcttcattattgatattgtggtcatatatatttaaaattgatatctcgtggccctcatcaagggttggaaatttatttgtgttttacctttacctcatctgagagctctttattctccaaagaacccagttttctaactttttgcccaacacgcagcaaaattatgcacatcgtgttttctgcccaccctctgttctctgacctatcagcttgcttttctttccaaggttgtgtgtttgaacacatttctccaaatgttaaacctatttcagataataaatatcaaatctctggcatttcattctataaagtccaacctgtaagagaaaatggtgcatttgtatagcgcttacaatgatgaccttgtgtttgcatttttgtttctgaagttatatattttagagggggtgggggaaaggtaatgaatggctggaaaattgcaggcaagttatttgataagtcatatttgcactaaaggtgttaccagtgatttagtatttttcaaatgaacttctttggggcagaaagatttaagggaaaactaaagcctacaaaacaagcaaaacctggataacccgagataaagtttcagagataatagcccatgcaacagaggcaacggtgccagaaaattagaaagggaaagtgtcggagatcagcttctataagaacatctgccagttggactgacgcccaaacagaatgaagtcaaattaggctgctcagattgaacacttaccagagtgtcagggcttctgtaccctgggttagaatcagaccaaggaagggttcagcagatgttcataagagcagggcacccacaactacccactattttactggcagtattttaggtcagtttccaggactttgcatcccctctgatcctgccatgcatgattggtgaaacctacttctaatctccttggaattggctaaaaaacagtgtgtttataatggaacagactgttataatcaaattcttcctaggaattaacttttgatgactatgagcttagttacagttcggaggttatgaggttatgtaaaccttatctttaaatgtgcatgacagttatcttttactaatgctggttaacttttaaaatcttgcagctcctttttatctctagttctattgttcttgattaggtgagaaccattagaccatacccaactgaggggattggggtcttgtttgttctccagctgttcttcaccctctattgccatggacatgaaggacagactgcacggtcttaacatgttaaaacgaatgacccatgttttctcatattcacattctctagatgagagcatgagagtatagcacaagaatttcatcctttggcagttccatccacccttttgatttctctgcttcattggttctaatattcttggttaaaactgttttcaatggtgtcaactaaaatgtgttatcttgcatatgcgtatttaatatataaaacataaaatacataaatatacatctaaagatgtatgtaatatgtagtacatatgtatagatgctggcattttcagtttagtttcagagattttataatcagacactctgaccctcttggaagctcacatgagaaacaatatttttacaaacattctacattgttacagacattttagctcacagtcttcattccgaggaataaagagtcaaaatgaacataacactgaatgtctttaattgcactcactattctataggatccttggaatcatttcagagttggctttaaaaagtc

SEQ ID NO: 16411 - DNA, 54461 bp, Human
aattgttagataaggaagatggtcccataggaggggtgactcagttgactcaactctctcctgggaaatacacttctgcattatcctatttataataacagggtgttatgaagtaaatagtcacccaaagaggaacctcctgagagtagagttgagtgtgacataggacagtccaagaaaatatgtgcacctgacaaggtgctttgaggtagcaggtgaagctcaatcacaagaagtggcataactcaacaaatgactctttctgtacccctgggaaaaccatgtttcccaccaagaatctctcaattcatgacagggaatgtgcaacctcaacggatctctctttcttttgtgactattaagattactatctctcaggctgacacaggtggatcacctgaggttgggagttcaagactagcctggccaacatggtgaaaccccatctctaccaaaaatacaaaaattagctgggcgtggtggcacccacctgtagtcccagctactcgggaggctgaggcaggagaatcacttgaacctaggagacggaggttgcagtgagctgagatcgcaccactgcactccagcctggcaatagagcgagactcagtctcaaaaaaaaaaaaaaaaaaaaagaaaaagattactatctagagaggtaaatcttagagaactcaatgaaactcatagggtttctatttttgaagcaaacttaaatgtgggtgtaacaataatttttagagtcactgtaacatgtgtgtgttttccacttaagagaatttgtcatattaggtttgtagctttattgaagtgtttaaaacaccttgactaagtttgaaaccaacatttaagtatcgaaggcaattggttcatgaattaatagtttgaattattagttgcataatagtgtttaaatatttgaggaaatgtgtttaatagatgtaaaagcttagtaaagtgaacattaaacaaaactaagtagtggtaagtgttctttctatgccagtagcccctgagacgttaaggatcctagcaacagacaagatatctatcatctagtagatttagtagactgtatgttgtagcaaaatcgcatgacctctggctattactattgaaaacaaaatcctaactaagatacttagcagaaaaacccagccagcaactatgtaggttaccttttgtaattacagtctctcgacaagggttattattcaattcatgacttgattaggtttggatcattggcaaatattttgctatgttcacctctttagtaataagcttgaggtttactcctttaaaacacttctgaggtcaagctttctgaagtgacagggattgagaggtgaaggttctagagaaagaggaggccaagcaaccttggtgatcaaaagacttttaagaaaaggaaagattaatattcacctttatgttgcagtgatgcaaactgttccatatctcccagatgttcattacagttgctatataaacaaaaaaaatccaagcacttccgaggtctaaatagttttacttcctatagctatcatacaagaacgattcaaagtgccaattgttgccaatgtcgtgtcattcatggatatgtcagtgattcttccttgctgtggacagcagccgacattcagttatttttctggaatagacacctcagcttgctacttgctgggctgatctaagatactctgaagattcgctagggacttatgagctactaatgctcagggatttagtgtcctgaagaactctttaatcctgtgcttcctgaatcccaccctaagccagggccttctgtcacatcccaagagttacaggcagtttgaaagctctgctttctgcttgacctttggaagtcctatgagggaccatttacggtttcctcagtaatttccaccaggatgaatttccttctcatcactctgcctcaggtagtgctctgaaggtcgtcctttctgaacaaacgcagcaaagcaagccacaccatgggtgagatcaaccaagttgccgtggagaaatacctggaggagaaccctcagtttgccaaggagtactttgacaggaagttgcgggtggaggtgctgggagaaatcttcaagaacagccaggtgccagtccagtccagcatgtccttctctgagctgacccaggtggaggagtcagccctgtgcttggagctgctgtggaccgtgcaggaggaggggggcaccccagagcagggggttcacagggccctgcagaggctggcccacctgctccaggctgaccgctgcagcatgttcctgtgccggtcccggaacggcatacctgaggtggcctctaggttgctggatgtcacccccacctccaagtttgaggacaacctggtgggccctgacaaagaagttgtgtttccattggacattgggatagtgggttgggctgctcacacgaagaaaactcataatgtcccagatgtgaaaaaggtaggtggccttatgacagtggggcagaggtcttggcagggtcagggaggaacaaatgggaaagagagatagtgctatccttgtggcattagtttggcaataaccgggggaatgtgggtggcagggaagaggatcacccaggcctagtgttgccaaatttagcaaatgaaatttcaagttgcccagttgaacttgaatttcagataaacaatgaattattattttctgaagtataagtatgtcccatgtaaagtttggcattttatcaggtgatcctacctggccctggtgcattccacacaccctcccttacgcctcctccagtgctctgggggactttccttctcagcaacaccagcaaaacaaactaccccactagggagatgggccaacgtgcccagatgccaagacttgtgaactgctccccatgcctctcattcacagtccttcgaaaacattcaggttttttggatggatttgctagtaaatcaattctttcatctatcgaccaaatgtgcaaagagaaaaaatgatgccatttgaaagttcagatgttcaaatttggaattcattacatatgtgaatttaggtgatggttaagtgcaattgaccactcccactgctccataacccagatctttcaagaatgaattccaatcaagtaagtgggacatttggaccctcttgaagaccaacagcatactgcacaaatacaaggcattgagatgccccttatagaaatagaaaaactttattcttaccattagagtacatgttcatttttaaacaattataagatacaaataaaccagaggaggaaatgctaatcacccatcatccctcccctcagcaataatcaagggtaccagcttggagattctcctggcagctccttctctacacatgtggtccattattacagtttaccattaacaaaaagggaaaagtggattatgatggaacagagttgaatgggaacaacttgtgaaatgctttctgtgcaggggtgtatagggcagctggagaggcaggaggataatctcctaaatgcctcctgaagctgattatagggggagggtcacacggacccaagaggtgtggaagtcatcaaacacgagtgactctctgcaaacaaccacagaacaccgctcaggtgcaagggttaccatggggcctggtagggcttcagtcctgaataattcctcctttcagtaagtttaagctgggttaagtttgcttttgagcctgactgcagctgcttcaagtgtctaaatggatgctcatccttagggcaaagttctctagacaaccaactggaaggcaatgtctgcacatcctgaggtttttctcatgggaatacgctccttgagggtccccaactgagcccatccctgctagcacatcaaacttgaaaaagtgacattcagcaattttttgaaaggcttttaaagaagagatgggtaaaatgatttctgctgttatactttgattagcccagttctctgtggtgagaaggaaataagagcatggagctgcttggaggtggttttggtctgcggctgtccatggtgagcatcacggcatggacggagcacttcatctgggagtggggagtctctcctctcttctctggaggactcctggctgttctgggtgggacacagagaaatgtgtgttgaagacagatacggttctgtgctcacgagaaagagacctcattggttcttcatttcaactgcttcttcacatttttttctctctagagtggggattccaactctggctgtacattaaaaccatattaagctgtgtgcagtggctcacgcctgtaatcccagcattttgggaggccacggcgggtggatggcttaagcccaggagttcgagaccaggctggccaacatgggaaacccccgtctctaccaaaaatacaaaaataagccaggcatggtggtgtgtgcctggagtcccagctacttggaaggttgagatgggaggatggcctgagtctgggaggccaaggctgcagtgagctgtgttcacacactgcactccagcctgggtgacagaatgaaaccctgtctcaaaaaataaacacaatccacaaaaccatattggtggctttattgttacagcggactctcaaagattagaattcaggcattagtatttttattttattatttatttatttttgagacagtcttgctccatcacccaggctggagtgcgatggcgctatcttggctcactgcaacctctgcctcccgggttcaagcaattatcctgcctcagcatcctgagtagctgggactacagaggtgcaccactatgcctggctaatttttgtatttttagtagaaacggggtttcaccatgttggccaggctggtactgaactcctgacctcaggtgatccacctgtctcggactttcaaagtgctgggattacaggcgtgagccactgcgcccggcccaggcattggtatttttaaaaagctcccccagctacttctaatatgcagccaatgttgaaaaccactggtctcttgggtaagcagatacaggaggaggaagtgaatttcaaatcagctgtggaatattagagatggaaggggcttatgaagtctttagcccaactctgtcctatggaggacaggaagttgaggccataggagttgtatatcccccgggtccatggtgtgtgtctgtggatgaggagggttggaacggaggtggctgagtatgtgtccagtgctgtttgcctaccttacacccctgcagtttcacttgctttagccgctgcagtaagatttgcaacgggaaaggaagtagaaaccaatgtttcaaatgaaatatctgattaattcttcctcttttcattgcacttgacaatttaaacaacattctctgacaagggtcatatttttatttccagcctgtgtagtaggaatcgttcaaagttaggtagacaggaagtggcagatctggggcaataactcaggtcttggaggcctccctctttctaccatatccctgaccacacacaactttcctctggctagcagtgtgggcgcaggtgagggaaagacttctcacacctagacaaaggtacagaactacatactcccaaccttggagggtccatgaaggtaacagggaagccactagtatagggagagggctgtggcatcagacagacctgggtgaagatccatgtctgtgacgtagtaactgtgtgatggagtttctacccctaagaaatggagataagcaaatgtacagattaaatgtatataaaggacctgactcatagtagatgctcaataaatgatagctgtgataatattgtcattatgccagtaggcgtttaggagctggatatggttggccaaaaaatggtcaatgattattgcctgttttaaaacaagttgaaggcaggaagacttttttttttttttttttttgagacggagtctcgctctgtcacaaggctggagtgcaatggcttgatctcggctcactgcaacctctgcctcccaagttagagccattctcctgcctcagcctccccagtagctgggattacaggcatgcaccaccatgcccagctaatttttgtatttttagtagagacagggtttcaccatgttggccaggctcgtcttgaacttctgacctcgtgatctgcccacataggcctcccaaagtgctgagaggaagacttttaagaacaggaaactgagagatatcctctttaagttgtttttttctctattcggaaagctgtccataaactatgggtgatcctgattctgactgtggtttaaaagtcctccttcctctctcttcctttcctcctctacttctgctttggatctcaggggttaagggtgtttaatcaggatttagcaatactgacatctgatgagggatcaggcctcctgttgctctaaacaatgttctccagctgccttcaagggcttctctgaagaaccatcaagggacacacgcaggatttatgcaaagaaacttcgctaaggaatttttgagctagtgaaaataaaacacaaaaacccctcccccatccccatcctgtaacttaatggctggtttatctagggctttcagatgcaataataagcaagtatcaaattttgaaacttacaagccattttctcaaaacagtccattgaacttaacatttccttgtgtttagaatctggaataaaatggcattaagtttgaagctgcagagtgaaatgtgtttgcaaagaagtgctgccagctaagcatggtggcttacacctgtaatctcagcactttgggaagctgaggtgggcagatcacctgaggtcaggagtttgtgaccagcctggccaacacagtgaaaacctgtccctactaaaaatacaaaaattagccaggtgtggtggcaggtgtctgtaatcccagctacttaggaggctgaggcaggagaatcacttgaacctggaaggtgaagcctgcagtgatcagagatcacgccattgcactctagcctgggcaacgagagcaaaactctgtctcaaaaaaaagaaagaaagaagtcctggctaacttcaccccatggtgcacatttctggtatttcgatgattcctttagtgcccaggctgtgtaaatgaaggtgatgtgatctgcatggataacagggtggaagggaaacaatgggagctggcctagacaagcagtggattaagagaaagaatctaacaaaaactgcagacactttggtctgagggtgaagatgctatggggaaccagagagaggtaacagataaaatggatagaaaagaaatgtggttcttggtggcatgagtgagggagtgtgctggccttctggaggaagggtgctccgcggtatgggaggcctacatccagctatgggcatctgatttcttcagtgatttgaattggctagaaaaattaaaactagaagcaaaatggtaattgcaaaagaactacttctcattcaggaaagcctagaaaagtactaagtttctcttcctagtacttactgaatactatgtgccagacactctttttttttctaagtgctcagcctatactatgttattctatcttcacatcaggaattctaggcagtagatggaagcattacccctattttcagattacaaaacgaggacacagaaggtaagtaacacgcccaggaccatacagctagtacactggggcccagtttcagccaagaaagtctgactccaataccttccttgcctttatgcaatgctgatgcctcaagagttggtttgtgtgtttccactttgggaaaggtatagaagagatctggagtgaggggctgcctttatcccctttacatcacatatttcctctgagagcggtaccatttctggtgatcctctgcaggagtgattccccattgggttgagcctaagaattacctgggccacgtaaaagtgcaggttccactgtaggagattaggattcagtgcatctgctgcattaatctgcaggtgattctgaggcatatctcaggactgctaatctcatttgagctctatgagttctattggccaaccagcccttgttccctggtggaaactctggcctggaaatgacacacccagaaaattctcacatttttttctacgggaaaccagacagaatccagtctgcaaggtttgtgctgcttttagaagcactgccaacacagggaaatgaaaataatacaactgtggaaggaataccgcactaattttggccaacgagtctcagagttaaggctgaagttcagttctaattgaagaagtcctaggttcaaagggaagaatgtcatgacccaaggaaggctgggtctaaacccaccgtgagtggctattctctgaaatgataactaataagataattgccttccttgacctttttctcaagcccttccatttgtgcgcttctccagactcattactcagcctctgctatggccagtggattagaattatctctcgaatctactctatgaggtctgaatctgggaagatccactttcctctctcccagagaaagaaaaaaaaataggaatggaagacataagcctggtagaacattaaaaacctgataagcatctgatgctggcaagagggtagtccttggtcctttcacacagggtcagtggaagttagaatgtgaacctttctttttctttttcttttttttgagatagagttttgctcttgttgcccaggctggagtacaatggcacgatcttggcttactgcaacctctgtctcccgggttcaagcgactcccctgcctcagcctcctgagtagcggagattacaggggcgtgccaccacgcttggctagtttttgtattttagtagagacagggtttcatcatgttggccaggctggtctcgaactcctaacctcaggtgatccgcctgccttggcctcccaaagtgctgggattacaggcgtgaaccaccccgcccagcctcagaatgtgaacctttcatcaaagtaatctatgtaaagaaaaactgtatgttcctgtggctccagcaaaagggatttccttttttgggaatctgtcacataaaaataaaagcaagaaggattagtgcagtattgttggtagtggggaaaactatacacaggcaaaatcagtaaaggacagttgagtggatcataaagcacccagggtggagtagtgtgcacaaatctaagaggtgagttcacatccatatgcattggtcttcagggaagtccctaagacattgttaagtgatgaaactattataagcaattagaaaaggaaattttagaaaaaatagaaaactctttgttcaagcatggagaaaggcataggagacacaccagcagttagcacggatttcttctagtaggctagattggaaggaactgggggcaatgataatttttgctttatgttatgacatatgggttgatgatttcaagtgcatgttttccctttgtaatgagagagaagcgctctatgaactgtgtctgtattcctagctgtgctctccttccctgcatgtacttgctgtctattgtaaccttgtgccttcccctctcttcctcttagcacctcactttccacttggctgtctgatcacctcttttcttctggcccaacctcagcctaacctaaataggccatagctcaggttggcagcgcttattctgaaatgggcaattccattctatgcagtcataggatggcaggtggagtgggattgtttactggggaccactgtactggagccctggttatctgttggtagcatttaaatgagagagaatgatctgtcatcatccctagatctaccactctatgattttgtgccactttgacaaatatgtgactgtctctttcagaacagccatttttctgacttcatggacaagcaaactgggtatgtcactaagaacctgctggcaaccccgatcgtggtgggcaaggaggttcttgctgtgatcatggcagttaacaaagtaaatgcatctgaattttccaaacaggatgaagaggtaatgctaaccctgggcatctggttggaggctcaggaaatttatttgttgtataaccaaagaaaagatgtcacaaccataacttgttattctctgccgtctgtaggtcttttccaaatacctcaactttgtgtctatcatcctaaggcttcatcacaccagctacatgtacaatattgaatcccgaagaagccaggtaaaaggaaggcagcattagtcattccatgctgacctattctgacaaagccgcccagagacaacaaattcagacccctcctattcctcctgggggtgtaagccacgtggaacagatccccaaacttcagtcccacgtgtcctctcatgatcttcccgccactctccccacacacactcccctgcaccccaagctctccaattgtgtacacaactggcttggctttcttcagtctagatcccgagtggacttggcatttctgtctatgagatggtgatgacaataatggtacctacttcagatggttgttgtgactattagcgattagctctcaaataaagtttgtagaaattcctgggtcatagtaaacctattaatttgaggagcatattattcctaactccatgagacagagggataaagggcactattagtacctaagatacctaggtctggcccactctctggacctcagtttcctcaccagtacaatgcacgagtagaggttgagagggaggtcccttcccgtttgaactctccaggtaaggttacctctgactatctcaggatgcatggaaggaggtatgtggctctctccacatcagggccagcaggagccagtgggccaccgatactggattctccgtccagggaccatccctgcatcccatttcagggcacttcccctttggagccaaaacatctagacacaggaaccaatcatagcttctctctctccatagacccgcagccttgcaaaagtctactcatcatctcacctagaggatctgagtagtttgttggatgtacacatgttcaaaatcagaattgcactttccaatgatatgcatttattttatttgatgcacctcatgttttcttgtggtgaatgctctatctctccatagcatactttattctaactgttttctttttgatacctactttcagatccttatgtggtcagccaataaagtatttgaagaactcacagatgttgagcgacagtttcacaaagcgctctacacggttagatcatatctgaactgtgaacgatactccattggactgctggacatgaccaaggagaaggttcttattattctacacattttgtctcatctcacatcgcctatataacacacaccacaggaaatgtgatccttaaaaaacagatacactatgtaaataattagtcatgattgatgacaagaacagaggtaaaagtgtgtgtcttggagcaaaaaagatgtaggcttgaatcttggtttttccacttcctagtaatatgggttttcagcaagtctgttttttttttacattaattaatagactatttttagagtagtattgacagaaaaattgattataaagtacggagtttcctcttccctcccaatctcctctcccagtttccctgttattaatatcttgcattagtgtggtgtgatgaatcaatattgatatattattattaactaaagtccatagtttacatgagggttcatcctttgtgcagttctctgggttttgacaaatgtgtaatgtcatatatctgctactacagtatcagacagactactttcagtgcctcaaagccctctgtgcttcacatattcaacctttcctcaccccttccaaactcctggtagccacaggtttttttttgtttttttttttgttgtttttttttttttgctgtttctatagtttttgccttttccagaatgccatatagttggaatcatacagtatgtagcttttcagactggcttttcactttgaaatatgcatttaagtttcctccatgtcttttcatgactcaatagctaatttctttttatcactgaataatattccactgtatggcaggtttgtgtatccattcacctgttgaagggtatcttggttgcttctaatatttagtgattgtgaataaagctgctataaccattgtaggtaggtttatgtgtgtctacatgttttcaactcaattgggtaaataccgaatagggcaattgctggattatactgtaagacaaattgatctttgtaagaaactggcagactgtcttccaaagtgactttactgttttgcatgtctaccagatgcactttctcaccagcagttgttaatgtcagtattttgggtattagcagttgctgatgttagtatttggggtatcagttgtggtatctcattgttgttttaattttcagttccccaatgacatatgatgttgagcatcttctcatatgtttacttgccatctgtatatcttcttagagagatagctgctcagattttttgcccacatttttttatgttgttttcttatcattcaattgtaagagttatttgtatattatgggtccaagtcctttaccaaatatgtgatttgcaaatactttctcccagtctgtggcttatcttttcattctcttaacagtgtctgctgcagagcagaaggttttaattttaatgaagtccaatttttctatattttttctttcatggattgtgcttttggtgttgtatctatgaagcctcatcaaacccaagttcacctagatcttctatgtcatctcctagaatttttatacttttgtgttttacatttaggtgtataatccatttcgagttattttttgtgaaaggtacaagttctgtttctagattcactttttttacatgtagatgttcagttgttccaacaaaatttgttgaaaagactatcctttgttcattgcctttgcgcctttgtccaagttaactatatttgtaagggtctatttctgggttctctattttgtttcattgattcatttgtccattctttcactaataccacactgtcttgattattgcagcttcatggcaaatcttaagtcaggtagtgtcagctttttgattttgttcttcttgtcagcaagtcttttaacctacctgattcttggcttcttcatctgtaaaatgaggacatctctcttatcaattgtgagaattagagattttatatatttttttatatatataaacactatatgtacatagtgtctagaatttacacagtaggtggataatcaatattatctttaccaactttaggtttttgtattctaaaaaaatttaattaaagtagaaatattgaaacatgtaatattattcacaatataatgcccttgtgtcatcttctttaattctgttgctacccttctagttcaaaataactaacgataccatattatttatatattttttcttttgttttctttcctttttttgagactctgtcttggtctgtcaccaggctggagtgcagtggcatgatcttggctcactgcaacctcagcctcccaggttcaagcgattctcatgcctcagtagctgggattataggcctgtaccaccacgtccactgattttcggtattttagtagagacaggatttcgccacgttggccagactggtctcgaactcctgtcctcaagtgatccgctcgccttggcctctcaaagtgctgggattacaggcatgagccaccgcacctggccttatttatatttcttcatattcatgtgattggaagttattttttcagagtaattgttctaagtggataaacataggatgaagcactaggagagctgggttctgatcttggttctgggactttgtagctgagtatgttggttaggattcttttggctataagaaacatcagacacagctaaaagcatctctaacaatatgatatttattctcctacttaacaaggtagggcagcgctagtactggttgattcagagatcagtgcagtcattaaagtccaggtgctttctctttcttcctggcaaggtctctgctacctgcagcgtgctggtgaggcctcctcttatggtggaaagatggctgttgcagctcaaatcattggcacataggcatgacacaactgggaggcattttctccaaatgtcactctcatcagcttttatctgaggaataccttttgccagtagtccctcagcagacttctcccccttcttcaatgtccagatctgggccacatacctgcccttaaactgatctaggcacctcatgtagaccactcatgggctgtggtctgatggaaaattaccacctgatactcaaatcgcatcaggttatgctagcaaggaaaagacagagaatgaatgttgggtaaagcaaccaacattttgccactctgtgtgaccttggccaagccttttaccagatttagcttaattgtctatgaaagaattgctatacattgagtattttgaactatgtgccagggtagatgttacatatgtattattcatttaatcctcacaacaattctttagtacaaattctattgttatccctattttacagatgtaaaaggttaagtaacatgttaacagtcaaaaattcctaaccagtattgctgggaattgtagatctttcagcactaaaattccagaattacgtagattaacataaaatatacaaacacataaaattcatataagatatggtaggtcatggaacagtgtgtttaatgatacttaaatctgattgcctccaggaattctacgatgaatggccaatcaagcttggagaagtagagccttataaaggtccaaagacacctgatggcagggtacgtgcaaatgtcttccttgatgccatctgtgcatggtgtcaggtgctaaaattaagaggccacagtgcatagagcactggcctgggaagacctggagtagtagaaacagcactagacaaggagtttgaggttctagtcccagctatgccccaagctagagctgattggcccctgccttaactccttgttgaacctctccgtttccttttctataaagccagggcttggtagaccagtggttctcaactggaagggatgcatcagagccacctgcacaacattttaaagaagtacctgggcccttcttcagatatgtgggattagaatctctaaggaagggttgggttaggtttactttcccccttgactgcaagcttcatgaaggcagaaacccctgtgtccatagcacacaggaaagagaaggggatggattgtgtccaggcctcagattcatcatctgccccatgaaacagagagaataattctctagtccctttcagctttggcagtgaaacctcctgtttctgaggcacctgttcagataagtcactgatgaaaggagggtacgggtcactatatataatgtaaaactgactacagttaagaaattacatgatttgttctagtgaagttattaatgtcaggtatttctggacaacaaaagggatcacttgaaaataaaaacagactctctgatgatttggtagccaaagatcccccccaccccaaaagctgtttgggggcaattcaactttttaaaaacaaaatttattttagcctgtgcatgtagataaacagccaataatatttctggttttattataagtttgtagtcaggatataagtagtttgataatttatgttataatataatgtggttgggaaataaggttctatttgtaagagttttaaagtacaagttccccaatgaaaaatgatttctttgggaaataacattattcccataatatcctctttctttcttaggaagtcaacttttataaaatcattgattacattttacatggaaaagaagagatcaaagtgattccgtgagtattggcaggaagttgctgccgcagttgccgttgtatttttgcacatattgcatttctctatattgcaatgattttttttcttctcttccccaaggacgcctcctgcagaccactggacactcattagtgggttgccaacatatgttgctgaaaatggatttgtaagttattgaacaaattcaaattttaaataatattgcaagaaactcttattagctaagagatagatacaattgtgaaagcaagaatgcatccaataaaagctagatgggccgggcgcggtggctcatgcctgtaatcccagcactttgggaggctgaggcgggcgaatcatctgaggtcaggagttcgagaccagcctgaccaacatggtgaaaccccgtctctactaaaaatacaaaattagctgggcgtggtggcacatgcctgtaatgccagctacttgggaggctgaggcaaaagaattgcttgaacccaggaggtggagattgcagtgagccaagatcgcgccattgcactccagcctgggcaacaaagtgaaactccacaaaaaaaaaaaaaaaaaaaaaaaagctagatgatcacttcctttggcataggacaaaggagagaagaatcttgacagtcaaatgtaggttaactggagacttctgaactctacacagaaatatttagtcagcatgagaaaggttcctccatccctcaatttcttattctgcagccacacacatttcagatatcctttggaatccaatgactatgatttaatgactgggtttaattctatctcaagtacatcagtcaattttttaaagcataaatatgggggatggggtggggatggtgtgggatgtggaacttttcaatattgagttaaaagcttgggcctctaaggtcttgacccacctgtaaatgttcttataacatttagaacataatgttcttcaaagaaaggactaaaacagataattgctgatgaaaagtttaaaaaagaataggctgctttttgcctcttcaaaaacacagttgaagggtgctcagcccatcaaatgatgtaatttattcaagttagatcatgaaattaatgcatggcatgaaagattccttaaattcttaggctatatatgcttataaaaactttgaaagattctcgcattttctgtgtaagagtactacaaaaatagtagacatggttcattcaattattctcagaaagcacttaccttggggccgagaggcaggcagagtttggtgaggtggggatttaaggagggagcccacttagatcttgttagattgttagttttttaggacttttgtgagcaagttgttaaactgttggcagcttgaaatctcccatggcaagagaattgggaccatggaaattggcaactgatacaagccaaggatttccccaattcccagccaggagagctgatttccccagcacccattctggagctcacagttctagttccatcccatagatttaaacaaatcacttaacctctttaggcttccatttgttcattttttttttttaagtatgaacttaattgctaagatcccttctggctttaaaatgctatgatagctgggtgtggtggctcacgcctgtaatcgtagcactttgggaggccaaggcaggtggattgcctgaggtcaagagttcgagaccagcctggccaacatggtgaaaccttgtctttactaaaaatacaaaaattagttgggcttggtggtgggtgcctgtaatcccagctacttgggaggctgaggcaggagaattgtttgaacccaggaggtggaggttgcagagagctgagatcgcgccattgcactccagcctgggaaacagaacaaaaactccatctcataaaatataaaaaataaaatcaaataaaatgctatgattttaattatctcttggaaagacatggtcttttattaagatccatttgtgattatgacccaaggtacagaaaacttaaaatgacccaaagttgagtgatttcttgtccttatagatgtgagcaatagtctgtgaattccactaagtaaagtgatatctctcactgaatccttactttggtgtaactaaaaacttatctggctgtttcctcctgcctcttaaccatcatcttctaacccaaatctcactttaggaagaagaagaagaagaaaaaaagcaatcctagctctgctgctcatactggctgtagcagagctaggatttctcagctttctcctccccttggcctgagcagcctgttgctttgaatttgaaggggattccctggagtctgggggagtgggaaggggcagagacggtaccacatatcctccagtgatttaattagcagcagggaagccatcttgaatgagttgttagcagctgtggcctagttgaggtccatttgcccgcaagcagtcaagagccgtgtagaaaatcctcactcccaatgcgttctttcttattctgctttgtggatcaagagggctccactacacaatatttcagaccatttgtctcctcttgccttccagatctgtaacatgatgaatgcccctgcggatgaatacttcacatttcaggtaactgcactctgggtcagacctcacctcttggggctggggtagaggagtggatgctctcgcctctcctccacccccagagtccgcctgatgctcaggtgtggccacaggcacacacgggtccatctcccactcaccctggctgggccagcaagtagcagattcttcagtgaaggaagaaaagaaggttaagacagaaggccagggaggggacctgccactcctccatttgctcacactcctggtcatttacggcagtggtccccaacctttttggcaccagggaccggttttgtggaagacaatttttccacagaatgagggtggggtgggagatggttttgggatgaaacttccacctcagatcatcaggcattagttagattctcataaggacggcacaacccagatctctcacatgcgcagttcacaagagggttcacactcctatgagaatctgatgctgctgatgatctgacaggaggtggagctcagacggtaatgtgagcaatggggagtgactgtaaatacagatgaagtttcacccgagtacccactgctctcctcctgctgtacaacctgctggttcctaacaggccatgggccagtactggtttatagtccaggggttggggacccctgatctaagggctcaacagttcctgacacagcattcatgctcaataaacgttctctgcatgcatgaatggctggctacctcctacatcctgaatcctgctctcctggtggttttctcagcagcccttccctgcagcttattgcaactgttctcaggaaaatcaacaattctgactgagtcttcagagcttctcctgctgttagactcggttgtatccttccttctccactgtgcagagacccactgcctggggaatctgcctccactcaccgccagatgctcccaggaatcagcttctgtatgtgctactctacctgacccacttctccccatcagggcttcctgctggaacctggctgcagacccgagttgatccctccccgccccccgagttcatccagcccaccagaagggccagcctgtcatcttcaccaccccctccccaactgtcaccccccacctgtcatctctgccactcccttctctacctgcccatccctcctcacctgtcatctctgccacccactccccacctgtcacctcctcccaacctgactgttagagataaactggcatttggctccacagcctcttattttctgcctctgggcacttgttattctctgtcctgtatttaaaaaaacatccccttagagccctgatctcagtcacaaatagagactgccctccccggtgggtaccgttggggtctgtttttctgtctctctcacatacagagccccatctctgccttttaggaaaagccagccttccccaggctgcagcgtgcctccttagcggcagaaccacaccacaccttggggaaagctgtacacacttgcttcgttacgtgcatctgcctgctcctccctttgccgattgacatggaaaacatgtaaacaccatatggctgctctagctccttcctccttgcaattgaagcttatttgtgaccatgctgtgcccaggcctgacccctatatttatggcacgtggatgtcagaataggatgcatgtcagcaaaagggcgacaatgattttctagagtctgaaccttaagcagtcattgtctaaacagggagtgggaatggagctggcccaggagaatgcaggctgctctgaaatgtgaggccctttgctttctctcatgctccactgcagctactgctctgatgtgctctcatggcctgggcagagaggaggcctggggcctccccggggccttggggagtccccagtgtgggataaacctccaggccacagggatttcccagttctctgggaaacatcattgtggtgcccatgaaaatgtgcttctcagatctccacctgtgggaagtgtagccgtgcaatggctgctggcctgaaatccatggtcacatctgtgctgaggccacacgctccacaggccactcccaattggtaactaagtgtggcagggacagtaaagcaggcctgctcctggaagacagccagataccctgccaggcagcttgggccctaggaatgcctaacagctctgcaaacagtttcagaacagcacggtggtctaaggggctcccctcaaccttccatccttccgtttctcctttgcaaagggtcgggactgcatctctgtctgatgtctctctcagcacccccagcctccctccccgccgctcttcaacggcatcacctgtgcatcattccgcacagcggactaggacgggtgaccgccctccccaaaccaccaccctccttttgtgctccgtcttctgattctgtctctccctgctcaggccccaccctgattcttacgattcctttttgcacctgagaagtttgatagacaagccaatgatataaaaagaactgccatcagagcaaacctgcaaaggcagtggttctcacactatgtttcttgggggcataatggattcatttcctattgctgctgtcacgaattgccactgagtggtttaaaaccacacgaaatgtattatctcacagttctggaggtcagaattccaaaatgagtcttcttgggctaaaatcacggtgctggtgggactcttgctttctggaggctctggggataattcatctccttgccttttccagcttctcagggcctcccgccttccttgcctggtgacccttcccctggcagagccagcagcaccatcactctgaccttgcttttgtcatcatagctccttctcccattctgattctaacctctcttctacttttaaggatccttgtaattacattgggtccacctggaacatccaggctaatttccccatcttaaggccagctaattagcaaccatcattctatctgcaaccttagttcccctgtgttgtgtaagataacatattcacaggttccagagattaggatatagacatctttgggggccattgttctgcctgccatagggttcctcgaagtggactaaggggtcttcctttaacgtcaattaaagtggtcctaattcacaggaggaaaagtgtatagaatttcctcagttttttgtcctactaatttttcttaaaccttgggttccttctgtaacttgtctgtcagtaaggtctaactaatggcaaagcacaagaatatgaactggtagcaaatgaatatttcctgaaacactgagaagcagtcagcaaagcttattttggaagctttaacaaatacgcatgaagttctttcacacgcatgtgatatattctctattactgattttgtccttggttcgtatgatggtgtaagtacataaatatttcttattgttttccaaagatgcaggctttgcaagcactatgcactgcatcttttttctaaagctttgaccatcaggagacggatgttgaggtttggttcctctgcttttcattccatgtataatgactacatagagtagtaacaaattacttagattgagcacttattacatgctcagtctaaatgttaaattgtggttcaggctataagtgcagttggaattccaaaacagaaaagttctttatgagttagaaaaattagaaaggcttcatgggagagccaagacttaacaggggcctgtaaggatgactaagtaagccaagggaagtcttcaagaacaaataatgtggtgtgttgagtgcttgtctatctttgccttagctacatactgtgcaaatgctacatcatggttctcaaacttcagagggcatcagaattacctgggaagcttattgaagatgcatgcccaggccaggcatagtgactcacgcctgtaatcccagcagtttgggaggctgaggcgggcggatcacttgaggtcaggagttcaagatcagcctggccaacatggtaaaacctcatctttactaaaaatacaaaaattagccaggcttggtggggcatgcttgtaatcccagctactcgtgaggctgaggcaggagaatcacttgaacctgggaggcagaggttgcagtgagccaagattgtgccgttgtactccagcctgggtgacacagtgagaccctgtctcaaaaaaaaaaaaaaaaaaaaaaaaaataaacaagctaaaacaaatctgttacacatggtccttggaccacactttgagaaacactcctaaacttttgtgcctgcatccctcgactagaccctaagcatcttgagggcaagacctgtgatttattctttgtaccttcagcaactgccccagttcctggcataccacagaggcttgacaaatgtttactcaactcaacacaccacagaatgaaagactatcttcatggatcagtcagaaaaacaaaaaccacactagtattttaacgggagaattttatttaaggaattagctaaacaggtgttagaagatagaaaaagtgtaaagggaacagtgaggtaacatagtggtaagaagcacttcccatcactcaggcttgggaaagaaagggaaaaggttagaattgtcagaaaacagacacttggttctagttcactctattggatgtgctagagtacatataatggctgtatggtcctagccatgttctgacacaaagtaggaattgcacatctaacaccaaaagattactctttcttttttttttttgagatggaatttcactctgctgcccaggctggagtgcagtggcacgatcttggctcactgcagcctctgcctcctgggttcaagcaattctcctgcctcagcctcccaagtagctgggattacaggtgcccaccatcacgcctggctaatttttgtatttttagtagagatggggtttcaccatgttgaccaggctggtctcgagctcctgacctcaggtgatctgcctcccaaagtgctgggattacaggctccagccactgtgcccagcctttttctttaaattaaaaataaactaagtgacaggtggttgggtggtagctagaagggaggagtacaggacagtcttgtagtgatggaatagtgttgtatcttgattctaatggtggttgaaaagctacacaagggataaatttgcataaaactatatgtacacacacacatatatgtgcaaaagtaactgcatacaaatcttggtaaaatccaaatcagctctggatcgtacaatgtctgttttctggtttcgatattgtactatagttacacaagacggtagaaaatgtactgtagttgtctaaccatcattaccattgtgtgaaactgggtgaagggtacctgaaatctctctgtacatttcttttgtaatatcctgtgaatctatgattatttcaaactaaaaaggcaaaaaaataacttgaggtcccttctcgtttgtagaaaggacctgtagacgaaactggttgggtcattaagaatgttttgtccctgcctattgtcaacaagaaagaagatattgtgggagtggctacattttacaacaggaaggatggaaaacctttcgatgagcatgatgaatacattaccgaggcaagtgcaataataagataatggaagtcaatgcaattcacaaaataagagagggcacgtaattatttgttattctggaatgatattttgaagggccattaagacatgagtcacacatagctgtaaccaatatgttgttattttgtcgtttctatttcctgacttctataaactgcaacattttctaccaaagtataaaattttagcttaaccaaaatttgtaataatactcggaaaacaggaaagaggattttcttcttctttctcccactcctccttcctgttccctctcattcttattcttattcttacgcccagccccctgcctaatttttaggtcctgcttgactatactggtgttggtaacacctctctcttctattcatggtgcatggtacactttaaaaagcaataattcagccagttttattgtctgaagctgattattagtatgtttttcttaaattaaaagaaggaatggggtggttgatgatggaagggagatggatagaaaagcgtgcagattgttgcctccaaaccaatttttctttcactgaagagaattagaatcaccttttatccgtttcagactctcacacaatttcttggatggtctcttttaaatactgacacctacgataagatgaataagctagaaaacagaaaggacattgctcaggaaatgctcatgaaccaaaccaaagccactcctgaagaaattaagtccattttggtaagtgggaaattcagtcctgtggacataagatgttacctaaccacatattctagaagtcatctaattacccaggggtctgacaaatgcaaatggtttactcctgggctgagagagagagacagggaaggaggggttggaagaagacatggatggcccagtgtacagagacccttactggaagtacagctgcttggctggaatagcactttgttcaaaacagccctggggctatgggagctatagcaagaaaaaaatatatatattttaggaagggaaatgtatcagtcagctattgtcatataatgctgcataacaacaaccctaacacctcagtgtcatgcagtaatgaacctctatctctcactcacatttgtgggttgaccaggctttgattgacagtggctggacttggctccaagctatgaatttggtttgctctatgtgtctctcatccttcttggaccaggagctacctgatagatgtccttctcacaaagatgacagaagtgcaagagagcaaacctaactgtgcaggcatacttcaggtttttgctcacatcacattcaccaaaatgctcattggccaaagaaagccacatcacgaagaccaaccttatagatgatgggggagcaagtggatatttgctaaccatgttctaatcaccacaaaatgaagggaaaatatcatgtgcccaccatctctatttcttttatttccctggctttgtgtgtgtgtgtgtgtgtgtgtgtgtgtgtgtgtgtgtgtgtgtgtagttttgctggagtgggttggttttggtgagcatgttggtttttggttttgccgagtggtttgagtgtaattcagtttgatagtttgagatgttaaagatgagaagatctgggggtaataaaaggaactgtgataagctaatacaaaaataaatgtaagccactcattttttctttcctacatgcaaacaacccacacctctttaaaaaaaccagctactgtaatcattttgggggaattttaaaaatcaaatatattagattatttcttgaaaaaagtcttcataatcaggtgctataggtctttgtatccatgacaaagaatgcgtctttgccatggaactcattgtagtatattttatttatttacttatttttagagatggggtctcactctctcacctaggctggattacagtggtgccatcatagctcactgcatcttccaactcctgggctccagggatcttcccgcctcttcctcccacatattttaaatatatcttaactaagattgtaatagtagaggaatcagatggaaatcttctcctttaggaatttcacacctcaattgcttttacattttagaaatttcaagagaagttaaatgttgatgtaattgacgactgtgaagaaaaacaacttgttgcaattttggtaagtgttttctttctaaccttaatgcctgttaaatagaggcattataaatcaataatatattaggacatgctttcttgtttttcaagtaaatgttgagttttctctttcctgatatttctcaaggctaaaaagaaagaattcttctaaagattgatcttttgattccctgcttttcttcatctttgtcgcctctggtccaattcatacagataatttacaattgtaggtagcctagactactgcttaggggacttcaggcacagaatctagggatatcaaggcacagtttattttaatagctttggatgacaccatggccaccacagagaacatgacagagttagcgtggagcatggatctttctaggcactggcaccgcctgccatttctagcttctcttctggagtctgaaggctccattctttcctgttgttgccagtaggccatccctattatttttctttgaaattaactttcccacttcactaattctgtcttttgttgtgcccgatcaactgttaaactcgctcaataagttcgtaatttcagagatttttttcagttctagaaggtacatttaattcttttgttaagattctaactctgtgttaaaacttttcatcatttgatctattttgactattttcccctgtattttcataaatgtattgatgtgtattattttaaggtacccatcttaataccagaatcacctgtagatctgattctactgtttatttttacacctgggttctagtcatttgatcctgttttaaagcatgccttatgcttttaaaataaaaaatcagatattgtagataaaaacgtgtaggggctctgagtgatattatccttctgcaaagagcattagagtttcttctggcaggtgagagaattgttttagatttcatttggaatgatcttttttggctttattcctactattagggtggagcccttgtttctagaaagtggctcctctggaatccatgaaatcctgggatatttacgaagaccccaagaccttgaatttcagaggattgaattccttctgattgaaatggaaatatcacacttaatttccttactaactgctataacctgttttccaccatctctttccgatctgtgatgtgagcattctttctaaactaagacacatcgactatctcaccttctccctttccatcttttgtgggctctgtcctcccacccagggcctttgctctgctaccataagactgttggtctttgacccttttttggggcttacttcccacccccgtgttttcatgtcatctgaggttcccttttctcccattttgcttggctccacctttggcaccatcctctcagcctggcccagaagaccaccctttcttctccccacctgccctcaacaataggcatcttcttggaaaacaaaacttttattgacatccgtgtcaccagaaattctctaatttcttatttaaaggaagaaggatcttatgttgtagaagcaataaagtggacaaagaaccagtagacttcctaaaaaaccagcctattttgaatgtaaaatctactcagggcaaatcccaaatcattgttgcataaaattgaggaacgtaacaaatatttcagaggagttctccaaaattatcctggcatcatttcccagctacgtaattatttgtccatcttcacgtacctgagtctctctccaggcctgcactttcatgttacctccagggaaggctcagctgattttctgggtgtagcaacagttctgtgcaagagtgtgaggggtcagcccaggctcaggggctgggggaaccagaaaccgtaattttgttttaaatagctatataccattcggtgttgaaatctgtgtaaatagagcatggctgtcccctgaaaaacattaaacttactaaggggagtgacctccctttccctatgtttgtgtcctcctcagtgcactagtaaggacatactacacattcaaataaatacccattgaactgaatctctcctgcagatctgtctggtaggcccacatagttgttgctcatttctgcctcttagcactttctcacccacatggaatcgtctctccgcttccttctgccagctcagctgcatgcatgtccctccagcatctctcctcctttaatttccccacctgtccaaggacattcagtttctccctcggcatggagcactggccatactctctgattattctaagtgcttacttttcactcgtatatattttatagccactttaataagttaagttccttaagggcaagatacatatttttatttctcaagtcgcaccaatgccatgtgtctacttggctattttttcacataatccgaaatcctaaccagatgtgagttaaatgaaatgtctgcaagtatacctatgtactgcagggcaatcattggtttatccatccactcattcattcaacaggcatttcctgagcaccttcatgggacaggacctgcagatttgggatatggcagcaaataagcagatgatccccaccctcggggagctcacattctagtgggaaactgtcactgagcacataaagaaaattcaagagaattgaattaagcagtcgtttactgtttactgaatatttcttgaacagaaaaaaagttgagtatcaaaaatgagtaaggcttttgtaactaaacattttattttgcatcattgaaagaaaagagctactggagttggatttagaatggtaacccatcacttagaaagtctttaatatggccaagtctcagtttcatcacctgtaaaatggagataatcgtgtaggcctgccgttagcataatctgtgcaaactgcatcatccagtgcctggcacatggtggttcagtgaatcacacattgtgttcttttattgtaattttggtttacacccaatgttggctatgggagtggaaagggaaaacagatgaatgtaatctgaaacaacccatccttatttcaacagaaagaggacttgccagacccacgctcagcagaactgtacgaattccgcttcagtgacttcccccttacagagcacggattgattaaatgtggaatacgactgttttttgaaataaatgtggtggagaaattcaaagtacctgtagaggtcagagggtatttaatttaaaatactgtgtgattctgtggctctgcttcactgatgttttctgtggttcaaaagatggactcagtttgaattttaaattattattaactttctaaatacatcagcttaacccctatctacaagaccaacacatctttttagataagattgccacagaccttctaacctttagaattctattccaaagtctgaatggtgtcatcttcttttaggttcttaccagatggatgtacactgtgaggaaagggtaccgagctgtcacttaccacaattggcggcatgggttcaacgtggggcagaccatgtttactttgctgatggtaggtacagagggctgtaaatccttgtaaacctgcagatttcccatttgagcatgatgagaaataggtatggtccatcattttagatcagtaatttaaaaattcagggcacaaacccctctccgctgcagatgagtcccagtatccttgagcaccggtgggatgatcattcagacattcacacacttaccttctcaaaggaaggttcagtcttcacccacagtactacaatactcacaacaaataaagtgaacttgctccagaaacctagtgggcctattctctattgcaggctgcacttggtatagaggtatattaattcaaataaattatagatatgcatatatatgttatttttttagacaggaagattaaagaagtactacacagatctcgaagcctttgccatgcttgctgctgctttctgccatgatattgaccacagaggcaccaataatttgtaccagatgaagtaagtgaacacatgtccaatgttgacacgtattggtggacattggaaagtacttagggtgagaaaaacgcttctccctattccttggcccagtcaatgcctctttgccatgttggaaattccagggctggattctattccctcccaagcttccgccttcacgataacgttgctctttctccctaggttcttgcgtccccctttcctttctgttttcatttccagatgtgcctctgccttcttcctataggccttcaggctttcttctctcaactttgtttaatcagagtattgaattcctatattaaagtgcatgaatctggctgggcacagtggctcgcacctgaaatcccagcactttgggagagtgaggcgggcggatcaagtgaggtcagttcaagaccaacctggccaacatggtgaaaccctgtctctactaaaagtacaaaaattagtcggatgtggcacacctgggattataggcacatgtctataggaggtagacgtgtgcctctgaggtaggagaaacacttgaacccaggaggcagaggttgtagtgagccaagattgcactactgcactccagctggagcgacaaagagagactctgtctcgaaaaaaattaaaaataaaaaacaagtacataaggtacatgaatgttaggcttacacttgtacactcctatggagcactccccagctcaggctagagaatactacccctgggctcactacccttcacctccctggtctttttgcttctgccaaactctccttcagctggtcttccatcttaacatcgatgccatctttctctcttgccccaagaaaggaagtacaataagaagggtgcaagctctgggctcaggcagatttggattcactgggtcacaaattatttaaactttctaagcctcaatttcctcatctgggaagtaagaattatagtaatggtacccagcacataaggttgttgtaaagattaaatatgatcatgcatataaagccctcaactcatggtaggatcttggcagttaataaatattaggtatgattgctgggtgcggtggctcacgcctataatcccagcactttgggaggctgaggagggcagatcacgaggtcaggagttggacaccagccttgccaacatggtgaaaccccatctttactagaaatacaaaaattagccggacattgtggcgtgcacctgcagtctcagctacttgagagggtgaggcaggataattgtttgaacccaggaggcagaggttgaagtgagctgaggtcacgccactgcactccagcctgggtgacagagcaagactcagtctcggaaaataaataaataaataaacttcaggtattattatggttactattattgttgtgatgtcattggactattcattcaccagtattgctcatggccagcccagttccttgataatgggttttaagatggtctatctgccttagccacacttcattctcatttctgacacattgaactacccctctccagaagtagtgaagtgttgtagacagactgaatgggctttggagtcttgggtttgtggggaccaactacttcttggttgggggatcttggacaagtcatttaatctatttgagattcagtttcttagccatgagatgtataaagtgttgacctctcaaagattgttgtgagaatccagtgaaattacatatgtgaaacctacttgagaaagtgcctgctaggcaggtttcacatatataatttcattgagcgaaaagcactttgtaagcagtgactcctcatcttcagcaattctacctattattaggctttgtcttgaaaagatgatctccatccagacttgaggcaagagacatcttcatctcaaaggttccagcctacactggccgctcgctcctccagaatgcaagtcccctgacagtcactgaagtcctcgtcctccttcttgatcagtagtatactagccaattcagttccagagaaacaaattgagcatctattgtgtgctagtaaggacttgatacctactgcctcatttaaccttcacagcacagtgaagggaggtgccatataggaggtactagtatcccccactttaactgatgagctcaaaagatgaagttaaaccttccctaggttataggaagtagcaggattgaagttgccatcttgcctccaggtttgcaggaaagatgcatgcagccacaccctgccctctgcattggcctggttttctttcatcattcctcctctgtaaactcaactgtatgggcatgtggtgatggaagggcttcctgactgcagactgtcagtgtgtgtgaatgtctgtgtgtgtatataaataatatatatattttttggagacagggtcttaccctgtcacccagggactgcagtggcatgatcacggctcactgcagccttgacctctggggcccaagcaatcctctcacctcagcctcccaagtagctgggactacaggtgtatgctaccatgcctggctaacttttaaattgtttttgtagagacagggcctccctatgttgcccaggctggtgttgaactcctgggctcaagcaatcctcctgcctcagcctcccaaggtgctgggattacaggcctgagctactgtatgtggccaactaattctttttttttttttcactaaatcatttgtgagtcagctgcaatactagatttcattcctaaatattgcagcatatatttattaagaattaggaggacattcacctacataaacacaatacaatgatcaccctcagtattggtacaataatattacctaatataaagtgttttttaaaaattttccaattaccacaataatgtcctttatagctattttttccttctaattcaagatctaatcaaggagcacactttgcatttagttgtcaaatatctttaatctcctttaatctggagtagttgctcaacctttttgtgtgtttcaggatgttgatgtttttgaagagtctaggccaactattttgcagaatatctttcaatttggatttaaccacttgtttcctgattaataaattcagactaaacatttttttggcaggaatactacatagatgatgctgtgtccttctcaatgcattgtgtcaagaagcccatgatatcaattttatttatgggcgatgtccagaagatctctttatgtaaaggaacattttctcctttgcaattaataagtaatacgtgaaacgttagtttgagatcagattaatatctagcttcccaataacattttttaactaatgtttttaaacctaaaggaattaaagataccactcctttctgactagaattgagctttttcatttttaaaaatatacattttaaattgctacataatagatatacatacttttggggtacatgatattttgatacattcatatgatgtgcaatagtcaaatcaggataattgagatatccatcaccttgaacatttatgatttctttatgctgggaatattcaaattattctttactagctattttgaaataacaatggattgttgtttgctatagttactctgttaatttattgaacagtaggtcttatttcttctacctacctgtatatttgtacccattaatcaacctgtcttcatccttcccacctccctacccttcctggcctctgataaccaccaaactactctctatcttcaaataaagaaaatgtggtgcgtgtatatatatatatatagtatatatatagtatgtatatagtactatatatatactatatatagtacatatatatagtgtatatatatagtacatatatagtatatttatatagtatatatagtatatatatacactatatcgatatagtatatatataatggaatattattcagccaccaaaataatgaaatcttgtcatttgcagcaatatggatggaactggagattattttgttaagtgaaataagccaggcacagagagtcaaatatcacatgttctcactcatatatggaggcttcaaaagtggatctcagaagatagaaagcagtttggtggttatagaaactgggatttactcatttttttaaaaatctctaatgccaacacagagtagttgtttaaatatgtgttaaaattatgatcgattgtaatattgatcagatatggcctaattattccccaactaaagtatttgctttccctgacctgccagtaacctggcaatgacctctcccagcctaaagttttgttctccatgaaataaataaagcttctctactaaggctaccagccatgttttttatttcttctttctttaaaattatttattctatattttcatgagagtcttcacataatctctagacctttgacatcagcctcttttaccctgaaggcattgaagaaaaacagggtacaaaagactggggcccctacttatataaagctgtgatctaattgttaataaatgggaaggaacagggagatacatttatctcactgtcttgggggaggagagaaatgttaccttatagtgcttttcatcttggttctatgcagataacctatgggcctccacatgtttgctatatgttttataagtcatagtccaccgccataagccccagggaacttaaagaatttagatacaaggagctgaactccttagtttaaacaattaaatcatttatgcattcaacaaattaaggttttttttttccaaaagagcatattctcatcttctaaatctagaaaatcttttccaatatgttatttttgaccacttcacagataattgagtgaggagggagaagagagacattaagaaaaatcctgaattgtatgaacctatgtgtaatttttaaacagctagaatcatggcatgttgttttccttctagatccacgtctccattagcaagacttcatggttcttctattttggagaggcaccacctggagtacagtaagactctgttgcaggatgaggtacgtaaacctctctttaggacagctaaacacaaattctggatcaaagcactaacccacagaaaatgcttggaaaaagggtggccttgagttacagcagttgatagtgtatacccttgttgaagtcaattgatagaaattgctatattgaactagtttttgaacagccaagttggaagtagctgagacaggtgaagagagccatggaaagtcacagaatctctgtgggtctgtagggaaagaagaaaaagcttatggtggatgcaaaagggctccgtgcaccccaagcatatgtaaatgtaaagaggaaaggaggctacatggtcactgatttgcttattcattcatggggcatatgctttagagcatggtctatgcctttaagaaagtcaagctttcatagtggagtgtattcacacattcttgcattgctataaagaaatacctgagactgggtaattataaagaaaagaggtttaattcactcccggttctgcaggctgtacaggaagcacggcagcatcaacctctgggcaggcctcaaggagcctacaatcatggtggaagctgaagggggagcgagcacttcatatggccagagcagaaggaagagagatgcgggggaggtaccacacacttttaaataaccagatctcatgagaattcactcagtatcatgaccaaggaggatggggctaaaccattcataagaaacactgctcgcaaaatccaatcacctcccaccaggacccacttccaacattggggattacaactgaacatggggtttgggtggagacacagatccaaactatatcatggaggtaggcatgacgtagccaccatcagagaggcactgagccatgctctgagagttccaaagggagaaaccacatttgtgtgaagacagtggcagcggaaaggggcaaagagggtgggatcagagatggctttctgcaggagcggctcagccccttgaattcattgtgaattgcacatattacgtactactaatcttccagagagggtagtcattcttcttcccttgatcaattttattgaagggatatatgggcctgtggaaagttgtggatgttgtctaattatactttcttaagaacgttccaaaccaaaaatgattaaggtgagtcattagattgaggggagcactgttttgtcgcaggcagtgaacttgttcagaatcacatgcttcattaggatacatgagccctctggagagtgggcttttctcactttcaataataatcttttattaaaagctcagggagaatatacagaaagatatccaagtttagagagaatactaaattcttctaggtaatgaaaatccaagatggtcctcataagccaagcaggaaaatctcataaggcagagcaactgggcagaaaaatggaaaaagaagaaaactgcttgcgttgttttaacagtctgtgattgacacagcacccaacaccattgccatcccagacctgctgtggcatttctaattccgctatgctcttggcaaagcactaacctcatataagtccagatggtggttctcagacatgggtacctggaccaactctttcagactcattaatttaacagggcgggggcagacaggctgttaaggcacagatcctgggccccattctccacttactgaccagactctctggagtttgggcctgggaatctgtattttgaaccagaacccttttaattctgatatgcagacagaatctctccctgcagcagaattcacagcataggtaacacctgttctatgagaattaaaagaaggagcggaactgaaaataactcaggaatgtaagagtaaattgttattacctaatttgttataagtctttattttgctggttgagacaatctttggtttctgagtaagaattttctgtaaatcccactgtttatatgataccacagtgaggtagcatcaaatgtcatgtatcgcataatcatacagtcacctactaaaacaaaatactgttttaaaacagctgccaaatatctacatgcttaacactggaaggctcctagtttcttaaatgtttttccttctgggatttggcagtttagagttacagttttccatctgaattttttttaatgttatttactttgcagtctgaactggctttgatggctatataaagacttattattctttctaaaaaggaatattgcatctcagtaatctataccatcttttcaaggacctctctgtaataccattcaacctgctaattgcagacttttaaagccttgtcaatagagtcgctaggcaatgcagtcacacagagcctgtttatgagcagtcaaattggacacacacacaaaaagattgttacctatcagatattctttttacattttggggagacaatgtagttcttgtatttttttcattctctaaagaaaatacacacattaaaaattttaatttttttaaataagggaaatccttgggatttatccagtaatttcagcatctgtgggcattactcagacattttgttttgcatattataaggctttgaacggcaatgtccttctatcctagcagagatggattcactgctttgaggaatagaactgcctgtactctaaaccagacagaaatcaatgctttaacccaaatgaatgagtggaaaccttgttagccaaatttgcacaagtataaattttaatactagaatatactgtagaaatgacaaaacatattgctcagcataaataacaaaatcttgttattattcagaacatctctttccaaagcgtatgataattttatttatgctttttcatatcaaccgcatcagcctgccccattttacacatagaaatgtgaaggagaaatcaaataccttgtgtactggcactagcaaggcaagaacatgttggcaatattctcttgcgggcgtcataggcaccatgctgaagactagaacggcctgtactttccctggcctcagctagctcgagagccacgatctgaatgaattaaagccatttctacctgtttggggtgtgctatgcagaattcatagttctatcgccattttaatagtcagggaaaataaaaaagattctttccgtgagcaaatgaaagcagctgagcaagtcagggcccgtggccagaggctgggaagtaggtctcctttcttgtctagtgcacctgtctccacaaaatgtcttcaacacaatgctcgaaaacaaatggaatattacatatttatacatgtattcaatgttcattaatagttgcaaaagttacataagcccactataaaaattcaaacgataggaaaacatcaaagacaaatatttcttaaattgcttcaaatcctaccatccagaaaccgatatttcattaacgtctaatgaacctcattgcagtcaccctgtggatatacacaggaagcatggagagaaaggactccatgtgttcccactacccaagctatttttttaagccagagttggtttttaatcaacttcattgaagtatatgtacaataaactgcatctcttattttattttatttttgagacggagtctcatcctgttgcccaggctggagtacagtggcgtgatctcaactcactgcaacctccgcctcctgggttcaagagattctcacacctcagcctcccaagtagctaggattataggcatgcaccaccactcccggttaatttttgtatttttagtagaggcagggtttcaccatgttggccaggctggtctcgaacccccaacctcaggtgatccacccaccttggcctcccaaagtgctgggattacaggtgtgagccaccatgcctagcctaaactgcatctctagagtgcccaattccatgagttttgactattttatatacctgggaaaccagcaccacaatcaagatgcagaacacttctatcatccaagtaattgctcatatcatgacccttcacagcacatcccactgtccactcccagccctaggcggcaacctttgaaatgttttcagttgctatggattagtttacattttctagattttatataagtgcaatcacacaattagcacaataatagaataatcatgcaatcaatcacactcttttgcattggtttctttcacgcaaaataataatttttagattactcatgttgtgtatgtccatgattcattcctttttttagagatggggtcttgctctgttgccaagactggagtgctgtggcactgttatagctgtctgcagcctcaacctcctgggctcaagcaaacctcctacctctgcctcccaagtagctgggactacaggcatgagtctctatacctggctaatgttttgtattttttgtagaaatgcattcttgctgtgttgcttaggctggtcttgaactcctgagctgaagcaatcctctctccttggccttccaaagcactgggattacaggtgtgagtcactgtgcccagtcaattcattttttttcattgctaagtagaatccctttatcttaaataaaaggtattgcatttgactttatttgaatttaacagaagaaatgtttttgaaatggaaagaattgcagaacttcacatgatagtgtccttatcacaagaaatgttagctcttaaagagccctctaaaatgaataacaaatgactatgaaaaattatgaaaagttgtagctgagcatttagatgtttgacatttttaagctatatgtgttaactttacagtatctactaactcccttctatgaaatatgaaggaattggtatactttttcccacatgtctgttttatatgatatatttttttaccattatcaatatttataaaattacattttgctctgtaatttccactattgtttattttaattcaacttttaattgagtccagtacttattgactctacattttcatataaattttataattgatttgtcaatttacaaacacacatacacaaacttgttggtattttggttggaattctactcgctctatggattattttatgttcttgtggtcattatatgcataggttttgcacttgttcccctctgaaaattactcatccctgagtggagccaactatctgcctagtaccgtggaagaagggcaggaatgagctggggaaatcctcagcttccaatttgttgactcaaacattctctcaccaattctaaggagcacacctgtattagtctgttttcacactgctgtaaagctactacctgagactgggtaattataaagaaaagaggtttaattgactcacagttctgcactgctggggaggcctcaggaaacttacaatcatggctgaaggagaaggggaagcaaggcatgtcttacatggtggcaggcaagagtgtgtgagaaagagtgaggaagtggcacacttaaaaccatcaactcttgtgagaactccctcactatcatgagaacagcgtgggagaactgcccccatgattgaatcacctccttccaggttcctccctcaacacctggggattacaattcgagatgagatttgggtggggacacagagccatatcaacacctctttgattttgttttccggaagttggtaaagctcacactgagcaaagcccatgaagctccaggccttctatttgggatctggccattgctgtctgccttccctccttcacttcttgttacctatgacaatgtctttggtctaggagattgaatatcagaagtcaatacaaatgtacatcagcataacttctccatcaactcctcttttgctgttgttttgtgttgtcaaagtaggtcttgaaaggaattccttgcttctcctgtgcgctgggcacatcttgagacctcttgctctaattaaagaatcactgagtctgtgtttacttactaaacaaacaaaaaacccaacttgtgtgcaagtgtgtgtgtgcatgtgtgtgtgtgtgtgtctgtgtgtgtgtatgtcccactttgttccaaagaggatttgatggagcttcgaagaatacatacaacactaaagaaaaagaaaatgaggactaatggaaaaataagaaaaacgaggtgagcatagtaaaggccatacatacccaaaatgtatatcagagatgggccacaaatttggccaaaacgtttatcagacacaggccacaaatttggccaagtgctttctagcaactaatacaaaaactggaatgggatcttttatatgaatctatatccacaacttaataagtcaattagaagctcttctttcaagaacctcaggtgtgaaagggagaacagagaaaatctaaaagaatgtagaattaagaaagagtttttcaattaggaggcttgtacatgtttttagataaaaatgaaaatgagtgagaagaaaaaggtatgaatgaaatgcagatatgtagtgctatatgcaaaagaagcagtactgaaatggtgactataaaccctttttcttcattatatcaatttttaaaaatccagtattgactcattttgaaaagtaagatagtttttgataatctatcaactttaatacagttgttttattattttggattggaaaaaggtataagagtaaacagtatttgtcacatatgtttctatatatttctttatatatagcgttttctttcacgtctattaaatagcaacaagtgtccaggtttacattaagcaatatgcactaaaacaattggtgcataataaatttgatgtatttgatttgttgtagattatatactctgcacaatctgacacttggtagagacgaggaagtctctgtcccaaggaattatttctctgaattcagcagtctgatttgcttctttaaatgacttaatgtgctataaatattaacttgtctaaaagtttaaggcattttcacacattcctcccctccccctgctttttttcctagtatagcaatcaaggttggcttcaaatattattaatttgccaagtatgtatctgagtcacataataaacatcactttgggaacatagcaatgttcatcagtgaacaaataaaggcagtgattccctgatgtcagtatgccactggatcaccccaagtccaaaaggaaggccaccattgttccaaaatcaggggcaggttaagtgggatcaaaatgactccacttacttttcccctccctggtaatccagaccaggttgaaaataacctgtatccagatttgattcagagattctggactgatatgtacaatagacttctgtgaaatgtcccaagtaagaaattgattcggggtccaggcacggtggctcatgcctgtaatcccagcactttgggaggccgagatgggcggatcccttgaggtcaggagtttgagactagcctggctaacatggtgaaaacccatctctactaaaaaatacaaaaattagctgggcatggtggtgggtgcctgtaatcccagctatttgggaggctgaggcaggagaatcgcttgaacccaggaggcagaggctgaagtgagctgagattgtgccactgcactccagcctgggcaacagagtgagactccatctcaaaaaaaaacaaaaacaaaaacaaaaacaaaaacaaaaaaaaacattgattttgatccagataatctctcttttgtttttgtaatttagactggtcaacacccattgcttcattctagctattttaaaagtttaactatagttgctatgatgaactcattatgttgacaaaacaaatcacaattttcccttctattacttatatatgctttgtaaaacaccacttttcttgtcctagaaaatgttataaaaagatgacttaagggaagatttatataaggcatagtgtagtgtctaaaacttgagttcttgtccaattattgctttctaatatttcaatcttctgaaatgactgagccatatttggtcttaggtttgcaattctatttctaccaggagctagcctcataactttacgtaataataataatgatacaacaataaattttaacagcgatttacagttttaaaatgcattcacagttgtcatttcatttgattcagcattccacagatattaattgagcatagactaagtgctaggcagttaggcagggcagctgttattatgcccatatgagaaaacaaatacagatgttaagtgaagtctctaggattataccactgccaaagtggggaagccaggaaatgaacctgggttccctcttgagaggtaatgtagtgtggtgcagagattaggagcacagactctggaaccatgctgcactggcttagacaccagttctgccacattctagctgtttaacctcgggcaagttacttcacctctctgtgctggggtctgttgtgaagagattaagaatattcacaaagcacttagagcctggtaggtagtaagaactaagtaagtgtttactgttattatttggtgttcaggacagtattgtttttggcattatgctacttctctctttatatagtttgatagactatctcctctttctttccagtggagtttttctgtattttgtaactgtcaaattcatttggcaaaatcactatctatctgtcatttggcctgtatgactaaaatggtctatttggaataactgggctttaagaaaccacccccagcttatatactcattttctttctttctttctttctttctttctttctttctttctttctttctttctttctttctttcttttttttttttttgaaacagggtctctctctgtcacccaagctggagtgcaatggcacagtctcagttcactgcaacctccagtccccagcgttaagcaatcctaccaccttggcctcctgagtaggtgggaccccaggcacataccaccacacccagctatttttgtatttccatatttttagtagagacaggagtctcaccatgttgcccaggctggtcttgaactcctgagctcaagccatctacccacctccgcctcccaaagtgctacaagcatgagccaccatgctcggcctatattctcattttctagaatgctaagaaatgaagctgatccttatgtgaagagatgtagtgagaaactctttgaagaaaggtctagttaagtcttggtaaaatagaattgcatgaaaacattttcaggataatgtggaaggatttcattattttttcctacatatacacgaatatgagtgtaatttgcaatttctgaaagaccagtggtttctatgatcactctaaaattacctggtagataaagtaacatgtctgacagttggacttctcccagaaattctttattaaagcttctcaattaatacaagcacatttttaatctattgttatttattttaatggtcctagaagaaaacatttatttactccaaaaagttaaacactgattacatgaatattggctaacagtatctatttttatagtttaaattaaattatcttacttaaagtatagtagaggggtttgcttagtccatgagataaaaactaaaagcaagccaaaaaaaaaaaaaaaaaaggaaggaaaacaaaaaaaaaacaaacaaaaaagtgttgaaagacttttagattttcttcttgttaagcatagtttcatttgttcagaggcaaattattgatagcattttattgtgaattttcatcttacagagtttaaacatcttccagaacctaaataagcggcagtttgaaacagttattcatttgttcgaggtcgcaataatagcaactgacctggctttatatttcaagtaagtacataactctgcacagtggaatgccctatactctgtgtggttttaccttccataaattatctgttgcattaatgttaaaaggcatttattcacacacatacacacacacagacacacacacacacatacacacaaaatttgctctccttttggattaccaagtagagtatcttcaagacagatgcctgccagtaaatttactagacctctgggaacatattttaaaaacataagctcctaatattaagtaggttgctctccgaacaggtttgaattgcagaatgtgcagccaagtttgtgccttgtcaaaagagtgaagccaagagacctctcaaggtggctttttgtccaggtgaattctctatggtccagaatctggcattttaatgtttcagcctcagaaatttaattctgtcaaagtctgggagctgaacaattttgatggcattgacacacattaaccaaacttacaaaactgagtcatacgtaacagagagccagcctatttacaacagtaatattgccaaggagaccagatactcccagtatctccacattttctcataagtgaactataaagttgcttgatgaaaatgggttagaacaagatgaactagttataggatggaaatattcagtggcttgggcattgtcaaattatgcctttctgatccttcactaaatatttatttattatttattattattattatatgtattattatacaggtctcactctgtcacctgggctggagtgcagtggcacaacctcgggtcactgcaatctcggcctccaaggttcaagcgattctcctgcctcagcctcctgagtagctgggacttcagtctcccaccaccacatctggctaatttttatatttttagtagagatgggtttcaccatgttggccaggctggtcttgaactcccgacctcaactgatctgcccacctggccctcccaaagtgctgggattacaggtgtgagccgttgcactgggcctgaatatttaattattaaatagttcaatgtgaagacaaatactaagaataataaaatggatatccaaatatctatagcctaaatttaacaaatgcgaaattttgccatatttgcctcagattttgctttataaggagaaaaaaactagtgatgcaattgaggtattccacccctactccactatgaaaaatcccttcccttcttccacaaagatatcaccgtctgacgttgatgtgtattcataatttccatccatgtttttatatggtattgttgtgtgttgttttttttgtttggtttcttggtttttttgcgacggagtctcactctgtcaccaggctggagtgcagtggcgcaatctcggctcactgtaatctctgcctcctgggttcaagtgattcttctgcctcagcctccagagtagctaggactacaggcacacgtcaccacgcctggctaatttttttttttttttttttttttttgtattttagtagagatggggtttcaccatgttggccaggatggtctctctatctcctgacctcgtgatccacccaccttggcctcccaaaatgctgggattagaggcgtgagccacctcgcccaacctgttgtgtgttttcaaattgtccataggtggtatcatactgtctgtacatacctttctgcaacttgctttattcatgcaacattgtgtttcaaagatttatcattgataataaatggagctccaatgcatccattttaactgaatagagtattcaactgttgaatattcataattaatttacccagtcttctattcatagacatttcaattgtttctaatttttcatcattgcctacaatgctaccttgtatgtccctgtatatatatgagagtttctctaagaaatgtaaaagtgacaatgctgtaggatttgcatgtcttcaatttcatgctacattacaaaactgcactcctgagaagttgtgccagttagcactcccacacacagtgtgcaagagttccagctgagtgaggtggctcatgcctgtaatctcagcactttgggaggccaaggcaggaggatcacttgaggccaggaatttgagaccagcctgggcaacatagcaagactgtctctacaaaaaaattaaaaaattagccaggcatgctggagcatgcctgtagtcccacctactcggtaggctgaagtgggaggatcccttaagcctaggagttcaaggttccagtgagctaggatcaagctatttcactccagcctgagtggtagagcaagattctgtctcaaaaaaaaaaaaaaaaaaaaaaaagaaaaagaaaaagaaaagaaagaaagaaagaaagaaaaagaaaaataccacatctgaagtactcttgaactcagcaaattgaaattttattttgctaatataatgagtgtgagataatatcttattgttcaaatttgtagtttcttgattagcagtgagaccagctggacatccgtgtgttttgggttccaactttttgttggctatatgtgttgtgatatcttatcatagtttggggcctttatttttaggttatggtctcttttctcatatgtaattttgtatttactttcatttttaaagagacagggtcttgctttgttgcccaggctggtttaaaactcccggcttcaagcaatcctcccaccttagtctcccaaagtgctgggattatagatgtgagccactgcacccggccttatatgtaactttttcgttgtaatgtattccaagttacctgttttgttttgtttttccctctctctctctctctctctgtatggtttgtgctttttctgccttaaaccctttctgagccaaagttataccaccattctctgctctcgtattttctggccctgtagactttgctatgtggacatcacaatgcaaagtgggaacgtgaaatctgaaaagcatgtatttaagatattttttctctcttttcataagctaaaattgttgctcacagctgtatcttttctaggaagaggaccatgtttcaaaaaattgttgatgcctgtgaacaaatgcaaacggaagaagaagccatcaaatatgtaactgttgatccaaccaagaaagagattatcatgtaggtagttgaaattgtatttctctcttgttttttgtaaaaataacttattttgtacttatttctattttaaaattttttgttttcttcctaagggcaatgatgatgacggcatgtgacttgtctgctattaccaagccctgggaggtgcaaagtcaggtgagtccagttaagttttcttttctgtcacactgtcaggtactgcctaggtcccatgtaaatgtccacctaaagatctcaggcaacctcagaattctgaaaaattacaaatattagtgagacagtaggcaatttgattaggccctagaataaagcaaatagaaggaactttggaaggagaattctttcttgaaagaattctttaacattgaaacactgtaaataatttatataaaattatccaagaaatgtctgagtttttaaatagaggagtgtattagcctgttctcatgctgctgctaataaagacatacccgagactgggtaatttataaaggaaagaggtttaatgaactcacagttccacatggctggggaggcctcgcaatcatggtggaagatgaaggaagagcaaagggatgtcttatgtggtggcaggcaagagagagcgtgtgcaggggaactcccctttataaaaccatcagatcttgtgagacttacttaatatcactagaacagcacgggaaagatttgtccccatgatccaattacctcccactgggtcactcccatgaattgggaattatgggaactacaattcaagatgagatttgtgtggggacatagccaaactatatcaatgaggtaagtcagaacaagatcaggatgcatcgttagtgttttcctctatcaagggtgtttttgctcctatagtctcttcttcaatgtgctgtgaattataagaaggcactgactgtgagatgatgtctaaggttgccttccactgaagttcttcccccaccttggggaggcactagtctaccacttgctttcttactaattggatgaaaaaaccttcctttttcctccagtaatttctagggaaacccctaagcagaagagagcccagaattaaatgggtttaactataaaagtgggttgtatctttttaaaaagatagaataattagaactcagtgtaggggagaaaaaatatctatttctcacccatcctagcttcatgactgaggcccctataacaaaagacagattaacaagagaaaagcgtacacgtttatttgttttacatgtaatacaggagccttcgtgaggaaacaaagaccctaagaaacagttaaacttgtatgttttatgctaggttggatgaattagatagtcatggagaaatagaattcaacaaagagggtatgatctaatcgtgaggcagcttagcaaggccgatttgttcagattcttcttggcatctttgtgtctctggctcctttcctccaggaatagggagggcacctcttgaatgaaggtcttatgatctgcttcaggggaaggtcagaaaatccttacctggttttatgacctacttcaggggagaaggtcgggggaaggtgagactgatcttcctgctgctttagtttcctcaaattccgtcaccttaaaatatttgggggcagggtgtcctgaactccgtcaccatcaagtccaaaaccaaatgcttcctctccttccacctcgacatgcctgctcttcttcctctgttctttatcgatgaggtcacccaagctagaaacctggggtcctgcttgagcttatctccctcatttcaaaatcatttatatcagcctcgctagtacctcagttctgacttttatcagaactatggtagcagcctcctaatagatgctcacatcaactccacaagtcatcctctgacttgctgccaggatgtctctacacagagctcaactcagccattctactccttaaaaggctcatactccccattgccagaggtttccaacttctttcccaaagaagtaaagtctattttctcccaacaaaacttgcccaaagatcactttataaaagagaaaaaagcaaagctactttagctttcatctctcttggtctccaccttcttgggccctagagcacttcaggggaaccctagactccaagagtaaacagcactggcctagagaatcaaattcaagcttcctggcaaaatttacatggcctgtcactgcctgtcctcaactcacactcccagcatcaattcccatcaccttctcccatgtcattgcttcacactctaagcctgcactcacagaagctttgtacgttccattttatctcggcaaatattcttcccctcctcttttcctggaaaattactcttgttcttcacaatacaacataaatgccacctccttccttcatgaaacttatctttactcccttctccctgacccatagcacttacactattattgttacagcacttaccacactgtatacatgactgtcttcgctagactctgaacattttaaagaaaaagatcaccccttattcctcttggcaagcctggctcatgccaatgtaaaggcagctagcaggtgttcaatgaacttgataaatgtttttttttagtgatataaattaatgctggaatatcctcacactgtaattaggtaaagctacatactaatgggtgtatgtcacatgtgcattcacagacatatgctagatgctaacagatagacaggacaaagaacaaccggcgaagtgttagaacttgaagcataatatttaatcctcctatttctccttttcgttggtgagaagtggtggcaatcgtaaatgggagatagatactcctagaataagcctagaacactgaagtaggaagaaaaagctcccctttcgcatttcaatataatctgtaaatgacctctttttaaaagttaagagcatacggtttgatagcacctcaaacattgactgtaaactcgatccttaaatgtcacttgtactaataaaatgcaagttctctattcataagtggatttagtgaaccaagcctttctcatttgcaggtagcacttatggttgcaaatgaattttgggaacaaggagatctggagagaacagtgttgcagcaacaacccattgtaagaccttgacataaaaatgtattacttattaaaagttatcaggacaggccgggcgcggtggctcacacctgtaatcccagcactttgggaggctgaggtgggcagatcacgaggtcaaaagatcgagaccatcctgaccaacatggtgtaaccccgtttctactaaaaatacaaaaattagctggtcatggtggtgcatgcctgtagtcccagccactcgggaggctgagacaggagaatcacttaaactcagaaggcgaaggctgcagtgagccgagatcgtggcactgcacccagactggagacagagtgagactctgcctcaaaaaaaaaaaaaaaaaaaaaaaagttgtcaggacaaatcagtctgttttgttcatacatcttagaaacctgtcttaaaggatttatttctctttctagcctatgatggacagaaacaaaagagatgaattacctaaacttcaagttggatttattgattttgtttgtacttttgtatataaggtaagtaagcaaattatttgaattaaatacataaacatttggatgagaaattttctttcaaactgtcaccaaaatttagaagtcacccatacggaaagccattggggtatcactgtttctccaaagcagtttgaggttttaccctaatctcattcagggctggaataaaaggagggaactcagatgtgagcgaactgaacacttccttaggcaggcagtaaagacagcacgtgtctctttcccaaacttcataggcccgtggttaaacttatcctagcagctctgagtgctgtaacaattccttacagctcactctctgcatatgaaagatcctgaaaattaactgtatgatttatgtagtttctgacctaaaattccttttaggagttctcacggtttcacaaagaaatcacacctatgctgagtggtcttcagaataacagagtagaatggaaatcactagctgatgagtatgatgcaaagatgaaggtcattgaagaggaggcaaaaaagcaagaaggaggagccgaaaaaggttagatgggctctgtttttgctccctgtaatgtagccagaagctaggctgagcttaatggcatgtgacaaagccataaagagtcaccacaaacagaaaacctgctttactggtgcagactgatcattttaacaggccgattagtggttttcaggtccccctggccctgccacagacaacatcttatgtataactccagatcgaattgaccggtccagttgaagtagaggttggagctaggcttcttcatcttgctagaaggtggctcctctgcagaacactgggtgcttagggataatatgtaaactacagaatctgggggattagagttaggtgagaaaaaagtttttgtcccaacattatgcattagctgtgagaccttgggcagcttgcttaacctcgctgagtttaatattcttctccatgtaatgaggtggttttacagatcttcagcttaaggaagccctacatgtagagtaaggctgaaattgccggtctcccaaatgtctcattgggagatgtttttctggcatgagattcctgtgccattttttttctggcatgaaatttctattcctaaagtcactttgtcaagtttaatgttgtttttggattcttaaaatgcttaggattaactattagttcatcagatggcccaaacatcattttgaaagtggaatgctaatttctgtcttgaaagtttatcactctgaaggttttgtaagcaattgttattgcttaacaaagaaatcatctctatgtggaaaggccctgacatgttccttttaggtggctctattgcatttagtgaaattttaaataattcataggagaaaatatttttcttaacaaagttaaggatgtccttcagaataaaagcaggagtttttgactccttgatatccattcacttatgtatttatcagatgtcttctctgtataaagcccggtgttaggcaggccctggggaaagatgggatcctttatcttgaacaatttaccatttggtgggggaactaaacattgtgaaccaatgcacaattaacgatctcgaagaaggcactagtgtgcacatgggccatggagaaggctttcctgaagaatgcttacgctaaccacagaaagcaggcattggggaggaagagtaagaaaatatgtacaaaggcttggagtaggaataagcttggtgcaattgaaaaatttttaagctgatatagctggagtctagagagtaaagagtgcgaagtacatatgaagctggtagtgcaggtagctgccagatactgtattgccttgaaggtgggctaaaaatgttcatgggtcatttgagagatttaaggtaagatatgatttgcatttcaaaacaataagtgatttttaccaagcaagtgaaaagtgagggtatttcttagtactattagatttaacctttatctcaactttattatgaagagatgatcaggtcctttaagtgacattggatatggatctgtattttatttgcacaaaaatttacttctgagtttttttgctactacatagagaattctttgtggactaagatcattattttctatcaccaggcatggagctttgtgcatcaagctcagatttccagactgcattgtctcagtgagaaactaagatgttaactggccaaccattgatcagattctgttttttatttatttaatttatttttttgagacggagtctcactcactctgtcgcccaggctggagtgcaatggcatgatctcagttcattgcaacctgtgcctcccagattcaagcgattctcccacctcagcctcctgagtagctgggattacaggcacatgccaccacactcagctaatttttatatttttagtagagacagggtttcaccatattgaccaggctggtcttgcactcctaatctcaagggatccacccgcctcagcctcccaaagtgctgggattacaggcaggagccactgcacctaacccagattttatt

SEQ ID NO: 16412 - DNA, 95890 bp, Human
acattgcctgccccataaccattgcttaagaaataatgagtttaatgaaacgatgcatattactctatccctgacagagagtgatgttttacctataatctaaaatatagttgtctactgtttaaaaatcaaagtttatccttgagaatttagcatcctaaccatgcatccctctcccacccgacccctgccctcagccccggatcccttttaacttaaataagaagctgttttattctggcagtttttgccagaagaaaagtgagtctaacagaagtcaatctaacagaaatgcattaatgcaggctggatttgcctagacatcaataaactcgaaaggctccctgtgggccacttgtagtgtcaataaacgttcgtaattacttgctccttggagcatttttatacccgaccccgttcgctgtgctgcaaagaggaaattcaagatctcggaagttcttaacttcttaaactctagaggaagtatggtaaacactggcgggaaccttgggtttttaagcaaagatgctggctgttttcgttgctattttaagctgtcaggcgacaagcaactcagaattccccttcttacttccggcgggagggaagattggaattgggcctcatcatttctgagcgtgaaaaaccgctgaagctactgttcaacctgaaggaacacggaattcaactggagagaaaccctggcgaccagggagctggggaccggcgcatatagatgagggaaatcctggcttccagacactgtctcatgctagaggtgcctcccgacctaccagccaacagtaaagaccggaaccaaggcgtggtactagcagagtagcaagcatctctcccaatgagggcaacgactggaggatggtggagaggtactcagagtgaacaatcgaacacagaactcttgaaaagtgtccctgccacccaatacaagtacgaaaaatggtgggacggaggagaggtgacaatcagaggctatatatataattgagacttttagagaggactttgctcttccttcctcccctcccttttctttcctttctttctttccttccttccttggtatccgaatgtgtgtgggtgtacttgcgtttaaaagagaggtccatggtagctgcttttttttcagaactctgtttctccgcaatgaagtttaagtgggattggagtttccttgacttctgcgtgaggagtttccaaatggcaatgaaagggaggcgcataaatatccataaagttcctaatgacacctctatcatcacttgtttcctgcagaatcctgagccagggtcgtcgtccaccacccatgcagagtgggcccatcggctaacaggttcatgtgtgtatttgcactttccagattgagtaataaaagtcttcttccttccaccgccgtccccacccccgcaccccgtttcactccaccttggagggcgtgtttttgcgtgtgagggtgtgtgtttagcaaaagcgattgaaagaaggtactcttcttgcaatccacccctagctctacctgaagcattcctctggcgggacgcttttgtaatctgtccccaggcgaggtgccctctcacctagatgcggatagactatcttggagctcccaggtccagagagctgatgctttgatgtcccaggagagtgtgtgtgattctgcgtgtacgtgtgtgtgcatatgtatgtatgtgtgtatgtatgtatatgtgtatgtgcgcgagctcgcaggcgcgtagcactgtgagcttcctctcccggcacagagcaggcagagccggggacgttactctccaagcagcctccgccccctcagcctggtgattggctttgcgcagcgtttatctcctagcaagagggaagggccagtgacgcccccgaacccagctgcagaagctgccgccacctccaatgcacaaggtgtctcatctgaaaagaaacctgagccccagggaggcggcgcggagcgaccctggcagagctggcgcaaacagggcgagaggtcgctgggcagcgttcgaggaccagagggagctcggccacagaagaccccagtgatctgatcccgggatcccggctccaagctctcctcgcattttacagatttcacccccgcgactatctccccaaaacggagcctttatatcaagagaaggtgcgggagctggggcaaccaggactttctcgggcacccaagatgcgctccattaggaagaggtggacgatctgcacaataagtctgctcctgatcttttataagacaaaagaaatagcaagaactgaggagcaccaggagacgcaactcatcgggtaaatgcaaagcttcatttcaggatatgacaaaaagtcaagccataaatgaaatgtgaatatagagggtagagtgatggttaggatagcatgtgtgtttgtttgagcttgcgcgtggttagtgtcatgaattaaataacaaaggctgttgttgagatgtgcgtgcttctctaagctgttcccagtatgagttcaacttgctctgtgtggttgtggtgacagttgtgttggccctgggtgctctctcgccaaaggagaagtcactgcagaagtgtcaacaaagaacgtgtgtccttgtccttttaatctgtgggcagaactcaagagaaatgtctttattcaccaaacggttgcctgttttcaatgtcctatcacctaaggagatactggagatagatggtttctcgaagggctgaagttaaagcttagaaagcaggaaataggtatactctgtttctctactttttttttttctatttgacgttggatagattaatgtgttataatttgaattagaaactccagtaccactaaggatacttccttatttgttcttctacggctaaaacgcatgggcgtcatggttacagttttagaaagaaactgggtactgtagcttcacacagactatatttctgctattttttttagtttgtctagatgagttcagactctcccccgccccactaagttctctaaatatcacacttccttccacccgctggcctctgtgtctttgaagtttacccaggaggtggtgcaactttgtgttgctgacatagcttggaaggctttttctgaggatgtgaacctgattgtcaactctattcaaagtcctgtttcggaaatcctccctgttccggtttggaggcgtcctctatcagaaactacacaccagcagagatgcctgcccagtttatatttttctctgacattgattaaaacaaagaaaacagcccttgcgtgtgtgtgtatgtgtgtgtgagagagagagagatgggactgctaacacacacacatgctcttaaacttcctgcactccatttcttaatattcctgctccctaggtaataagcatttatttaagcgagcaagatgcaggttgatccttacagaaggacttgctattctgtagaaaaccaggaaaacagtagcacagtcaaagcggactggaagagaatgaaaaagctagcaaggaatgggctggaatggtcgtcatgcatcaacgaatctatacatggtctattctgagggggtaaaaaagaccggtatgaggtcgtttacacaagactgggtggcttgaaaatccaatctagctcagttgttagaaaagcaggactttgggcaggggcgtgggcatcccttgcagacctgtgcttgccaggcagacaaaggggtctttagaaaggtgatgaatgggcgcatggggctccgatgagaggcagaggctagagcttgagggtcgaggctctttgttccctcccgggccgtgggctaggaggataagcctgatcccagacaaagcggccaaggctcactaggactccgagggttcgggcccttggctgggaccctggagagcaggagtgggcggagcgagtgagaagagggtcgccagatactgccgaggtgtccatctccgagcctccctaaaccgtggccaggaaaaggagcgcacctcgagtccctgcggggaagcggagccgggacactccgcattgcacgggtgtcatttctcctgtggccctttcctggacgttgccggctggtgggcgcagccctaggcgttaaggaagaggaggcgggcactggcgcggcggttgagctagtcgggctgggcttttgcccgcatccttttcaagctgaagcagtttcctcccagcttgactgagaaggcgttggggcaggcgcttgagtaaaccaaacaggaagagaggcgcgcaccggggttatcccctgctgccagagcgccggcggcgagggggaaagaatgagtgagaagatagggggaaacctttattgcaggactcaggctcttttggtccctcccctccttccacccccaccccacccccaccccccacccaaagtcactttcaaagctcagtcggcaactggctcctccttcttaatcaaaacccgcaattacagtggggcaaggcagagggctggccgcgaacgtcgcgcttacacccgtgccctgtagcgtcctgactgccttggtctcctgagagaccaagactgtgcaaggagttggagctgccaggaacaatgcgagggcagctaggctccctgagcactttcctttttctccaggatgaaaggttcgtggaaaagcttgtgacccgagctcattatttcgtttcaactcccaaacagcgcttctggtggaggagttgactcataaaaccatcaaatcatctcattgactgtctttctacccaagccacgtggagaggccagttttgagttttgagtaaactggaatggaggttcggctccagatcccggtccagtattcaagtgaggtaaccaaggcagtctctggcctttggggggcactgcgagccttgtggcttggcagcagtttcaaagaagggccttccatagtccttgaatcttgcatcactaccccagattcatatttagcttttctgctaccaattttgcaatacaaggcagttcctttatcccttcgacccttcccccccgcaaatgggggtcccatctatagttactcttacagtatgccacaatactgagcagtcataccacgcagatggaaaaatagaaaaccagcacaaccttctcaccaaccatccacattctcatatctccaaaggaatacctgcgacatgtttttttaaatacataaggaattgttccagcataggtcaagtaatgattattgaacatctaaaattcatatttccttccataaaagcctattagttaataaagtttaagttgaagagcagtgaaggcattaagtggtgtgttcttgactaactttactttcttagtagacctcacagttggcttatgacttaattagctctttgtgcacttttgggtataactggaaatgtgttaatgtaaggctcccacaagtaaaatatgtaagcatcctcatttaatgagataatatatttgaaagtgtaacataaactttaatgtcatataaatatttgttttgttagtccttaaatcttgctacacactatttttctggttgactacaaatgagactaacttacttttcttattatccaaagatctctcttataatttgactatgtactttaggttgtattactaaataatcaacaatattagttctaaaacctatgataaaattgaaagtggaaataaatatttttacttagagtattaccattgacagcaaagttagtcccagtttgttctaggatgaaacacaacctcgtgagtgcagaaatctagaatttgcactttacttcacatttcacatttcacaattctactaaaactcataaattaaggtagaaactatcatctttatttttagttgtttgacacttaggtaatgaaaatacaaaatggcctgctgtgtgtattcaggcttagtttcatgcaagttctttatttaaatttttatattaaagaggaagtttaacctagttaaaagggaacaaatacattcaaaagccaagtcatgaagagtttcagtagggtggaatacggggcttttgagacctaataccatgaagtgaaattaatcatatgtcttacgtactgcaaaactaatgaagtaaattgtggtgaagcctggaaatatttgtagacactaggttacctaaaaaatgattaattcctgccactggtatcacatagatgaccatcttagtgaatttttctttgatccaaataagcagggatcctttgtattatattgatttatgtggagtgatttcgttgatgtgtttcgctattttccttttaaaagtacatattgaatcttcttgtagatgatcctatgcaataaatgttttcagtgcagctgttcaaaagtcatgtctgatctggaatgagagacaagtaggggggtggcaacatccttcaagcttcgcattcatgggaaggaagagccttttctgagacagaatgctaccaaggtcatgagtgaaacatcccatgggacccatttaactttatacagagaaatttactctagagcttcagattgtactaagtttgaccttctcccacactgactataaaaagtgtgactagttgtagatattttcattcaaaattctttccagtgatgaaagtctgaaatttggcttatcaccagctcaatgaaagcaattcaaacagcggagtaaaatggtagcattttattcatagaacactgatttaaactttttaaatcttggatattctgaaaaggcttggcacaactgaaaacatcatatcaaacattctgccatgtaaaaatgtatctgtatttctaggtcaatgaagcaatcatctatagattatttatgtagttaattatttagtttttagagacagggacttgtgatgttacccaggctggtctctaactcctaggatcaagtaatccccccacctcagcctcctgagtaggcactgccaaccatacccagctcttccacacatcttaaagagtgcaagcccatgcatatttttatttctcctatgaaagtttattggtggtgaaaataattattataatgatatcaatctgtggttagaaaaagatgacactgatacatcaattaataaggtgatgattagaaatataccttatccacagaaatagtgatagtttgcacctgaaatcatgtagtcatatctcccaaagtgtgaacgttagcttctgtgtataaccacatttttattcataagtagctattatcattatgaatataatataaaaattgacttctgggccgatggtcagtaaagcacaccccgtgttttctggcatcctaaatgctccctgtaaggcaatcattatttgccatgcataggcatgcaaacgtatcattttcatcagtaggatagtttaagatattaatttttatagaattatgaatttcacagggagtagcagcctatgatgatgctttgagctgcttcagatttaagctaacatgtttaaaaaagaatgcaaaccaaaataccaaactataaggcttcaattacagaattcatcgaatagctgttacacaggcaatgtttccattgatactaggagaggattgcctgcattaaaaaaacacagttttagactttgttatggagcaaatagtcatgttattttttaactatatttttgactttctaagaagtaaaaggcgatgtaaagaaataaatacaaatattcaaagggctatggttactattcgtataccataagaagtagctttttgattttctgagtctgggtttacatttataaagtacaagaaaatggtctattgaataatgaatttattcagatataaatgttttaatggcatgcatgctattacaggtatctgccagcatcatcactcccaccagcacctcagctagtaccatgccacatgatatactagcttgacactattggttgcagggaggtagtttttttaatgtaagagaaaatactactaataatgactacttaatgagttttctctctactataatctctgtctctccaccaactgtcagggaagtgactcgttgagatgttttgaaatcaatgcaatttttgaaaaattacttttacatgcagagccttacttgatcctcacaaagccattgtatattacataaagttattgtaattttcaaggtaaggtaagactactgtggcttagaaagagaatagagtctaggaactcaagcaagtcatagaatcacaaacatgcccagatcacctgatattccaagttattcttgcttcaaaacagaatccccttctattatgcatatatgccttctgtaaaaatgaaattacaatcttaggaatcacaattatacagatggaggagcacttacaaaacattctgtctctgttgtctaaacagagctagtgaggaaacagagcttatttgttttatcttattttagttgccaaacaataattgtatatatttacgggatacaatgtgaagtttctacacaagtatacactttgtaatgataagatcaggctaattagcatatccatcacctcaaaagcatgtcacttctttgtagtgtgaacatttaaaatctcttggagctacttaaaaatatacaatattattaactatagtcactgtgttgtgcaacagaacttattcctcccgtctaagtgtgaaattttgtacctattgaccaatttctccccattccccattcactctttcttcccaatattctgttctctacttctatgatttccactgttttagaatcaatatataagtgcgattataaggtatttatctctatgttttacacttattcacttaccttaaggtcctctaggttcattcatgttagcacaaatggcaggattttgctctttttaagggctgaatagtactccattggtatatataccacattttcgttatctattcctctgttaatggacagttatattatttctatatcttagctattgtgaataatggtacaatgaacttgggactgcaagcatctctttgacatcctgatttcaattcctttgtgtatatgcccagaggagagattgctgaattatgtaattctgtctttatatttggtgattttttttctttaagtaccatagagatctttttttattcagaaattgtttaatttcaaaaatattacgtgtagattcttgtcctgatagtcatattcacttaatcctcataacacctttcatcatgcttgcgtatttccttctaacttgtaggggaaaaagtatctaaaattcatcaccagtaattaattcaaattatgtactgtgctgtatacacaaaatgtttcttactttcacaaagctggcaattttgttttgtttcagagatggtgaattgtctttgagtcggtcacttgtcaatagctctgataaaatcattcgaaaggctggctcttcaatcttccagcacaatgtagaaggttggaaaatcaattcctctttggtcctagagataaggtgagtttctttactaaggcataataaatttcacatcatgttctcaaatacgttgggcttggcaaacttgtattcaacactggatttatggtttaagtatgaatacttaaataaaagaatgaaccagctctatttaatgttgctcactgaagaatatgaaaccataaaactgaaatcattatatagtcagagatttaaggatgaatatgtgagttttgaatatattgtctttatactaatggaataaaatattcagcagagtactgatatttaacatacttcactcaattactcaggatggacatatattttaagaattatctttaacttccctattgagtcttcattctgcttttgggttttctcaactagctgaaaattagagcctattacactctattgtgctgacgattataaataaattagtcttatcctgtgaatgagtatttctgtgtgggctcatgttttaaaaattggataaaaatcagaaaataagctttctagattactgacttcttctttgtaagactagtcattttagctgaaacccactcttgaactcatactccatgcctacgtttatccagtatgtaattttcttctgatataaacctgttactaataagaaagctagagtcataccttcttaattatggaggaaacaggaagattgttttttctttatagttacattgcattactgtattggttggtatatttgaatcacagcatttcagtaaacaagaactcactaaaagtgtgaaagaatacattcgttatataataaaataatccaaaagtcaattaatagttagcattaacacacagattttataggtgtagcttagtgactaagatataaggggctaattaattttcctgggtttctacctactcacttcttgtattatacctacctttaatgtagattataagaaatttgaaggaagagtctattagtctattacactcatctttagagtatgcacagaaatttcacacaatgttttggagcaaagataattacagcatgttgaaatttacttgaacgaatgtctggaaattttaaaaatatgggcatcagggcgatgtaggaatagtattactactttggtttaaaggtttgaaattgactgggaagggaaacaggaatcaaatcatggcaatgtcaagtggtgtgtgtttgtttgcttttagtttggtgggagctttctatattcatgtgcctcctacaagaatgaatagatgagtagagtctgatgacagagctcataaatcaatgacttctgggtagaatatggccagcaagaaaaatttatttccactggataaataaaaaagaaaccttaaagccaatattaaaaaccaggaggctttaaaataaaagtacagatttccataaactcttgagaaattgaatgatttgacaactctgaatctgtactcttcctaaggtttagctggttaaagctgacactagtcatggtctctcaagtttgacattttcatacctggagctcacatctttcatgatacctgtcaagtgcattcttctctgtcgcatatccccatccttatatttgaatttagaaaccctgtgagagatgagataattatgaggaaaaagtcacaagatgtgagttgatgtggggttataaacacagatatactttggtttagaatggagtaaagattcatatttcttgaaggtatattggaaagagagagagataggtgattaaatagcaaaaatttgatctgtaagcagaaaaataactttcaaattggatggcttagcaagaaaggagccaattaaggctatagagatctggtaaagaaacctgatggaagaaagtaaaataaaatgttgtaatagtttaactagtatatctagccatgctaaataatgtgtcagatagcaaaaaatctaataagtaaattaaataagtaattgacactagttcaagtattatatctggtcatgcctttcctaatagctatataaaaatcaaatactataaataggctatatacattttgctattaataacatattcaagtgaagggtagtaaacctaacttgacccaaaagattcgtattacaattttacaaatcaatgagcattacattcatgtatttgagggtgatctattttcaattataatagctgatagtatgaatgaaatgttagtactatttttgtatggttctccttaacagattaaagaaataaacaataaaacaatgaacaaatgttgaataatacatacaaagttgtcacttccttgaaaggaaaggataatttgtaaaaccattattgtacaatgtgcaaagagttcataaaaattagaattggctatagcagaaatgactagtgagtattaatcagtttgatacctgtaataaaaaaatttagaatatgaaaatatctgactgttggcttagcttttgcaaatatttttgaaaagatattagaaactaattatggatcatttattattattgttattattttctttcttcctcacttttctggcatttaagaatttccatatcactttgggtcagtgattgggtgtgggtaaattttaaaagtgttttcaaaattctacttttaagtttttgtttatttttatttttatttattttttattttactttaagttccaggatgtgtgcagagcatgcaggtttgttacacaggtacatatgtgccatggtggtttgctgcacctatcaacccctcatctaggttttaagccctgcatgcataaagtatttgtcctaatgctctcctccccttgtccatcacctcccgacaggcccgggtgtgtgatggtcccctccctgtgtccatgtgttctcattgttcaactctcacttgtgattgagaacattaagacattatttccaaccatttttttatcttactgattcaactatcattataaatctttgaaatttaaaaatcttattaaacttataatgttcttattatattcctaataattgtccgcataataaaatgtgaaaacagttcctgagataatttttttttacatttgtggatatgattttcaaccctattactaatccctttgttcccatatgccttattttattttcataagcacaccaagaatcggttcatatgtattcatcaaacaactgtacttctatgcaattgtctatgagagatggttctgttacttcactgtactttgaggattcacgatatatggagtttatgcattctacagctaactttgcactcaaaataattatcttagttttaagccttaatattgttgataaaagtttgttctttattattataagctaagaaataacacatttaagatgcattaaatgttgtgaataaatctgtgaacatcgtacgggagattatgtagttatgtccaatacttgcaacttgactttttttccatatttggattatttattttctttttttgttattgttttttacatgttgactagaaaccccgaaaagtgcaaacatcaattatagatgtatagaaatgtacaaatgtacacatcaggatagctttatcacatcataattagaaaaaatatttcagctcttagtgtcatgatatatcaataatctgaaatacataaaacctgcaggttaactaaacataattgcaaatttatatatgcttaactgacaagaaaaatttcctattgcatacatagatttactttacaaaaacttctacatacaatgtttatactatcttctacttgctttgatcaataagttaccgatagagctaatcttgggtcacaaagcttattagtggcagtgtcaagattcaaacccagacctcctgactgaggaaccaggaccttataaaataattttgttaagaatatattttagtacccaaatgtatattattaaaatttatcattatggaataaatgattctctttgctctaaaataacaaaagtcatttttcattcaacattaccaaattctggaccaaatatcaaatggcactctagggtgtaaattaaactaaaaatgctcttcatcaaatattgtgggacaattttgccttttcatttgttgtgtttaagattttttttgacactaagatgtctttcccataactgctaggacttagaaatcctaaataaggtacagttaaacgttttattcttccagagctttaagacaagttgccttgcaaaaataatctttcaaaacaaacaaataaaaaatgtgtgttctctctgtttttttgtaggcataatgaaacactgggcattttttagttttactttttattttcttttagtgaactgggtcagtactaacttaatttacagtgatttttttttgtagtcagtgtctaaagtttgcaaaaactgattcctaacatatgtatcatagcctaatttgcttctcaacttgtgatacattccacctataagattcgtcacacagtattttctgatggagttaacaatgtcatttagattaaattttagttgcaactgtgtgcttattattgccaagaaacccacagagaagagtggcacttggtgataacttagttatatttaacatttcacgagtgaaaacttgttactaaacaatgtttagtaaattaattttctgggattctgcagttgctatttcaagtgataggtgacgttgaaagggaagttctagttgaaaattcagttaaaagtttctgggtagaactctacttgttgtcagttcaacagtccaaaccaacctttcagtttaaggctgatattgcctaacaaaaaaaatagtttttatgactaagatatttagtttcactgaaaatgaaacagattttcagattccttcagttatctttaatgttaaaatagttgctcaatttaggtgtttgcttatctaatgaggattcaaaagttgaattaggatcacaaaatgacagttaaagacctgtgaagggtctttttttgtttgttcttttgagtcatgcacagaaaacacaaccccttgctttgaatattgggtaataacttgaccacgtactaggaaaacttgtactggtaaagcatgcatattaagcattagcttttgttgattcatgtgtctctagatagagcgcagatattaaagccagttttctttctacctctctcatttctgaaataattttgtttgacctgctgttaaacaaaaatttctatcaattgtcttcttagcaaaagcatatatgttctccttggtgacatgttgttgtttcagttcagtttaagtacaggagttttctatgcttccaatgacatttagctaattatacttgaattttttttcatatttatagtctgaacaacaactagacttagcaaattcacaaagcttttaattcgccattacatctacaatctaaaaactgtttgcactaggagataaaaaactaaccttttcttactgtttccaaaaattatgaagcacttaagtcataatattattcactcatagtaattactttcagtctttcttggatcctataaatggaatcttaactcagataattttccatacgtagaagacctaaaacagaaactgaaagtttggttcaggaataagaaaaaacaaacaaacaaacaaacccagagtcactcaagtttacctctttttctttttactttgtaaaatatcgaattccaagttttgcctaagttttttgtgtttttatattttgattagtctatgtgagttggtagtcttttctgttttgaaatcacttttactattttcactgcttcagttgaaaaaatactgctgagcctataacaacattggaaaaacacataattacaatctgcatttagtaattatttatcttattaagcattagtttctcctaagagttagacaatatgatgtcttttaaaactgtgcttaactcttatagttccctttttaaatcatttttccctaagagtaaataaaataaagaggtttacttataatcaggaacttaaaagacatgttttacattatttttgcaactaactgtctataacacagcaaaggtgctgttattggaaagtccattttgacgttagttgactagcatgtgttaacttttttgaccaaataaaatagattttcccttttggatttccaagctacagagtcttttttcaaatcaggaccactagtttactcactgcagcttgcaaacatgccacttcttgggagtgtacatcttcaaatagatctacagcaacccatttaaattatattcaaagaaaaacgataacaccatctagcctgatgatttaaccacatccgtgtagtctctattttagagccagccttgtcgttttcacaggaaatgagaaatttctgttgaagtacaggtgtcagatattaattattcaccagacaaataagtggtactcaataaatatatacaaaaaattctgtatattgccacttttgatgctagttgttaacttttgtgaaaaatcattaagtgcttgacataaacacttttccagtttctataatgcataagccctagggttgcttatttaaaatataattatcttcttatataacctggactttgttaagataaactgttatggtgtgtcagtggtatttctatcaatttttgtgatttcatttgtagagcatttgtataggattttctgtacaaattctactggttttgaacctgatattcagaatatttggggaaaaagatcataacattattttttcaactagctggtggacatatttcttgtttataaaattagagcagagtttttcaatcacttggttttctaattagaacaaatattaaactggaaaatatttagagcaaatcaaaataaagacaacaaaagaaaagatatgagttactttcctcccttctttgctaatcatgcttatgccttctgagttagagaattactcttttgatggagtcaagggatgaggttatattctgctctcactaataaaatttaccaattgtgatgagcttaaaaaataagagcactagaggaaaaatgtttccatcatatcttaaatgttataataatgacattgtttttattactttgaaaatacaagcttgcactaagagcactttagtaaataatatccaatttccaaactaggtgtagcgttttctcaaattgctttttgctggtattatgttgtatatcccctattatgttggatacccctagaatcaaacaattccagacttttgtaggccaggttcatagtttgagtcaaacacaaccccctgctttgaatatcaggtaataacttgaccacatactaggaaaacttgtactggtaaagcatgcatattaagcattagattttgttgattcgtgtttctccagagctcagatattaaagccatatatatatatgtttttttttttttccttaaaatctactagggtcccggactcttcccttcttgttagttccaggtgtaaataacctcatccagtgatttcttctgctcactgttcttaacccttggaactctcctctaattactctgacctatcctttcctcctctcaatttaatggcagctacccttaagtcattttaatctatggacttatatgggaaggcaatatcccttttgctgcctggatggctccaatttatagtggtatctcttgctgattggggttacaggaacatttaaaaggtcccaatcaatagactctcacacagtttagattacaggcactgccagatatgtattccctttcatctcagcatgcaagttagttggctattttatgcctgacttcacctcttctagtgccttactaaaaggagaaactaacataaacgaacatacagacacattttaaacaattattcaagaacaacatatttattagatgcatggcacaacttccaaattattgaagacagcaactgtatcaggtgcttctctatatcatgccaaggatcatcagttttccagccagctatatatatatattataatcattttccatcatctacctacttagcatatgcatatatttacgttcatgtagcctctcaatctgttatcaatttatatattaggtatgggctaggctaagtattgaccaaaaaagtaaccttaaaatttagtggccaaacaagtaggaaatttctttatttctcacttaaactcacatgatccactcatatactatttaattaagaaaactaacttgcatgacccaactgagctctacttgggttttgagacttgcaaatattctagctgagcatccatgtgcccaagtaaaacttagaaggttcaaatattagaaggaagaagagaaaaaaggaaactaaggaacaattagctacctctgccacacagagtccaatgttctatctattcattttgtctttgatgtatccatcttacttccaggactcttgatcttagagaaaaagttgcatatacatctattgctatagttttaattcttctttagataattataatatacatatcatatgtataaatgtatataagtttgagaagttcattccttttaatagcattaactatgatacaatcaaaaacaatctcaaattatttctctccaccttaactagatgatattaaacaacacttatgactatcaaaatacgctgaagctagcagaataactattcaaagtcaagtcatggccactgtgttttacttaataaaccaatttttctatatattttgataattggagtgctttttataactccacaaatagatgtttatactatatctatgtatacagtcattaagaatctgtgcaaatgatttttaaaattttgtttcttatagaatcgacttaattcattggtttaatcaccacctaagattcatagcttaccaatttggtaatctaagattaatagtttgccaatttgtattttgtcttaagttactttgtaaatgacaccatcagttcttggatatgctgatggtaatgtaaaactttgcttgtatttcaaatacaggaagaacatacttcgtttcttagatgcagaacgagatgtgtcagtggtcaagagcagttttaagcctggtgatgtcatacactatgtgcttgacaggcgccggacactaaacatttctcatgatctacatagcctcctacctgaagtttcaccaatgaagaatcgcaggtttaagacctgtgcagttgttggaaattctggcattctgttagacagtgaatgtggaaaggagattgacagtcacaattttgtaataaggtgagctttcttctgctttttgagattgtaagtttttcaaagatattttacttgggggtggaaaactgttagaaaattttaaagtattactaaaacctcaaacaaatatttgtctatgatatccttttctgtgcaacatttaaattacatttaccctggaatagaatattataattattgcgtagttgaaagaaaaagtgatcctgtcatagcaacaagattcacacagctttttttggtgaggtgaggggggaggcaaatggcaattttattaaatttaatattccacacaaacttttttcttagtatctcttcttcatactcattagttttgtgtgattttatttgttgtataaagattatgaatattactatggaatgatgtaatagatttatgttaatgttactttttattaataattatctaggagatagtaagaacatagtttagcaagtttatatttgatatcctgagccatatttctttaatttctctttatatgtggtatttgtgtatgttagtatatttgaattttatgtttttttaacataattaagcgtgcatgtttgtttttcattaacggttaaaagatatttgatgaattgtgtgtttgattaacctattaactgaaaaaaactcaacagtagaaatggaattataatcacatcataaatataagcagtttttaatgatcaatttttatatctgtacagtttttttggattgttttagttccttagaaaaattagctaaatgacagaaacatggatattgaaatatgaaatagtacaatataaagatagatagaaaagtatgctgagttgacatgttgaaaaacacagtctcttgaagatatactggaatacattatttttgaatattttgaatattttttgaatatttttaaataaagtcttaaaagcataaataggtaactacttttaaaaaaaaagtcatgagaaatcacactcaagcattatcaagtgaagaaaattcataatagcaaataaaactgcaaacattttaccttattatctttccttttctctcttgggtgaagggtcagagattaatgtgaaatcaatttagctttttaaaacttgaactgttaaactaattagactataagagaaaccttgtgaacaagtagatacaaacaaagacaattgtatagaaagaagatgtaaaaaatttgatgagggaatggcaatggaagtggaaatcaggagcttcaaatgtcgaagtctatgcgaagtatagctgtgaaaaaatgtaaggcctctagaatttctgatgtgactaaatcataagtcaggtaaaacaaagaagtaacgatgtcaaggcataatcaaaattgttgcaatgtaaggatttcaacaatcgcaatagggaattttaaaaggtgataatactggaggaaaatagagtctaaatgacttcttatttctgtgtccctctaaactttgacactgggggccaagttgttagatttagccccacctgtgactctgaaatgaagactgcttttacatgtgggtaatgagagaggcctgatggcagtagtcctcaaagtttgtatcatttccttattgcttcctgatctggctttgttactccagtttctattgactgggattttgcattatttcaattcctaaactactgagttcttatctcacatggaattgtgtgtccaataagtaggttcctacactctttctctgtcttaagagtggctggtggccaaccttgcttcatattaccacctctcactttcacttttcctgccttcaatttctagaagttatatagcctgcatatatctcacttccctgcaattggctatggcaagcctataggtttccagatttctgggatgtagtcaacctgtgaataaaattctgatcccaaaaaatctttctgtccacctctcttattctaaaattgaagcctattttctctttcactggccaagcagcaactggccacttgatggtattgccttcacagctctactatggactactgggcatttagaccactactaagctactctggtgctactccagcaaaatgcctagaagttgatattgtacatatattttctcttccttttatgttttaggcacctaatttcatgcctactttttagatttaaaaccctataatctgccgtatattaatgcactccaatttcaatttggaatattgatcattcctgtagtaacccaactccagtgatgttcagtaaactggtttaactgtttttactccatattttgtggctcctagattctttatctaccttattgctaactatcagatggatttgaatgtctattcttagtttcttgtccactattgtcaatcaacagatctaattttttagcagaatagccttagcacttccttaagtggtgtattagtccattttcatgctgctgataagggcgtacctgagactggaaagaaaaagaggtttaattggacttacagttccacatggctggaaggtttcagaattatggcgggaggtgaaaagcccttcttacatggcagcagctagagaaaatgagggagatgcaaaagcagaaacccctgataaaaccatcagatctcgtaagacttattcactaccacgagaacagtataggggaaactgctcccatgattcaaattatctcccactggtccctcccacaacacatgggaattataagagtacaatttgagacgagatttaggtgaggacacagccaaaccatatcattccaccctggcccctccaaatatcatgtcctcacatttcaaaaccagtcatgccttcccaacagtcccccaaagtcttgactcatttcagaattaacccaaaagtccacagttcaaagttccgtctgagacaaggcaagtcccttccgcctatgagcctgtaaaatcaaaagcaagctagttactgcttagatacaatgggagtacagttattgggtaaatacagccgttccaaatgggagaaattggccaaaacaaaaaggttacagggcctgtgctagtctaaaatccagtgaggcagtcaaattttaaagctccaaaatgatctcctttgatgccaggtctcacgtgtaggtcacgctgatgcaagaggtgggttcccatggtcttgggcagctccgcctctgtggctttgcaggatacagtcttccatccagtttctttcacgcactagcattgagtgcggcttttccaggcaaacggtgcaagctgtctgtgcatctaccattctggggtctgaaggatggtggccctcttctcacagctccgctaggcggtgccctagtagggattgtgggaggggtggggggctccaacctcacatttcccttccacactgcccttgcagaggttatccgtgagcaccccgcccctgcagcgaacttctgcctaggcatccaggcatttccatacatcttcagaagtctaggcagaggttcccaaaccccatttcttgagttctgtgcactcacaggctcaacaccttatgggagctgcaaaggcttcgggcttacaccctctgaagccacagcctgagttctacattggcccctttcagccatggctggagcagctgggatgcagtgcaccaagtccctaggctgcacacagggatcctgggcccagcccgtgaaaccattttctcctaggtctccaggtctgtgatgggagaggctgccataaagacctctgacatgccttggagacattttccccattgtcttagggattaacattctgctccttgttacttatgaaaaattctgcagccagcttgaatttctccccagaaaataggtttttattttctatcacattgtcaggctgcaaattttccaaacttttattttattcagtttctcttctaaaactgagtgcctttaacagcacccaagtcacctcttgaatgctttactgcttagaaatttcttctgccagatgccctaaatcatctctctcaagttcaaagttccaccaatctctagggcaggggcaaaatgccactagtctttttgctaaaacataaaaagagtcacctttgctccagttcccaacaagttcctcatctccatctgagaccacctcagcctgaaccttattatccatattgcgatcaggcttttggtcaatgccattcaacaagtctctaggaagttccaaactttcccacattttcctgtcttgttctgagccctccaaactgttgcaacctctgcctgttacacggttccaaagtcgctttcacatttttgagtatcttttcagcaacaccccactctacgggtactaatttactgtattagtttgtattcagctgctgataaagacatgcctgagactgggaagaaaaagaggtttaattggacttacaattccacatggctggagaggcctcagaattatggtgggaggcgaaaggcccttcttacatggcggtggcaagagaaactggggaagatgcaaaagcggaaaccctagataaaaccatcagatctcatgagacttattcactaccctgagaacactatgggtgaaaccacccccatgattcaaattctctaccaccagggccctccaacaatatgtgggaattatgggaatacaatgcaagatgagatttgggtggggacccagctaaactatatcaagtgagaacctcattgagtcaacagttgtattttgaccttatactttttctgtgtgcaatgtgtgctttactttcttttagatttcatgagtattctataatatatatatatttacatccaaactttaaaagataaaattccttgcctagataactagtaatattaagtagtgtgaaaaaaatacttttaaaactttgagaataatgttgacatagttaacaaactagaattttctctcattggtatttcccaggcgctttctcttctcagagaacggatgacctcagatgaactaaaatgagagttattatataagaatatatgccacacaaaatactaactttctcaattcaaaatagacttatctctatactttgtaatacaagagttctttgacaattcaaacagagtttataaacttaaaaacaagataggcttgctggagttttaatttatatttttgactttggaacatcaccgtggatttttcaaacacatttctgtaaatctacaacctacttcagtctacctcccactgttggtgaatttcctacatgagtcttacctgcatacaaaatcagaaattttagagtggagaaagaatctgcatctttgaaaagcacatatatggggagttgacacttaattcactataatgtagaaatttagtgaatgtagatatatgtgttttatgtatatctaactcagataactatgtcttagagtgtcagattcatatacacacccacaggcacatacaaatatcttatttaattattttatggtaaatatgaatgagaaaaattgaaattgccataaaagtgccttgacccctttttcttcttagcattatatcaccaattaatcagcaaattctatagatattaccttcaaaaaatatcaggagtcaaatgatttctcatgacatccactgctgtcaccctggtaaaagccaacatcatctcttgattagaactctacaatagttccttaactgatgtgacgggttgcattcttgctccctgttcccaaagccaaagtctctcttcatcataaagcagcttcttaccacactctataaaatactaatatcttgccagtaacaataaatgaggtaatctgaagcttcagggacagacgatgtgcctgccagtcattttccctgaaaccctcttacccacatacctatgggtggttttaccccttatttgggggaaaggatgagggtctatgcttgtacagaatatcctctgcaagtcttctctgactgtaatatcagaaacaccccctaccactgtcaccatctgtcactatctctttacccttccatttatgtatttatttttgcattgtatgtttatttatttattgtttatctttacaactagaatatgcaaggcaagctttgcctgcatttatcccttttttaatctcagaccctagtaaagagtctgacatatttatatattctataaatatttgctagaggtaagcaagaaggcatgtagtaagaaagaaaagaagaaagggagggaaagaggaaggaagtaaaggagagagggagggagaggagggagaaaagtgttctatcatggtcttccgtcatccatcccaccttgcatgaatgataatcccttatacaaacttcaatattaccataataatgtacttggttgtctgggatgagtggctgtcacatcatctcctccaaaactacagctcatctagtcatcatctcctctaaaaccttaggtgaccaagtttcagagcaggatgcaaattcttcctacagtaaatgcagaagctgtcttactctgtctttcatggagaaacatatatttggcatctgttgtttgccttttagcccaccatctcaccaagcaaaacatgaggatctctgctttgcgtgcctctttgttttctcgtattaacatatttttaaacttacagtatatagtctataattccaaatttatagaatgtatcttatgaaacaatttgcatgaagttgaatttacataaactcagtgtcttacaacctagagaaatgttgtaaggtagaggctactttacatgtgcacatctgaaatcttttgataactagattttttttctaaactatcgtcatctctattatattattcctttaaagacacaacatctctattatttctttagaggtaaaacattcctttatattatatttaaagatgataaaattaaaagcaaatatattgggctctacaaattcaaatttttatgagcttaactttcaagaacaatttctaaacctttctctataaatttgcaatgtagaaatgagttgaatagccacagaatttactgatttgtgcttgaaaatttgtaaatggcagagtacacttaggactaggagtttaggagtctcttgatattttagcagctgtgattgtttaaaaagattacttaataagaactaaatagtgaccaattgaagttcataatgtattctggacttaccaagaagtatagaaaggtaaagataagcatcttagtgaaggcacaaaaattatcaccatgatcatttttgatttgttctatatttttactactttccaaaaatagaagttagaatgttgtagattaaattatttgctagggctctactgtctttcatgcggtacgggattatagatttggcatctgttgtttgcattttgtctcaccctctcaccaagcgaaacatgtggtactgcctaccacataatataatctacaacattctacaacaaaatttctgatttaccacaaaaaatcagattttctaatgaacactttagaaagtatctacattttagaaacaatatctacagaaaaaccatcttttgttacttaatagctagttgagaaattcattcctttgagtttaattttatcattttattatgaaattgtacgtgatcacttactgtattctacagtgtttaattgtggagatacttgaaaacttttctcagtacctatgagctgaaaaatatactcttttattgtaggaagcaataagcaaaacactgatagttggttattattaagtagttgatggttgtatcaaggttcaattagcacttaagagtcatcattacaaacaaaaaaatgagcaaaagtaatgcctgggaataaaaactttgcagcccagcacagtggctcatgcttgtaatcccagcactttgataggctgaggcagttggatcacctgaggtcgggagttcgagaccagcctgaccaacatggagaaaccccatctctactgaaaatacaaaattagccaggcctggtggtgcatgcctgtaatcctagctactcaggaagctgaggcaggagaatctcttgaacctgggaggccgaggttgcagtgatcagagatcgctccattgcactccagcctaggcaacaagaacgaaactccattaaaaaaaaaaatctttgtcacttctgaataaagactgtcacttcttgtgaagaggcatgtgacctcattcttctcatttgattaattaggccactcctaagaatatatccttcaaaccatcaagccgaaaaatgaggtgctatgtctggcaatattaatgatgaaccaaactctcccagtgcctaaactccctataagttagatccttttcaaaggttaattaatagccatttgaatttctgaaatcaaatcattatttgaggggtagtaaagacggaggagtaaaacagaatccaatgccaacccattttcccaaagacaaaagttaatttcagctcacaaataccaatttgtaattgataggtggagagtgtgaccataatttaaatatagagtatatgaaacaaaaatcaaagacaattttgataataattttaataatagaagctctccataatcacgtgtaagtgttcaaccaatagactttggattatttcttctggtactacgttttcccttaggatgatatctattttctgttttgagggtcatattgtgctacctcttaacattcttagatttgtaacaacccttgaaaatacaaaattctaatctgaattatgaacataaaccagtcacttcattgtggacacgagatcttcaatgacctattgtcataccagactttctttcttccttacaactcttgttcttcttgttgccttctgactcattatttgtgtaacaaacacatttccttcctcaagtgtatgcgtagccctttgttattgccaatgtgtctcctctactttagaaggtccagagaatttttgcttcaaatttaatcaatcctcattattctttcttgaaatagtttcctagccacattgaactggttaaaattattacaaaatttcagtaataatttttagaatccctagaattttttattatcctggagatgtgtatatatctgcatagctgtagatatgattgatttgttggatggttggttttacagtctgtgtttccacttttttgtttctcacttttcatttaacacagtaaatttgttgagagagagagggagagataaattatacctggtttacttgcagtgggcactaattagtacagtaactccttaaggataagatttacccaagtattatactcaagttgacctctaactttataaaccaaggtactctcttagtggctgtttgtatcattcattaatcaattacgttaaataatgcttttaatggggtatttcaaaaaatgagagtcctggtcaatatcattacatgatgcttaaagttaaaaaaagaaacagaaaaaaataggaaaataaattaaagctcaattttcatttcctaccgagtgactcaatatcaaactgatttctaaaatttaggtctcatgtacatatatccctaaataacagaaaaataatcataagagtaaaattcttatttcttaacaaaaatgtctaaaactctaatttaagtaagaattttaaatacactgtgatcaatgtttttatatgtggaactctaaaaatgcctagtatttttacgagattccttaaatagcaaataccatgtttcaaagaaagaagattggctaagatagaaaaacaaaggaagccagtcattggctaggttaaagatatcttacttcttgtccggcagtaccctctgataagaaaggtttataaaaaaagataatgtccttgtaatactaagattttgtcatatgattacagacaagcaaaattttgacaaatttggttaggcattgatgtgccatttatgtaccatttctcacctgcttgaggaaaaaaagcaaatgggagcataaaagaaaatattgttttggtattattccttagacgtatctcttcaaagattgataggaattctgaatactcttgatgaactaccttaaaactgcagaaaatgatgattttcccctatgagattctgtatgaaagaatgttcagttacatatataattcgatctctcatattctctttttcatctctgggataatttcttttatccttcagataacatctgtatttctggtattattaaatacagaggagtatagttttaggctttatgtctttgttttattaactaataaaagagaaattccaaatattcagttgactaatgctacacttctaacatcaatagtaatattgtgtgcagaagaaggtataatatatgtgattttaaaattgtaaaacactaaaacactacttgataccactacttttaacattagtaaatttgggaacctctagaactagttccctaaaatttgtctcaacaagagtccacattaatgaaaattctatcaactgaaatacattggttttatatttttcttgtaaacatttaaagagaaaattagctgttaaaagataaacgtcaagtttattttatcaaaaacactaacacttgttacattattttatttatacaataaactttcaagaggaccaaccaagagccagtcatgaacagtgcccaattacagaaatgaacatctacattcattcttaaaggacaacctgtgctgtgtggggtgaggaataatcactacaattcagagtctccaaagacacataccacatttaaaatatttgtctacggccaggtttattatttccaataatgcagagggactaatagaatgtttgaaagagaaattaaggtatgcttccaatgctgaatgaggtgttcccactcagaactttatctgaagtctttgagatatgtcaggataactaattaggttactaatctttagatatcacacataataaattttaagaagatatcattggtcacgttaaagttttatttaagtgccataagctatcagcattctactctacaccaaccagaacactgccaacatctacacaccttatataattaactattaacagattcagtcaccatcataaggggctgaaaaatattcaactgactaaaaccctggtggtctctacctacctgtactgtagaatactttgacccacttttagactttacatacagttcaggggattgtctagtacatatctgagctgaatttaacttacataacacttctttaatgccacataaaatggaataatgatagaatctttattaagttaaataaaagctagtaagcattagaaaaattgtccaattgatattattttttaaattttgcacttggattgtttgatgtgctaaatatcatgtaaacatagagatagatagatgataaacagagatgacagatagaagctgagcacagtggctcatacctgttatcccagcactttgtcaggcctaggtgggaagattgcttgattccaggagtttgagaccagcctgggcaacatgataaaactccttctctaaaaaaattaaaaaattagacaggtttagtgatgtgtgcctgtagtcccagctactcaggagactgaggtgagaggatcacttgaccccgggaggttgaggctgcagtgagccatgatggtatcactagactcgagcctgcataaaagagcaagaacaagagcaagaccctgtctcaaaaaaaggaagaaaaaagagatgacaggcagagaaatatagagaggggagaggggaaaaggagagggagagagaggaaaaggcacagagagaggacataaaaatatgaatcaaattgatgctgtgctgcactgaaaagcatcacttcagatatagtccaagagtccaatcagagtttattgtaggtgatattggatgaagtttttagcttttctatatttagttttctaatttacaaactgagattaatatatgtactctttctgtctacctggagttttacaacttacctattatagagaccacagagtgatagaattgctcctacaaaatccttgcctcaagtgtacccccaccatgtatgcttatttgtcaaaaagtgtgttgtaaaatttcaagaattgagagtttgaaagattgcatatatcatttatatatcaccataggtaaaggaaaacaggtttagaaagattccctcatacaatctgtataaagtgtctttcaaaacctttcttaggttctttctctttgagtacttttgaaattaatgtaatagtgtatatattacattaaggaatttaatttgttggttgtgaaaattgttttgaattttgcaaagcaatgcttaaagtgcttttacattttttctgtagttatctttcaagtttttacataatctactctcataagtatctacataaaagcatattctaatatttgtactagctatactcaataatttcacaacagtggttttcaataaaaaatattcatatatttcctaatagtgattttgagtgatggcagagagcaaagtctcattccatcgctcctagtctcctcttccccacctttgttggaaaagtggtggtaaattctttcctttctctgggatggctggagattgtagaaactctcaagcagcacttaagtactggttcctcatagaaaagaaaccttgtttccccttggtaacaagaaaatctggccctgcactgtctttggtgttatatggtggactctgagggaggcaatgattaacaattacaattggcacctaatattctttaaccatcaaataccactccttactttgtttaaacaaagctactagagatagtgagtcttctagagatagtgagtcagaaatcaactaagagctacataacatttttttttgtcacttttggctaattagttggaatttctaacttaagtttgtttatttacttatttctttctacttacctttcctccattctatcttctcctcatcttccctctagcttaaatcactatcttctatttactcctttttaatttcttaaccaacatcttcattccctgccctgcagctttttctctccttgactactttcctcctaatttcctcttggtgcatatgtttttccttataaatcaaaaacagcaataagatatcaattaagagggccacttaaatgtgtacttatttatgtaagtaaatccttgctactcaaagtgtggtcttggatgaccagcattatcacctggaagcttgttagaactacagaatgtcagaacttgcacctggtctgctgagtcagaatgttcatttgattacagtgtccaggtgattcttatgtgcattaaggcttgagatgtgctggcctagacaatatgccctaggcacgctggagctcccactatgtttgattttttttttttttttttttagcccatatctttaggacctagcaccaagattggtacactgaggttggtcaataggtacaaaattacagttagacagtttagtcaattctcacattgctaataaataaatatccaagactgggtaatttataaagaaaagaggcttgactcacaattccatatggctgggtaggcctcaggaaacttacaataatggtggaaagcacctcttcacagggtggcaggaaagagaatgagtgcccagcaaaggggaagccccttatgaaaccatcagctctcttgagaagtcactcactatcacaagaacaggacggaggaaactccctccatgaatcaattatctctatctggtccctctcatgatacttgagggttatgagaactacaattcaagatgagatttgggttgggacacagctaaatcctatcagacaaaaaggataaattctggtgtctatgacacaataggctgactatagaaagttacaatgtattgtatatttcaagatacatacaagaaaaaaattttcaatgttatcaccagaaagaaatgaaaaaaatgttaaagtgatgaatatggtaattaccttgatttgatcattatataatctatacgtgctgtaccccataaatatataggattattatgtgtcaattataaacacaaaataataaagagtgaataagattttttaaaaagaatataacttccaagaaaaacctgatacattgaggtatatataatttatttattgaatggataaattaatgagaaaattaatgtaggagttgagaaaattttggtttgtattcacgtatctgctgtcagaatttttaaaacactgaatttcaaaattagtacataagaggagtcatatataaagagaatttaaacctttacaagaaaatacagaactaagaagagtgatacagtgaaatgttctaaagattagggatcagaaaatctgggttcctattaattactataaatgtaatattagacaaccatcactattttcactgttcagtgaggtcaataataataggcctattaacagcagagtgattttctcatttatcagatgagaacatagtaaagaaaagcacaaactgtaaaacaaaactcataatgagtgatgctaaaggacatcttgtttgagttcatcgtcataggtaaaacttaaaattggcactgcattttctaacagccatggctaaaaggaaagcctgttgactagagacacaaattattattgtctgatatgaataagaagatgaactttccccaaatttatcaaacatatgtaaagttgacactaaataactggataaaactgacactgaataatatgttacacaatgtgatataaaaaacaaagcaatatcactcagataggagtgtctacaaaatctgagtatgtaaaattagatataaatgtagtgaagatatatatgtcttcagaaaactaaggtaatatggtaaagatatattatttaatgataatctatattcctaaaagtagggatgatatttttcccaaagaaaaaggatggaggaattgactggctggtacaatgcattttataattcaatcgattttttattctccactggtagataatttacagaaagctttaaatcaccttcttgacctccttgaatgctaactcttttatgacaaaatagacttttctggaacagaaaaaaaatatcttatttttctacatgttcacaatgaatggccttaagactttatccttctactctcacagaggatatgtattcccttaactcaaacagcaaatagcaaacagctaagttcatgatagacagccaagtctagggcactagaatgatgtttttaaaattactactaaaacgaataaccacttatagtttaggaatagtaacattgcttatctaatatttgctacacacattttctccagtaattttgcttaataccttattcatgattttgatctatgaaattttataatttgtataaaactaattaaattgtgatttttgtttattgattttaaatgcaaaatttatgttatatgtagaaatatgatttatatgttgttctaattatgatgtttaaaatttaacttaaaactacacatgaaatatgaaatataagttgtgatgagaggtacagctctttatttctaattatgtcactcctcacacagaaattattttatctacaagtaaaaattttaaaaaatggaaatgatgacaatatctaaaattttaaatgttttaaatgttttcacccattttctgaaacaaagattgtaaacgatttttcatatatcagtctaacaaagatttttaaaatgtttactagtcagtaaaaagttacattgatgttggcactctcgtaaaatgcatttggaaatgtaaactgataacagcttttccaaaaatcaagttaatgatgtcttccaaagccttacaaattaaattaaatcactgtacatctgaatgattattcaacatgtgacgaagaggaatctgaagcaatgggaccagtaagcacacagacaaatactttccatgatcttaagataagactattcacaatagcaaagacttggaaccaacccaaatgttcatcaatgatagactggattaagaaaatgtggcatatatacaccacgcaatactatgcagccataaaaaaggatgagttcctgtcctttgtagggacatggatgaagctggaaaccatcattctgagtaaactatcgcaaggacagaaaaccaaactccgcatgttctcactcatacgtgggaattgaacaatgagatcacttggacacagggtggggaacatcacacaccagggcctgtcgtggggtgggggaggtgggagagatagcattaggagatatacctaatgtaaatgatgagttaatgggtgcagcacaccaacatggcacatgtatacatatgtaacaaacctgcacgttgtgcacatgtaccctagaacttaaagtataataataacaaaaaagataagacagaatttgagaccaccctattgttaggttcgtaataaagaacattcaaggggaaaagccaagatatgctgaatttaaatgatgaaggatcatgacatcatgttaagaatttgcatggaatcttatagtccaagaaggacccttggagtttgttagcatgttggtctgctttttgtttgtttgtttgagttttgttgttattgttataaacagaagagaaacatactgagaagtacagaaacatgagcatattcacacttggaaagaccataataataaacagataaataaaatatatgaaagagaaggcaccctaagtgaggaagatattagaggaggaaaaaagtgatgacattcagatcatagcagaaagtaagatgataacacctagtgtcgatggtatgattcatattaatgtgaaatgttatcattgttatctgtctttgacatgaaatggacattagcaaatggtcggtagatctatccttctatagatttccaaaatatggctagagtttttgatttaaagtacttgttatttttcaactatcatacttatctgtaaataagacataggttaaaaatgtactccaaagccaaacacaaatacacttgtcagtgcctattgtttcaagttatatgtaattataactttcatctttcttataattgttcttcacttcttcattcagtgctttatcagaaagttcagatacaaatataaagagcaagtttcgacttttgaggtgatcacactctaatgaaggaaataaattgatacactaacggtgtccaaattgctttattaaaggtactcacagaactaggcactgataatgaggcaaaaggaggacataagctctcattattattatgtgtagctttactaacttattaaagatgtcaatccctatacaagtaacaaaatatgccagagtttaatatatagtagaatacagataagagtaagtacttttacaccagagcagtggaaacaattttgcctgggaaattatgtaaagcattgaaatggatattaatcgttgatttttaagaacaaatatgactttttcaggtttagggctagggtgtctgaggaaaagaggcagtttcaggtagagacatcagcataaataaaggaatacagataaacaaagacataggtagtctgataatatttgaatctaagatatgcaataggatgtataaaacaaaaattctgggtaggggagggaatagttatgaaagacccaattaggaatcttgactgaaactactgaagatgtttggttaggttcataacatgattaaacgtacattttaaacaacaaaacaccatctctgaaacagagaattgataaagttgacagtccctgtggcaagcaactggttagagcagtgtcttttaatatcttttcacaaagatgattagtaatagaatagattttatatcatggtttactccttgtattatttccctggctactacacatgcacacaaatatggaagtcttcaacaaattttcttaaaattatgttcaaggaacactgtcattttctgttataatccgctctatccttttttattctttcaaaattggttatcaatgagcacacaattaattcatgatctaccaatgagtctagttaattgtttgaaaaataataaggacattattacaatactagttcaaagaaacatggtggtacctcagctgagaatgtatcaataagaacatacaagaggaaatatattcaggggaaattctgagaggaatttttagggctttgtaatgaatcagatacagaggataagaacattatggggatcaggcattacagctaggtcaaagtatgaatctgttaaaatagagcttgagaatgatccccttagaataagtatggtgtaataaatgtgaaattgccttggcctaccttatgatatcagaaattgaaactcatttttgtacactcatgatatttttcccaatgcttgattggtattagaatgcctacatcttttgagcatcaaaccaactgtctttctgggactcagtattgaataaataatatatactaagttaaaaatcattttcaaccttgggttatactttcaaaaaggtatttctaagaatgacaagtgaatatggtattaagtttttttgtttatttaagcaagaaagttaaatgtcaaagcgacatttctgtggcaatttgatggtataatcactaagagttagatatttttcctacaacccctctaatgtacccattgtacataccttattaacagcataaattgcaaagggaacaattatagtttttctaccttagttttctatcatgggtgattacagtatcagccataataaatgttgtttcgttctttttagtgcacaacataatttttaaggacttaagtactatgctgaatcagttctttcttctgttaaacagtagtaactgctcagcaaccacagaccaatggagtagtcagtttccctgatgattttggcaagaatgtgtcaggatacatacatcttgagaattctcacttggttctccaatctctaattttaaatatcccaattacaaacttgtactcaaagttttatttcgcaatacacagggcatttttcaacaactcatattttttccctgcattcctcaggcaaataaaaattacacttctttttaattacaaaggcagaattttgagggtatacctagtatcgattctatgtgcaattttaagaaacatatttatgattcaaatatctattagttgactaccataaatatatccacattcacttttgtgaaaaaaggaaaacaatcacatgctaattcttaatggtctgtgataaatggtgaaattaatatgtcatatttaaattatcttgacaattcatgtagtgtaacagcaagttcctaacaatgctcatgaagtttaatgacgtatttttcacatctatgtgtatgtttatttagcccaggtattaaaaaaaagtttgagtgtagaatcagatgtagactgcttggttttgaaccccagctctagcacttacaaatcaatgaccttgggctggtcacccatcctctgtgtttgtgcttcagtttactcatctgtaaagtacatatgattgtagtactacttcattgtgttgttatgaggcttaaatgttaagtttatgtatatgtgtgtgtaaacatatatataatatgtatttgtgtgtgtgtgtgtgtgtgtgtgtgtgtgtgtgaaatttagaagaggtcctggcattcttgaagtcctttacaagtgttaaaataaacaaagatgtctttgtaacatttcattgaagtaaatttttcacatagtcattatttttacttatacaaacatcttttagtttactctttgaaagaaaatatgtgtgttatatgtgaaggaaaaatgtgatcattaaattaaacaattaatcaagatatagcacttttaacttcaaatatttccattcattttggcaaatattttacatatcttatttctcctatattttgggctttgactgataggccctggaaacataaagagaaaatagatatgtttaaggaatccatagtctggtagaagaaactaacataactatgtaattaatccacagtgtgataaattcattgagagacagacactatgttaacattgtgtcaatgaatacaagacagcacttagtaaaaccagtgttaaaatgacataatctaaggtttggttcttaattctgaaggcactgagaattactattggccaggcccatgtgtcctcaagcttaaggggcaagcttatgctttctaaagcagactgacattccagaacactacattttaaatttcattcacaggaagtctcatcaaacagaattctcataattagtaaatgtgcatggatgattggaggagtatgagactaaagattgtaagaccatttaaattataaaaaaaatctaagcaaggcgtaactaaaattggacagtggcaagaagagtaaataggaagggtcacattttggtggtaaaaggagtatatatgaggcagaatttgatgaccaagaagatatggggaatacaatagggagtgtgagaagtctctgagatgcttgtattttggtgacactagaagtaatagtgacatagtattagaaaataaagaaaaaaacaagaagtttatggaagagaaaagagaacactacaggtaatggttttcaatttgaacatgctgatttgaaatatcattgggatagtcactgaggagttcagtaactgattgaaactcaggtaggagttagagttgaagataaagatttccttaaccatgctaactgaagagttagagtagttgatctcctgcaagaagtgaggtgtgaattgagagagaatatgtctagtaacaaaaatctagaaaatgccaacaaggaaaaattaataatacggagtgatcaattggactatttttttgcctttttaaaaaactattcagtatctgacaatttcttgttatttaaggctaatctttaaaaatgtagaaaggggccctgttgtccactacagaagcaaaaattgatcaatattttcatttctctctgcctagcagcaaagggacagaaatgtggtcaaaactagtttaaccacattttcctaattatgactttggctagtgaaatatggggtaagaaaactgggtaaactggaagttcagagttccctgatagtgagaaatgctgaggtatccctgacagggacataaccattgttcggggactatgatttttttagtgatttctgtggtccagccagctttccaataaatcactttttctaagttaagccagagtcggtttctgggagttaggtatggacaagataagaacagaaacaaaggaaatagacttcactgaaatttaagaaacactatgcaaatgtcacaagtagtcaaattaaataataaacattataataattggttgttttgtgggatacaattttgaaaatatagtattcagttatgtgtatgttatgtctcactgatattgctatgtgctttgtactgaatttaataaatgagagaactttacaaaatgattaccggacacctactatgagatactttggcagtgggaataagtaatgaacgagacaagatacctccccgcattagtagaacctgaagtttgttgccatttcagaatttgctgttggctttttttttttttttttttttttttttttgagccggagtcttgctctgtcacccaggctggagtccagtggcgtaatctcggctcactgcaagctccaactcccaggttcacgccattctcctgcctcagcctcccaagtggctgggactgcaggcgcccgccaccacgcccagctaatttttttgtgtttttagtagaggcggggtttcaccatgttagccaggatagtctcgatctcctgacctcgtgatccagccacctcggcctcccaaagtgctgggattacaggcgtgagccaccgcacccggcccgcttttataaatatattgtgaagtcccagataaagaacagcagttaacgctttaccctccgtattacttattacaagcaactatacattgacaaccagatgctgttagaatttctttttaattgataaaagtatttacaaattgttgtctttatgatgtcttatcattttaatttattcattttttggttccttttacaatatgctctattttttatcctttcttgaaaaaacaagtgctaacttgtaattagtcataccattcaagtctccaaggagaaagctgataaatgtgaagttttagtttgatttaaaatgtggattcacaagtaagcactctgactaaaagcacctttcctgattttacagattcttttctgttgatatgctgaagtgaataaagacagtgtaagacagagccgtccttaccacttgtccgtagctgaagtcctgggataactctctaattttatgtcttattttaatccattgctttatatcagaaaagataattgtattttagattacatttaaataaattaaagatattaatagcattttagcgacctcataatattttgagataatgctttcagtatcctcttattatttatttcaagacttgagttccaatgctaaagaagatttttttatttcagcaataacatttgtttatgtgtagttgttcatactgggtacatttcttatatgatataaatcttttgaagagaaagaagataaaaatttacacatttcaatatatttattttaaaattaaactccatgagtggattttacttctcattttcacctagaacaactttttattttagggaagagaatatgggccactggttttattgtaaagagtcttgatttgaattcatgtgttctgaattttagtactgtacttttaaatggcatctcagaagtgggtcatttttcttctttcttccttgcttccttcttccctccctcctttagtgtgtgtgcatctactattaattacctaactttttcccacacttccatcataggaaatctcagaatcaaccttttattttccttcacattctttcctatgtctgttttctttggtggcttttcagaggagcacaaccttctgtatattcctacctgggagtgactttctgcatgctgggattatccacccaagaccctacctttggggaggaggatttacagaagactgagaaaagatgaaaccttcactttagccaatcagactttcagaccaaacatgaggttcaacaaggtgatagaagtcacagccatatcacttgcacatatgcaactgaacttttgaccaagttctttgtatttattttttgcttcctttccattcttagggattaagtggtacataatatttaagagcatgagcttaaaatctgcctctattacttaaaactatgtactcttggacaaatttcttgcaactcagtttccttatcattggaaaacagcaatagtgactgtctcattggcttattgtgagaatcacatatattacatgcaaagcacagagaatgctccctggcacataacaaatgttcaataaaaggtattcggccaggtgcggtggctcatgcctgtaatcccagctacttgggaggcagaggcgggtggatcacctgaagacaggagtttaagacgagcatgacaaacatagtgaaaccccgtctctactaaaaatacaaaaaaaaaatggctggggtggtggggggcgcctgtaatcccagctacttaggaggctgaggcaggagaatcagttgaacccaggaggcggagataggagggagccgatatcccgccactgcactccagccagggcgacagtgtgagactccatctcaaaataaataaagaaataaagaaataaatattttaaaaatttaagtattcttcttagagcaacaataaaatatttttcttatcttctatgtgaattatgttattatgaaattgtaactgggaggccttattctcctgaacagttgagtcatattcctctttttaagtacaattgaccatgtctatgagttttaaagtttccacactgcctatggagtcaaatttgtttcatctaatatttaaaatatttgcaatctggccccatcagtcattcaagtctcaattcctaggggatcaaaagtaaatttcagccacaatggcttactaaatgtgttataaataaagtttgggcttccttacgctgttgctcagagatcttatttgacatgcctttaacttacctgcatgcatttcaaaagatttattatcataatagattgtaaaaggaaagagcatgtaaaaggaattagcataatctaatatgttttatccacccagggcaaggaattttgagaggcattccaaatattttgtttcatttaattttcccagtacagttcccatcagtgttagcctgatttatagaaaaatttgaatctctgaaatatttttatttgtcacttatacttcaataaaggaagaagtaaaaaaagagttataagcttggacaagttaagtaacttgattgatgtgaactccattgcccacatggttactgatgatcaaatagctaagaatagaaatgaagctaaatatcttttatttcttaaagtttaagccaaatttggataaatatgaggtatatatttaacatttttatttaaattaaacaatatatttttccttggcacgcttcccctttttctcccctcccaaatctaagctattctctagaatttgtgcagttatagcaaatttgaccgatgattccatttttcttttcacagaagtatcggaatgacacagtctaacatatttcttggtatgcagatctttgtttgctagaaggagtttgattatattttcattctgtgaatttctctagaaattatgacactgttcttcccacccttgccagtaatgttaacgaacctgggtttgtgaaaaatttcctcttctgtttagtcatttcattattttcatgatgtgtgttgtttgtatttctatcaagttgagaatttcaacaattggtattgttaaaagcataaaatgtggtgtgtgtgtgtgtgtatgtgtgtattttgtgtgcctattcatcatactgaacatgcaaatgtttaatgtgatatttcaactttatttcttatattttgtttactacattatggtataccacatgaaagtccattttaatcctatggttaatatttcaaaagtcttatcaattagttatttaatactttctagtatcattttgaaatcctgtctatcaagagatctgaggtatagatattatatttatgttttagatgtttaaaaccttttgtttaataactgctcaaaatttgggaaaggtcatggctgaatggccttgaataacatacctgagtcttaggaatctgagatgaaaagctagggataaatgatagaacactctttgttctataggaaggtttgtgtgcaggatgaatttatagacatttatcacatttctgaatgaactcatatgtataatagtgtcagttaaaactcctgtcctggaatgattccaaactagatggtgcttttcatttataacctatatgcccttggacatgtttctcaaccactttaaccttagtttctcatctaaaagtgaagttgatactactttttacctcaaagcaaaatgaatggtttcaggtctatgtggagcccacaaccttcatgacaggaaagtcaaagagactggcaggtcgcatgtgccaactttccacagaaattttgagaaagtaatcagaaagtctaagaaaagacagctaacagattttttttgttctatttgctcctcaagctgagaaacaagatgggagcaaacgggatcaataagcttcctttaggggcagaaaagagaagacattggttcctatttcacagtggattgacaaaggtgtttccgtaggtaataatgttttggctgagagatgtcagttagcacaggaagcaacacagtgggattggccaaaaaagaaaaaggatgataattatgtatttggaatttgtctgaatattaacaaaggtggggaaaatttggtctataatacacctagaattgttttcttcttatttaatctgttgggtgtgtgaaaggatgtaagtgacaacctccaattattacagaacaccatgttttacaccgtatttactccagttttggatgatgagttctatacctagcacagatacatacaatacgttgtagaattaaaaaatgtagaattaaaaaattggatagattatgtcattgttaaataacataaataactaaatagctagaaaaaaagtctgagcttctagagtagtgtttgcaaaacaaactctcaataaatgcctgttaataaatgcaagtgggatctcctagttgcatacattgttgaagtatcatttaactgcagagaataatggccaatccaagagagattttttgctagggaattctgtaatcttgaggtgctcacacatgaaataaacatttattccctatgaattctaaaataaatattttatataacttttaaattaacatgaaagtaccttcaattttgcatgtagggatgagaagccatcatatgcagtgtgaaatcatggaagaaaattcagaggcttagaatacagtggagttagctgcattcctgtaggtgtttaatcaatattggagaataaacacaaataaattgagaactgggaagtttagagtaaataaagagtattgttaatacagctaattctgtgtatatgttttcaacatgtcaaatataaaatgggcacaaatatttaaattggctaaagataatgttgtttgactctattaaatgtttatatgcactcaacaattttgactcaccaaagtccatcattttaaaactggctactcctctattttatgagattaagagtaatatgagtatcatgtattactcataaatgcttgagacacattctggctaattttgaatattataacctctaaggaattttttataaagaaaaatgaaaattgtgatggcaaatatattcataatcctgctcaatcagcagttttgctgctagtaatgtttggatgctcacaacaagtctactgaattgctggagtgcaacacagctcgttggttatttttgattttttaatgctttcttttaaataagtggcattcagctaattatatgactaaaaatctgactcaaccacagagttgttaatttaccagcaacatgtggacattgtattactctattttccagggaaaatgtatatatattcttccccaggaaaatgaacaagctggactcctaaaaccacaaagcgttgtattttatgaagtgtcttctgtcttgttatttcctgtacctcagttactatccttgacaaagtctgattgtgctctgctcagatcctcaagactctgcatgtggatttgttactctttgatctccaattgctcctttagttagcaccatactcatttagcattcattaattaaatcaaatatgttggtttgtttcctaaattaatctgttctccataaatattcttattccattagcttctttttgctttcaaagtggaaagcatttatctttcagccttcagctttaattgatgagcatcttaccaccttttgagaaattcatgaccagaaaatcaagagtgggtattggcaaatacggatagggggtgggatgtttaaagatgtggcaagaaaaagtatacagtaattgagtgatttttttcctgaagggataattcagcagaatatatcatttttattctatttaattgggttggtttttactagttttactattatagtgaaaataaagtacaaatattgttttctctacaattggaatcctctaaaaagaaattactgagggtttgttttagtggaaaaatatgtccaaagccacttccccaacaggaacatgttaactgtaatgttacatgtattctccctattttacctaaagaagtgtcagtaataatgatgtccagaatatacttttccccatagtatccaaattcatgtgataactagcttcattaggagtttagattacttttaatatttgtgtagagcacatcttaggactttaaaatgatcaagtccttgatcttccttgagttccacaagaaggtgttcactttgacaagtattcgcatgcagcaaatctttttctgggtagtcctgtttgtaatattcttaccataatgagaatgaataatatctaataataattagtggtatgaatcatgagtagaaacaaatacatactctgtcatataatatagtggatgtaattaaagatacccaaattgaaaagataataatctttatactttctaaataatattattgtgttaatatttttccctcagtagctaaccctaaataacagagaatttgagatgaaatatatttgttgttgtagctaaatattgtcggagatctaggaagtaacaagatatattaattaagagagataaggaacgatatataagacagtatttttagtatcagaacacatactttactttttaattaaaatgtttaataattcaattaatgtgacaaaatacacaaggaagagaaatgtaaggaactttcataatgtagccaaacatgcaaaaatgcagaaaaagaaaatcccttcccttgaaaggctgataaaagtattaaaaatagtttcatattttcatgaagggtttgattgaatcgattcaaacaactttttcccaatacagtaaactcttgtttatcaaaatctaacttttcttttatcaactaaaacctacctttttaaaagcaagttaaaaatagtttttttaaaaaaaaaaatgaagctatttttaaaatcaggtataaaaaggtctatgtgaccgatcaaagaagcatcagaaattggttaaaggccaaattcaaggtgcttttcaaagctttcttctaatataagaatgttatattagattatataaatataaataacaggttatataaacaacatcaggcccaagctcttttcaaaaccttatggctctagtggagaaaacagtacggcatattctgttctttccctacatatgcattccccagggatgcatacgtccgaaaagggaaaacagatattttgaggatgtcctaaaataacaggaaggctgatatttgatcttatagtaagagcttttctatattacttaaaaccccagaaagtcatattaaatatgacatctccacttttcttatttttcttccccatttagacctatagaaagcaattgtaaatatgtttgtgtaaaacactataaggaattgcacttttcccctaacctcagtgtgtaagtaaagccaactttatttccttacacttacaaagttgttgaaatgacttaagctttacaagtggtgcagattagaatgtcaagtccaatgtgttttattcacttgtagagcagcatgtggtttaaattgactactgaatggccaaagaacccttgtgaatttaccatcataaattctctgattacaaattcaaattgtgtggttttatgagataatagcaaaggatattcttagacaacaggttgaattcatacaagaggcattttgagccctgtactgggactgtatatttttattgcaggcagtattcctgcacgtgcggagacttattgaaaatgtaatcttaccaagtagatgatcttttggttttcttttcacatggttaaaaaaatgcttatttcccattcttcttttcatgaacaccattttaccagtgaatatttctttttttttcatttgtcccattaattttttcctcttcaggtgtaatctagctcctgtggtggagtttgctgcagatgtgggaactaaatcagattttattaccatgaatccatcagttgtacaaagagcatttggaggctttcgaaatgagagtgacagagaaaaatttgtgcatagactttccatgctgaatgacagtgtcctttggattcctgctttcatggtcaaaggaggagagaagcacgtggagtgggttaatgcattaatccttaagaataaactgaaagtgcgaactgcctatccgtcattgagacttattcatgctgtcagagggtaagtgactggaaaggaccagtttgtccttggcacagtggaacacatataactaaacattttcactagacaagaataagcttcagtaaaatctccaaatggatatatgtttccgttattttataatggttactctatttacaaacttgaagtttgtttatgtacgatatgattttaactcaccctcttttttgaaaaagcaaattgttgaacctggcacttatttatgtgtgttcatgaacaaactactaatttttatatttttgcactaaaaagtaataagaattcatagtaaaattaatgagctttgggtagggaaactacaacagaagtgctgaatggctagtgggcaatattgtgtaagcataaatgttagatatatttaaggagcaattaagtcccatctgtagccaagaggcctagtagtgagaaaggaggctggctgcgataaaatgccttaatgcttccccccaaagtcacagatgctgttttaatgaattaagccaacatttcccttttattaacacaagttcagaaaaaagcattaaaatataaactcttgcttaaaagtggcaaatgaccaaaaggccaaattcactcatgcacacatataagtatgtaaagtagataaaccacagatgagaaattatgtatttttactggaagtgtactgagtgtcagatactgtagcttcaaaaatgaagagctgatcactacctttaaaaaatgcataggctttatggtacagacagaggcatatacaattcactagtggcctaataggggaatatgttgtcagaggtgtataatttgtccctcaggttcacaaagacacttggaaagtggaccaaacatttgaactggactttaaaaacagaatagcaattgccagagggataaaataaagagaataagaaaaccaaacagaaggaaatgctgttgcattattagagggtaccaggtcaagcaaatgatgaagtgcacagtaaacgtatggaataatggagtctgttgtggaacatgggaatacaaagttggaaaagtaacttgggatgtggttgagaagggaattgagtttatgctctatgaagcacagttagatgtctgaatttaagaagaaatcttgtaactgcagacatttatttgacagggacaagaaaaatgccagaggcacaaaaaccaattaggcttttgattaatttactcataagataataaggatgtaagacagaagcagtggacttggaaaggaagggcaagttcagggggccaattaaatacaatggatacaagtcctgaaaaaaacaggtttccaagcccagacttaaaaatagtttcttatactgtaataggaactgggctaaggtatttttgttttgttcctgagataatttcctgcaaggatttaccatttcctgtttaaatctctagatagtttcttgtattgtattattttgcacacaattaaattacattctttttttgttttttgtgttttgttttgttttgttttgttttttgagacagagtctcactctgttgcccaggccggagtgcagtggtgcgatctcggctcactacaagctctgcctcctgggttcacgccgttctcctgcctcagcctcccaagtagctgggactacaggtgcccgccaccacacctggctaattttttgtatttttagtagagatggggtttcaccgtcttagccaggatggtctcgatctcctgacttcgtgatccacccacctcggcctcccaaagtgctggaattacatgcatgagccaccgtgcctggcctaaattgcattcttataattagatcatgtttactcaacacacattctcttggtggttgacaggaagtttcaacaaaataagataaaaatactgcatttggagagtaagtcaccgccttttttttttaagttacaaatatccctggtaattacaatttgactcttaaaaaaatgtgcatcttaagaaactgtaacattacagtgcattgtgttaagaacatgtctgtttttgtttgggtatcatgttactctgaaaaacaccttaaaaagataatgtttccatcttaaacacacacacacacacaaacacattccagtgatagcagattaagttttagaaagaaataatctgaagtaagtcctccctgactatggaaaactaatgagaaaacttaagattactctgaattagtacctttgtttcctagattttggtttatatttctcaatccaataccaaaaccaaagcatgaaataagaggagtgactgcagtagtgcattttcagtaagttagaatccagatagtgttatatatgattaacagtgaatacacatgggtttttacagatattttaaacataaactttgcagattcttttagtaatttaacaagactcctatcttttgtcctattcacttttataaccattataaatataaactacttcactaattcctaaccattttattccaaagagcaacaaggccaaacttctgaccactggtgaaaggaatggtatgctttttttggttactatgaattaggcatattttctaaactgattttgaattctgtagaaataacttctctctccaccttcctgttcacaaatctacatataccctcttaaagtgtcaaggtattgagttctaaactgtggccaagaataatgaaagtagctctagagaggcttgtgacttttcaaatagaatggaaatttgtacacatggtgtacgtgtgaaaggcaacttcatttatggattttattgaaactaatacattgatgtatgtaagatagcgttttgacctaatgtgtgtacttgctgctggaactgtaaatgaaaataaggaagtgtgagcgctgatgaaacaaaaatgatttatgtgatatgaaagcaaaggcaaactccccaaagaactattctttaagtaactgttttacatctcctttgacttacctctctgaaaccctgtggttaatacagttcagcaaaataagaagtttcatatcctctgttgattactggagttggttgcctctcatgagcaattaaagcacccaagacacagaatttagggtgtgtataatcataatgttaaaatgtgaaggctcttccaagtactgcaattaaaataaaaagtttaagtgatttgtaaaacaagattcctgaacacagtgaggatcatttagatagttttcatatggtcagacatcattacttaaacattttgccctccaaaaactgtgattccttactaactttaaaaacctatttaattttagatttttctaaaagctctaaagatgaaaccatcagtcacaaaattcagatactcttaggtattgttgtaatatattgtcattcttttgaaaccatattcagtaaaacagaaggaaaagatatataggtagattcataatttaaaaagaatcttgaaaaatagtaagagagtaatctaatggggacaaatcagatatataaattgcaagtttaagagaatgtatgaaagcataaaattggtgtgggattgccacttttttactggtatttcttcagaagccccacatgggctgcatttttcaaattaacattttgtatttttttttttaataaagaatggagcaattttgggcccagtgcagtggctcatgcctgtgatcccaacactttgggaggccaaggtgcgtggattacctgaggtcaggagtttgagacgagcctggccaacatggcgaaaccccgcctctactaaaaatacgaaaaagagccagatgtggtggcacacacctgtagtccccgctacttggcaggctgaggcaggagaatcacttgaacccagggagggagaggttgcagtgagccgagctcatgctactgcactccagcctggatgacacagtgatactccgtctcaaaaaaaaaaaaaaaaaaaaaaaaagaagagtggagcaaataagatagtaagcatgaagaggggatttggggacttcaaagtcatttaaaaatttggctacaaaatgtaaaataaaagcttcttatttatacagttctaagaaaattattaatatacaacttaatatcttaataacctgtttaaattaatgacagttttatataatattttaaattattatctaagacatagctcaaatacatttttataaaatacttagagttaggtaaaaattcttattttacagttactttaatttgactagtaataaccaagtgttgtttttactttggtgggatgattatacttaattttcttacttttaatatgggaaaaaaacaaacattacagaaagtgtatcctcagtttcaatatcaaactatgacgagaatttcttaagaatccttccaaaaaacctatagatagacagatagatagagaagcatattttaaaattatgttttatatgcacaaacctaaatatgtatttattgtagtagctctacaactcgaatcatatgtactcttttgcactttattttttaaattaacatgacattttctcaacaacacataaatacagcttgttttttttaataggaaagtatattccattatatacttttctataatgtatttaaccaatcttgtttgatggacatttgtagtacttctcatttgttcttgttgtatataattttattttgttattaaaaatattttaaattataggaaaaatgagaggtagggaaaggaaagtaaatatacaattctggttagctgattttataaactaatagtatattttaaaatataaaattaatgtaaagcttacaataggccgggcatggtggcttatgcctgtaatcccatcactttgggaggccgaggcgggtggatcacttgagatcaggagtttgagaccagcctggccaacatggggaaaccccgtctctaataaaaaatacaaaaattagccaggcatggtggcgcatgcctgtaatcccagctactagggaagctgaggcaggagaatcgcttaagcccagggggcagaggttgcaatgagttgagatcatgccactgcactccaccctgggcaacagcatgagattccatctcaaaaaaaaaaaaaaaaaaaaaagtatggttacaataataattctgaacaaataattatatataaactagtcttatattaccttttcaaatacaatatcctgaagtaacaacagttaatatttactcttattcatctatcctttttgtctgtttatacatatatatacacacacgttatatatatatatatacacatctacacaatatggattcatttagaatgtgtttttttcccacagaaaagggaattttaataaacacagaggtatggatgggtttaaacctactgaatactgtataatatgttcccttctgaaaatattatctgtattcagatattttaattttaaacattaagcttttgatctgttgatatttgagtctgggaaaaaatgttaaaatatttacgttttaattctttggcccctgctaattattatgaactattattaaaagatttaaacccaaaatgagatatttaactcaattatcgtataaatttttatggccccttagttttttttttaatttttacttttttaaattctactataacaaaagtaatatatatgtaccattttgtcactacattataagtagtaatttgttttaatataatggaggttatgctctcattaaattaataagcttctactttgtattaatcaagataaacacttggaatgagtactcacagatgacattgataaatgtatataatattctgtgatgtcaccatcatagtaaataattctaaagttatttaccatttttaaacttacatctttctcaaaaaatttttaaagatatttcatatagatttttaaaattttgattccatgtgtagtaatatggtgcaaaagtagttgtgggttttgccattgaaagtaatggcaaaaactatgattccttttgcaccagcctaatagtttttgtttttgttatttatctttcagtggagaatacataagatacctgtatacttaaaaaaatatagtcttttgtagtgattgcaaaggacgaatatgtgtaagataaatgggctacataaactgccttagatttgcctggaattaagaatttttgtttttattagaaatacttggtaaacatctcatgccctacaacagtgtttttttgtttgttttttgtttatttttgttttttgggtttcttttttgagacagagtctcgctctgacgcacaggctggagtgcggtggtgcaatatcggctcactgcaacctccgccttctgagttcgagcgattgattcttctgcctcagcctccccagtagctgcgactacaggaatgaggcgccacgcccggctaattttttttttttctctatttttggaagggatggggtttcaccatgttggccaggctgctctcgaactgcaacctcaggtgatccatccgccttagcctcccaaagtgcggggattacaggcgtgagccaccgcgctcagccagcagtgtttcttaaattcaagctcacatatgtattttgcaggttctgcgaaaattttcttgattttaaagaggatttgaacaattctaactaagaacactgacgtagagaattttgaagaattacgcagaaatttgatttccaaggaagacgaaaacaaacctttcctattctgactttagacaagactgtttaaatccttgagtgtcagatttataaccattaaaatatacgtaccaatgtatataatcgtatagattcctttgggctctaagaatcactggttctgaactttgtccttacacatgggaatattcaaactgtcacaaaaaaactcttgtccttaattaaacatcctcaggaatgtattctctgtaacttcctaaacaggttcattaaatttttggtaattatgataataaagatagctttctaaagtatttcttctttaaagtcattttctcttgatatttattctttacatgtttcaacaccacagttaagttaacccaacatcatctaaatgtttacttgacagcagaagaaatatatataagaaatatatatatttgaaatatataagaaatatatatacacacatagacacacatagttacacattcatatatataagcatgtatatatacctaggtaaatattatataaaaagaatagacagacatgtttgttgctgaatttgccctttctttgatttctgcaattattaatttttttaaaaatgcgtaacttttttgataaatgtcaattgtggaaaacctatatctgaagtagtatttatttgttatatatatgaaaaataaaattagtatacatacatatttactgttatatatacacacacactgtacagactttatatagtctatactcgcgatatactttctttgtaaacacacacaaaacatatatattaatatattatatacaattctatgtattctcttgctgtttctctgtctctatatatactatacagagtatatatactctgtgtgtatatatgtgtatattctttgtatatatacacacactgcacatatatagatatactgtaaataatttacacatactaacaaagtataaaatatacaaatatgtattttatataattatataatatgtaatagtatactcatagtatatatgtttattattctatacaagttactttgttagacgttttgtatgtcaaacatagtgccaatatatattgattttcttgtaataaaggtacattactgaatcttattcaactgtggtcacttaggattttcagaaatcagtttttccatgcttaatgtatagtaaatatccccccttttatatttctgttgttggtgtttgacatgccatcttgaatttatttgtagtaatttcatcttttgttttcaagtagatattgttttacattattactttaagtgactaaataacttttgaaaaatttcctcattcagaatataagataatagtctaattgatttacatactttatatgcagtatcttttttgcttcattatttttattaaataaaattacagtgaacaagaggatatcacttaatgtacccgcccaggattcccagagttttgctagaacattgatattttattttggcatacctttctaaactacctgtgcccgtactttacaccacaatgatcaataccataattcctagctaaatgtaagagggaaaaattacgtcttacggatatcaagtgacatatctagctaacttctcatctgggtagtattcactctgttgaaaaatatttaatggttattaaaagaatgaaagcacacattagttgctttggtagaatattttttatggtttctaacaaataaacagattatattttcacacatcatccatcaactttttttcagcattaagactaacaaaaatatcatttctcaaatgttagttgctgcactcatctttcagatgtaaaaattcattttaaatgaaagtaaaggttaaagtctatataaaatgaagatgaccttctgcaggataacttcatgtgaatgtcatgggtttgcagaaggatttgaatcagaccaggctcccaatagtctttagcaaaactataggctaaaatacatcatcaatagacctcaggaaatcaagtttattagtcactctaatggattgttttggagtattcaatcaactcaagtcacataaggaaaagcaattttaaaaaaacaactttgaaaagagaatattcactccaagtgctttctgaaaatggcttacttgttttaaaattagtcttatgctaaaaatatttccatatggtttctattttgacctatgagcaacacagctgtaatatttctttataaaacatgtgtcctagtttaatgtttttgagtagctagatgctgcgtattaggtattttaaaccaaaggagatttccatgaaaggatatttctttccttactggcagactctgatatgcacacttccggaacttcagtgtttcctgatattttaatctggttacccttcagtcacaatgttatttcctagcagatcccgttattcatattgcattgtgtaatgtggaagtataaatagtttatgtctgagaagatattcccaagtgtgtggctcaaactggaacctatggaaaacagctttcattctgcccctgaccaatatgcttcccagttctggttatctctcactgagactaaaaggctttgcgaaatatctagaatttctttggaagagtagttaagctttcatagcacccctgtaacattggcaaatttgggctttccttcttggtatggatttttctctcttcttcacatagatcattttttattccttcaagtctcaatttaaaggttaagtttcaattgggcatcatttctcactctttttccttttggtgagattgacctgggtttctgctctctgtattctcttctcaagggatgtatttcccttttggaacattcttcataatgtatgactattgtttattttcaactctgtaggtttattttaaattttttcatagcaaagattgacttattcatctctataactaataagaagcataaattcccagtatatgttacggtggaggttgaggcacatgtgcaaaggggtggggaataaaaatgggcaaagttgtgctgaagttagacattgcaatttggttcagttagttctctagagcaattcaaacaagcagggaaccaagcagaattgaggaagaggtttttttcatcgatctgggtagcactagaaattattttcactaggcagtattgtgaagaagagggaaactttcaagaaggaaggcttgaattctaaatagtgaggatgtaatctggatagtttgttttcctgcaatttattattaatcaaactatgtatcaacttgtgccctgaatctactaaattatgaaattaatgcttactaaattttacctgcctgtggtgttgctagggtaaaaataaaagagcaagttctgataagaaaagtagatgaatcataataatgaggcatgacgcatgggagcatccagtttgaccatctataaattcatcctggccacctgagaaaagtaccctagatctataatttagtaacagttttctcttgggtgttatctttcaaaatctgcataaagaaatcaatccattattttttaatattaatttatcatggtgttcaatagaggaaaaatcgttactaaaaatattttagctggggaaataaattaattgtcattattttataaattctaagactaaaatttcataatcagaacaaagcgctatactgctatattaacgaactacagggaaagctcaataatttgttctattaccttttactttcaaggctcaatcttttaatgagtgatagaaggtgcacaggtaacctcggaaattcccttgtttatttgacttttcaggagaaaagaacattgatcaatatgcaaaatatatactgagttaatttgcattaagttattctaatttaagtcaagatgactggtcgattacgcattcagagatttcttatatatagtaaaataattaatatattttaactaattattaaatattaaatagttgggagtttaaagttaaatgcaaatataaatttttagacagtgaacatgactagctacttcctgagtttgtggagaaaagttatttaatcaatattcccataaatctttgaaaacattacaggtccttatcttcttcaaatgatacaagtgtactttagcttgagtgtaatagtttagattaggtcttttgtttctatgtgattgatcatggtcagttaactaactctagtgtctcatgtggttgatcatataatcacagcctcaggccacaacttccaaattatggctatcgccatttgtcaagccagctcaacatacaagaagtaagttagagaataaggcaaaagacttggggcttgaccactagaattgccatgtaggaaacaagatactgatacattctgccaactttttcagagactagtgtgccatatcagattcctattggtaagagatcaaagaaagagtcatttctgtttctttttctctttgctctaaaaccttaccccccaaatcatttaaaaacctggatgagtaaatacattgtagcagaataagtttaaagcctttagctataaacttatttttaaagtggctttaacaatctttttcagttatttgattacataaaggcaagtattggagccacattcaccagaggcaagctggaagttttgtttcttacagtttccagtttgagcctaacacctatgactgacttcttagaaataagccatttactttttcacattccatggataaaataaatcaaaaagaatattcagacctacaagagaagaatcacaaaatagagccctggtgaagaccagtatccagtgcaggaagtaaaatcaaaatgcagtgccctgattctgatacctctggcagcctcccctcatcaatgtgtgtcccaaatagccagggttattctatgttccccactattctgctggatgagatttcttgtttatgtgttagtaggtgcttgtactctcccttcaagatagtacatttatgattgagtatggttttctgaagatcatatttaaacataatacatggtggttgatatatgtgggaaatattgttcaatagtttcttttgagatcaatcaaatcacattatatacgatgcaaattcttacacaactgtttcatccagatgatcttatgctggggctgtcacctgtggagcataagtgaaagcaaaattataaagtatttgctcagttcttaaggaaggatacttgccatcatatcttaggaactctggccctctagtataacattgtgcctatttgttggcaaattagggagccatccagatggtaccatttttgtacattccgtgaagaatttctgtccctcttaagaccttgcttcaatataactggaaaggctttacgtctcaatgagcaccacctaaacttcaaatattggagagagataataaaatgcgtaaataccaagtaaggtgtaaataactgatagctaattcattcttaggggcaaataagttgttgagattaaaagaagggatttataagggccctatgaacatgttttgggaatttgcagagcaagaagtggaaaatatgttggagcaacagtatggctgacttccattcctcatgataacgcatacattgcatcttcattcagatggatcatggttaggcatcatagttaagctcagtaacaaaaaattgtaagtgacaaatcattgctctgtattgtgtaaatgcctgctgctttttttatttttacatgagttttcaacaccagacttcatttcttcagcaatgatattgtttagctatatcctctggttaagttttcctggtgagaatacaagtcgaatgctagcatcttaagaactcagttacaaacactcagttcttacctgcttccacttttatcctccaaaccatcttccagtgaccatgttgatagctgaatggaatatgttgcagagggagattgtgctggcagttgctaccttatttctaactaagaataaactgattttgtttcagacaatataaacttttattgtcaacatcaaattgttttcataatgaaagtatggtctatattgcttttcccattctctaattagtcatttaaagtacactcctaaagaaaatattgccttttgatgtcactctagagatagtaaaatcagtggaaaactgtctttctttaaaaaataaacaaaatgataaagtgatgatataataaagtaattaggaattcttaggtaaatagcttatatggatttcccttaataaattattggcctttataataggagcttccttggcctttatacaaatttcagcaaactttaccagtgttcattaagctatagcatcaagcaactgagttcaactttaaagcttccttgttttggatactcaacaatatttgcatcagttacaaacttggatgaaattaaatagctaaaagaatcatgtgactgaatgtatcataacataatctagcatggcacagattctactttacactattaatatatttgataatttgatctaatagaaactaacttttttttcttttcactggtgaatcttaattaaagtaaaatcattacttgcagctaaagttctgattctgcattttattcaaattatgatcatattcctctcaatagaattcagtgagctttttgcaaaaaccattttataggcacatataaaatctacaatatggcaagctaaccttataccaaaatatatgtttctcaatactgcttgaaagaattgtacagtcattataaatgttaatagcccctatctgagaataataaaaactggggatagtgttgaggtgggatgtgggcagtttatcaaaattttcagctttgtttttgcttcttaatagtcaacttttgtttttgtttttgttttaaaaaaaggaacttgatactttgtggaatccatctgtgctataatcaaataatccatcagcaagtctccattaataaacgtcgctaccaggaagaatcaatgttgctaaaattttgttctttgctcagctcacaattatttcctctttctgttttctctggaacagatgcatacaccagaattgctgtcagtttcaaaattaataagctaattattttatgagaaataacacagaatatataaatacaaatattttagtaatgtacaaattgcaaattcctatcagactgaataaaagtgaaatacagatatttttcattaaaaaattctattgaagtagtaaaatatttgaaatcacataattccacattttgaaatatgaatagaagtgttcctgctgtatcacgttcattccttctataaacatgtatagattgctatactgcgctaggtctgaagctccaaagaagaaaacaaagcaggggcttcctcaagcaacaaaaccagcttggtagccaacaagattacatagggaagtgacaaggtagttttggaatgctagatcaagggatttggcaaatgcatgtaatacctctggtggatgggacatgtaatttgtcaccgattagagattcacagaagagattccaaacagtattaaagatcagctaaaagtataggctaagaatttacagtaatgcctatccacaaattgtgtcagaactatgttaccagtggagggtgtctaggtttttggtgtcttgaacaaataattggacaaaacacacaaacaaagcaaggaaggaatgaagcaacaaaagcagtgaattattgaaaatgaaagtgcactccacaggatgggagggggcccaagcataggagctcaataactgcgctacagaattttctagtgtttaaataccctctagaggtttccattggttacttggtgtatgccctatgtaaatggagaggatatttcttgtcatagctgaagtgtttccatttgatttagttctaagaagtcagagtgaattggccttatgttccctgcctccagaccctatcctcctgcctcagcaatatactgcataattgacctctttttaaagaaataagcataatgactccaatacctatggcttgaataaaaatttgtgttgatcccaatttacaaaagtcccagtttacaaaaagcatcaggttcccaaccataattttacatactcaactttattctagaagggcatggaaggcaataagagtaaacagctatgcaactatggaaatcagtaacctgtgtagaaattaccaacatgacaacaaaaatacgttccaaatagatttatgaacctctcttctttctttatcatgatgtacagtaggttttgcatttcccttattttggctttctcatttaacttggtgtgcacaggaaataagtttttgaatgtcttactgtgacactgagtgtgataatgaggaggcatactgtgattgcaaatggattaggtgggggccagggaaaggggtacttactagagaataaaacacacagaaacaatcttttttgaaaaaacaaactatcttcatttgtttttattgtttggaatatatgtaataagaaaactttggggacttttttttttcttatattcttaagtaacctagagacaagaatgttataagaaagaatgtaggctgactggaaaagagaccctaaggaagacagaaagctccaaaaatgttatgggctagtcaggagataatataggcattcatcttcctctacagtaacttgtgtgttaagaaatgactttgccttattcaagcactgtgagtcatgatgaaatgaaccgcttgggggaattttgcaactcgctcaatgttctgacccttttcatatttaggtatgattggggattttctaaccaagctgatgatgatattagggaacattttcatagcttgttctttagtccattagagcaacacattgaaaactagtttcatggtatccttgaaaattccccaacttgtaccctaaaaaaaaactctaaaattgccatgtgcatatgtatgtatatacacacacatatatataaatagacacacatacacacacataaatatttcatcaaacaactgtatgtattctctgctttggatttctttaaaatagcactacaatcttgttaaaataagtagaaaatactctaaaatgttaaaataaaagggtgaaaggaaatttataagaacttggagaaatctaaacacatttgaaaattctcatttcaggtattagacaatgttgctgtgtctcactgataagaccaaataagatatgacatgatataaaagtttgggatcaggaacagtttaaaaaagactccgtatgaattgaaaatattaaaagtatatatttttatttaaatatatgtatatattatatgtagctaatgcttacatatggaaaatattttcatgattttttgacataatccagttaaatttcttattttataaaggaaactgttgcagcccagagtctcatctgctcaaaaatagacactcagttagtggcacagttagagttgctgattccaggagcagctctctttagaccaatctcactatagaacagtgtatctttataatagcatggcaatatttgtgccattttatcatttctttttgatgtatgatttttcaatataataaaacctattgatttagagacccttgtatgtattgccaaaataatattcagaaagtgagtgctttctatttatataagttatcacagatcttgagctgtttctgtcttgtgtttcctggccagagataaagagaagattatttttcatagacaagaagaggaaacaactaaattaattgcctttgtagctagggatttatagttcaaactttggacccaagtttttaaataattctaaaataggatttcaatggttattttttcaatttaacaaagagaacataaattctatagctgagttctgaagcatttcattaaatttaagttcatttatctgctcaggctttcagctgacatctgcagagcaaaatcaagatcttttctggcaaattgattgatggtgtgccatattatttataaggctcaaactatgtacatttgaaatattttcatttaaatgaaatttgaaacaagatatgaaaccttgcaatatgtatttacccagaaaacaagtgaaattcatatcataattaaatataatttttttgcatattctaagttggcaaaaggttatagaaaaatttttaaatgggtgggtgtggtggctcatgcctgtaattccaactttttgggaggccaaggtaggaggattgcttgaggccaggagtttgaaatcaggctttcaacatagcaagccctcatctctacaaaaaagaaaaaaaaattaatgttctcttttaagtgcaagttttgtcactatggtttaaatcattttgctaggaagtttataatgtggatgtcatagtgttggaaactgaatgccaccattttatgatttgctgaaattacccagtagcaattttattttctattgtacatatttgctagtctattcaaagcaaatattcatgaagctatagcaaaagaaactgccagagaatagcttctaagcatctacagtgttgatgacttacagtgagtctctggaattcacagaaacattttcattataaattcagattaaattaattacattcttatagataaataaatacttgtaatatagtgacttttaatttgatatttaatttaacaggtttttttttctctagtgctccaaatttaatcagttactaatgttttgactggaatgaaaaaaatacataatttacatattacttctggccaagatgtattttggttatgttatttgatgtgtattcgttagcagtctaagtaatgtaacattggtcttcattaaaatctctgatttctttcatttatcttatagaaacaccatactgtaatttctgttccttcttctggttgtagaagagaggtagcagactcatgactcacagtttgacttggcctactgacctgcttaataacacagatatttaaaaatgaaattaactgtcaacatctaagtatcatgagatttttcaacagacatttcaatatctggtgattcttttaaagatcagaatatctggcagtcctagatctctatttcttcatgattatggtgaggcagacctaaatcgtgctgtcttctatactctaggcactgacatcctgtccttcacagtcccatgtaccgctttgtctcatacatcctgataacaagcctgattcattcatcctactttctggttttatccagctctctaaccatttgttttactattctgccttatgagagtagaatgaagtataaacatatatggtaattgattcagacactctcagaaatggagaatactgcatagtttccaatgaatatctcatttaaaaataatgacattaagacattcttgggcagattaagtgacttactaagacaacatatacaatagctaggtatcaaatatacatctttcggcatgagtttaagaaaccaaatttgaaacagttgcaaaaaagtaggccacatttcaccagtagagattcctttcaggcagtgtgtgctagtaaatgtttcacaactaactctctgggaaaacaaagtggatttatagcatttgctgattttcataatgtaaatactcccaccatgcccaatttcaaactaatgaggagatgacaagcagctcacaaaattccaaaaaaagaaaaaattcactgtggctctgtggatcagtaagggccagctctagcacaccagaataaacatatggttcaaggagattcttgtgtaaattgggtgaagaaaactgcagctattaacattcaggcttaataaatgaaatcatttctatcacactggcacctcaatcagaaatgtctatctcatgtattagaatattttctttaaattttagctgtcatcatagtttagattggccagtgcaattgcactggcaacagtgatatctgtaaacacaaagtcaatagcttttacagacttcatcacttctggtttattacaccaatcaaatatcaacatgtgtaatggatactttatataataatccctaaagtggagtctctaaatattttggacaaagaaaaagtatttaaattcttcatcctcctattgagtttggactggctaaatgcttttgaaactagttcaacactggctccctaaagcacttgtgacacttactgatgactcaggttttgcaagtggaaagtagagctaatgatcagaatggtatcttatttccctcaggtattacggtgtgtgtgtgtgtgtgtgtgtgtgtgtgtgtgttttagcactaatgagaaaattccctagacttcctttagagttcctatgtgtaaagtcaatagcgataagtgacgtgggagtattttaacctggaaattggaaaggaagtctccaaagtattacattttaacgtcagtacggaacagtagcaattttctctgatggattttatttttttccaagtttcagtcagtgttttctaccaaatctaagtaaaaaattgaatctggagataatgcttttagaatttaaaaattatgaataattcaagttgattgtttaaatttcgttttctttaaaaaaaattatttgtccacctgggagttatgaaatgatatctttaatttgccaagttggagaagtcaacgtgagatttaacatttgctgtagaaaagtgaaagttatttatttctaggttatacttagtaaggagtaccatatatttagttgagaaagcatgtgaaccttcctttctacattcaatcttaggtttcttttctatgtatttttatccattagtagtctaccgtacctaatgacaaatctcagaacaatgcaaaaaaaaatgaatgcagcattcaaccatggccaaattaatagtaatactagagatccagctcaacgtggtctttaggggcacagattctggagccagattactttgtaattcccagttccacattttactagctccatgactttgtgccagttagttattatcatcccttatctgtaaaataagattattaagagtgtctactcatagggctctgagaaatcatttgagttatatgcaaagcgtttagaacagtgcctggcacattataagtgctaaataaggcttatctctaattaatacatcactgaaaaatagattcagtaaattttcctttgggtaattaagcaaagctcatttctctctcaaggtatttctctctttccagacaactcttccctttctgcaggtttatttaaattaatcacagttgttctaataaagtgtcttgaaatacataaatgaattttggttagaaaaacaaataggagacctagagatcacatcttattatgccttaccttgatttcagaaagtaatctactaaaaatatctgagtttatcttcctttttacttctatatctctctcaatttagattgaagtcaactgatggttatctttctattctggtgaatattaataatgaatgaatatgtccaatgtatcccccaaagtggggataggtccattccaaacttggcagttgaaatagctgtacattaattgttggtgaatatctatggacttcactatgttacttccgaaacaataattggcaaccacagcatctataatgacgtttttatattttaaacttcatcttaagcttttcacaggagtgacaagtacaatctcagatgaaaaatttggtatgaatgaatacgaattagtggagaaccttattttaaccaccagtaatagcaatactgtaagaagttaactttccaatatttatctttaatagcattacacattttcaaatttcaagtagccacatttactttggttgaaaaaaaagatttttaaaaatttagtagtttttcccatgcattttcctactcatttacctactttcatgtgagtataacttaatttgtttatgatggaaaaaatgacaacctctttcaaaataagtagagaatcattcctggctgtcaaaatatctcacaattccatggaaaattgattaactctccatatgataattcaagggagaagtgtcactgtatagctaatcatgtgccatttactaatagatctgaacttacgggtagctttagcatttgtgattgaaaattttgtgtacaaacagaaaaagaacaaattaatatattttctggaatataaaaatgctacatctataataacaagaatgtaaattggaagacatctcagccctagttccttgtttgtttttcatttcacccatgttttacattttgaaaaaaacaataatccaagaaggccggatgtgttaggccatttttatgttgctataaagagataactgaggctgggtaatttataaataaaagggatttaattggttcatggttctgcaggctgtataagaatcatggcaccagcatctgcttggcttctggggaggcgtcagcaagcttacaatcatgacaaaaggcaaagtgggacaggctctcacatggtgagagcagggtcaagagaaagagctgggagatggtacacacttttaaacaatcatatcctgtgagaacccactcactatcgcaaggacagcaccaagccataagggatccacccacatgatccaatcacctctcacaaggccccacatccaatgttgaggctgacatctcaacatggtatttcccagggacatagatccagattatatcactgaatcaatttgatcagtagtgacaacttaagaaagagaaaaagtaataaacaataagagaaacaatattaaagctttagaaactcaaaactgtcaacataaaataaataccataataatacctttttagcaattacattttaatgtccccattcgataccaaattataggcattttcatagataaaaatatttctttttaatgtcagttaaatagttatgagataactgtgcttaatatttaaagttttactaaatgctaatttctaatttctaagcattctgctctctatgccctacaactaacaattgctccttttgtcactagagcgttctatgttttattattcttttattcttctacctgtctaattctattaaaaatggacctcagtagtacatatccatatacattatatgtgtgtgtatatataaatgcatgtatatttagatggaattttatagaaataatgtcttttgattattatattagcactcatttgattaagatgatatcctaatctcttcaatatcctttaattctttcattcacttattcaacaaatatttattgaacatattctaggtgccaggcattttgctatatctgggatgcacatttgaattagatacagttcttacctcacttggataattatattgttattaggaaattatagtaccgtacgataagtgcaagatgagtgaggagtggatgctcttggagaatcccttctagcaaaactgagttaggggactgattaaaagaaaaaggcctgctgatgaaattgacattctagttaatgccaagaacagggaaatacgtttcaggcagagaaaattacatgtgtaaaaccagaggcctttttgttgtataatattagttaacacccatgtaacactatatgccaatcattattacaagtgattttcacactatgtaaacaacccttttgacataggtttgttattactcctatttttctcttgagaaaactgaggaatgaattagttaagtaactttcccaagttaacataaccagtaaaattcaaggctgggatccaagtagcttggttccatcatctgtaagtttcctacttcctctcaattccatactgccttttacaataaaaatgcacagaagatttaatttattatgctaggtattcattttgcagcccaatcaattgagtaaaataatttgagaaaccaacttacaaacgtttaaataatacaaaaaccctgtgtgtcatcaatcatgaatttcaactcagcaagaaggctaggaatttacttcactttaacaaagatttattgtcttcctctacatgcaagactctgtgctaggtaccagggatgtaaagatcagttagtttaatctcttccctgaaagagttcacaatttttcctgcaaaataatatgttaaccaataagaatttataaaacttatgccaaatacaaccaagcagacacctacgtgtgatataagggtacagagtttgcctgactcacctttgaatgcatagcacgatgtatattacctgactaaagatagaatgaatgaatcaacacagcaacatgctataaagggaagaattactttcctcagggtaaatcatgagatacttcattaaaaggaggcatttagggcctgtaagagtggattggattttcttaacggaaggtggtagagtagtaaggtagatgaaacttgacacatagagggaaagaggagcaaaagcaatagagtagaaaagttagaactgaataagaacaatgagagaatgtcctgaagagttgggttggtgtaagtttctagatggcctcgaatgatgtaacaggagcctataagaacattttagaggttaatttgttaccctttgtgcaaattaatggtgatctaaggcagactaatgaaaaaaagaagagaaggaaagagatatatgtggaagttagttagggatgtattaagattatgtttttagaatgctgcaatacattttagtgcagtaacctacattaactgaaaaagagagagtcatactttgaaaataagaacaatctccttcatttcatttatgggcatagcaaatttctcttcttatcattgcagtttctgtggtccaaagcatgtttgaaaatgaaacatctgtgatactgaaatatcttcaataacaaaacatctgcgatacgaaaatgtcttcatttttttttagaaattgagaaggcttcccttaggcatatgtcccagatatacagtatcacatcttagttataattgaaaacactgtggtgccccaatagagcctccaaaagaaaaactaacccatatggatttaactaaaataaatataaataattaattaaataaaacctaaagtgtgaactgatttgtatcaaagcttctgctttaagtgtcaatgagcagaacacacttaatccatccaaatatggagtgtttgttattgatatttagtatctatgtagagaaagattaaaatagcatttaaactaaactagattctctttagaattcataggtaagttccttccttctaaatatttcctagaaccaatattttaaataaagttatggttctagattctgggagtatactcaagtatttttgacttgcatacaatatgtagattcccatcatttctcaattcctgtgtcacctttccagcccctctccccataacacaaaccaattgtagaaaagttagttcgagttagataaagaaaatttttaaaaaatatatattttttgagccccctgaccctcagagataatcagacccaactcatataggagcattttagctctatgcattgggcctgatggacaataatttcagtggagcagagatagtggagaatgaaagaaaaatgaatttcatgaaacacaatggagatgagaaaatatgctgaagaagagttgtgtctctgcatgaaggaaaaacaatggtagtaataataattccatttattgaacatttattttatcattgaatcatcataagtaggttttataagtctttttttaagatgaaaagaattgtgcctcaaaaagaattaaaaaaaatctggttaagaatccaggtgggaagttttagaattgataaatgttttatgtctcaaggtataattttagtattttttatagttacattttggagattgtcttgatgtggcacctgcaaggcattttatacagtccttttgtggttcagtaaacagctacctgggccttagttatgggatagagactgtcagtcaccccagggtaaggactatgtcttttctcatctgggcctgttcaccagccaagtacctggagaacagtagttccttcaaaattaagtggtcaatggagaacagaagcaataatgagaaaagaaataattcaaaaagttaatttaggtagacaaatataattatataatgtaactaattacctctggcaagctagctatttcaatttcaattaatactattgaagagagttgtcactggacatttattataagtcctatatgtatgtgtaataggttttattttgagaagctataggtctaattttaagaatgcattggttatactgtgctttaccaattctaagtaaacataataaaacataatatttatatttgaagtcatatgcaagtatagttacataaatagatatgattactgaatctcctgtagaaattatttgcttgtatcctttaaaaattaattttagttgtacttacacacatatatttcttgcatatttgtacatttatgcacacacatagacaaatataatgcaaccatttgaaataatatctttgtctaagttatacaataatcagttgccataccattcttgatggtgtgtccttgactgcttgcctgaactcatgaagttattacaatatattaccatccagaaatattataacacataaaataagtctgttgacggtttatagaggtaacttgaattcggaagaataaaatatttgatgtatacggatatctgctgcatatgacagtttctaacttagaaatggattaggctttaaaaatttgaaatccagataggaaactactggctgttttattcaacgataaatactacagtactaattatgtgctaggcattacttaaagcactttacaaattttactttatttggtctccataacaactctataaggtaaataatattcccattttattgacgatgaaataaagcacaatgaaatcaaatatcttataccagctcacatagtaagtggtaacactaggctttgaaactcatcggtctggctccagagtctacacccataattattgcacagaatgtcttgtaaactctattccctttcacttacttgccccttgtaacaggtcttcaacagttttgcaagcgattgctaaagtcttagagcgagccacataagtattttatcttcagtgtggcacatttatgaccaaagattgcaaaaataacatgagtatactcttaaaaatgaaacataaataataaataaagacttatctctttatgttgtttaattatgctttggaaagatcatttttccttacagaagaatatgttgctagatagaaatgttgtagtaattcttttttttttttttttgagacggagtctcgctctgtcgcccaggttggagtgcagtggcgcgatctcggctcactgcaagctccgcctcccgggttcacgccattctcctgcctcagcctcccgagtagctgggactgcaggcgcccaccaccacgtccggctaatttttgtatttttagtagagacggggtttcaccgtgttagccaggatggtctcgatctcctgacctcgtgatccacccgcttcggcctcccaaagtgctgggattacaggtgtgagccatcgcgcccggccgacatgtagtaattctaaaggatctgaatgtgttcgagaattttagaggttatacacaacaagtactttattatgtctactgtaacttatgactttcctttcccctattatagatatatcactgtcaatatcctattgtttcaatctttattactctaaaatagaattcaggcaaaggaaaaaagttcaagtaaatgaaaagatttatcaaagcgtttaggtaatagttgggaggagtgaagggaaaaaatagatcaaataatatataggtgcttgtatttgaaaaaggtttgagtttaaatttctaatccatgagagaccaaaagacaaagaatctttagtgatcaaaccgatagataactatttggaggggagagagagacagtgctggggaagactgcatagctcacaccgctttgtaggggctcactgggtactgttcgctgggattctcttggcaattagcccaagagagcagagcatggcagtgaggtgagagcaagcgtgaatacacactgatgctcctatgcgcagaatattcgcagtttataggtaaagatatgtgacttgcgaatattcctacacctacaaatgactattcccacactgtttttataggtcactgggctgtgttttgagctcaaatattgcctgcatcagaattcgtcgttatttcatagtgagtcatttgacaagtctttgttcttttcctggctgcaataattaagctaatgaaaattcttctcagtctcagacctgctgagaaaatttcccaggaatatgggcctttgaaaaaaaacggaactcttcccttgcttacttaaaaatagtattaaaaaatagtagtttacctcttttgacttgaaccaatgcttgttcaagactaaggatcttccacatcccacacagtcttctgatcctcttctagaattctaagccctttctacctaaattttctagaggcaaagtgcaggtttaggcaagggaaatagccctagagatgtctatggggtcccatgagtgaggaaatccagggcaaaatcaacttttggcctgagaggagccttttagcaaagacgtgattagaaatcttaaatccaacctatgtttccgtctaacagaaaagcttttgatccataatgagccactttgagggattttcaaagaggtattgctttttgaggtctcagagaaggaaaagtggagcttggagcctgcaaaaagcacactgaccctaaggagtaccggaaagttgctttctcagggagctatgagtgaatgttttggaaagctgcttgcctggcacaaaagaggaactctgaaaggctgacaaaaatgttccttatttcagcacgtatcaatttattactcatcagctcattagggttttacacggtagttggtttatgcaggccccagtgtgtaatgaacccgagaagtgaaaactcccccagaaccccaggctctcccaggacaggtaatttactttccagtgaatggtagtggactcatgtttttgtagttgcaatcgcaggtttgctctgattagtgagatgtcccagaactgtaaattagagtgttttatttttgcttcagtatatacattctgtatatgcatagctaagtggatatagaaatagatttcagtttgaaatttgaattacttaaccagtgtttatcaacagtgtacagtactgatgttgcacatggcatcagggcaaagtgctacaataaaacataggaaatctgtgatcttaaaatgcactttgccctgttcttgtagagccgtagattgttgctgtgaatgtcagtgctatttagggaggaactagagtgacaaagatacatcctggatttcttagagttgcctatgaccacacgtgcagtttgtctctgaagccagggagtgcctgattaaatacaggacccacccactgtgagaaaacactctggcatcccagctgccattcagaatgtaaaatccaggatatgacctgtcaagatgagcacttcagcatattgtggcaatgcagctgtcactgagatacataagtctccagagaaaagcattcaaactgtttccatggtggaatgaatacaaatgcacagcagctctagtcatatttgaatgtgagttttttcagcaggatggtccatattaaatatgcagatgtgtgcaagtgaccccagtacctcttctcatctctgattgctgagcattttctgaaggcataattttcttagttttcatgtgagaggggcagggaacatttgtaagccatacagagttaagatatccagttgtcctttttccttaatgaagacaaaattgttatagattatccatgacacatctgaaaaagagatgttttcacaacgtagatttaagttattttatatttatttcttgatattgaacttattctcttcaacactctgacaaatgtatagtgctagcaacatatttataatagaacttcaaaacttctgacttgtaccattagtgtcaggagaagcccagtgaatataattagtgattttataagtgtttttctaataaggaattaacgtgtatcaccctacaagtgtgcccaaataagtggtaacaaaaacttggggaggaaatttccttcctatgggatgtgtgtgtgtgtgtgtgtgtgtgtgtatacacacacacatatatctgaatagaaaactgaatatatatatttacatatgtgttatatacatttacagataggattcgatgtattaatgtattatatataattgtttatgtaaatataatatacaacatataactatacatgttatataactattctgaataggacactcatatagatatttactttattaattagaatgaaatgatatattacctaatgataccctgtaacaatttgtttcacttgtttttctcagaaactcttgattttaataattcattaacttaacaagtatattcaggcttgttatgtgaaaatgttaagtatataagtgtttccagttttttcacgtataaatttagaacttgcatatccccaaatacctgaaagccataactgaactacaggataaccttcagaccttcacacttgtcacttcttcattgcactgtgatttttgttttcgtatttttttttggccccaagtacctatcatattccccagatggcttagccatcatcactggcagattatgaataatgttttacattgaacagatgtaagcaatttgtaatttttcccctttctgaaccagctttgttttgatgaatcaactggaaattgaaacttaagtagaacttctgtttgaaaaggagcaatgttttcccacattggcatatgtagtcagctcttaaatatagagaagaaacaacgaataggggaactggccagggtgtgtggcaagaaatactggaagatcattatttagcattgccatatagttccaatttctttattctatagaaccacataataataaaaaaaaaattaagttgctccaaaccaaccaaaagttcatcaggttgcctgtgtttctatccagtaagaacattcttcaaaagaactagaattctggaaatacagtaagagctggtgaaatgttaaaagagaaagaaatgagctatccccttgacaaggatgtgtttgctctgctgaattgtattttatgtaattatataaattataattgtattttttgaccctaatataggcaagtcaaattaagcattactgacaatttggtgttaggataagctctctacaagctacaaattaggtgaataatctctctacaagctacaggttaggtaaataatgacaaaaatatctacctaagacagaccttaattatatggctagaaaaggtacatttatttatatatcgatagcctattcataaataatatatattttccttacaatagccagtggccagacctaaaacgccacttaatgtccagagttcagttatggtcctgcactttcagagcctgtttctgacctgataattcttgcagtggaaagagcaatcaaactgagtatccttcgctttctttaaagtctatgagaacaatctaattggcagttggtctggaataaatcttaattattgaacacttgcaaatttgaaaacttcatatgctacagacagaatttgataacaaaaatgtcaactatcctaggcagacactaatgcacttcttatttctgtgctcattacttaatttcaacatcactgatataggaagtttaatgttaatatataaaatataattcagtagaatcatagaccatcctcaaagtttctttaacccttgcttccaaaaaataaataattaaataaataaataaatacacatgaaatctcatgtctatctttagcaatatttagaattgcaaaataaattaaataatatgatttgaacccaatcaaaacaactgtatttattatacttcttctacttatatcccactctaggaatctgtatgtttctctgacagtgaataatcattggttctaacaatctggtaaaatctcttatttttattacttttttagagatagtctcatactgtcacccaggctggagtgcagtggcatgataatagctcactgtaaccccaaactcctgggctcaagttatcctcccacctctgcctctccaataactaagactacaggtgtatgccactactgctggctatttttttttttttttgtcaagacagggtcttgctatgttgcccaggctggtctcacacctttggcctccaggaccctcccacctcaacctcccaaagtgatgggattgcaggcatgagccactgtgcctgacctaaggatcttattaactaaatcttttgtgtaggcagccattggaggaactcattaggtgtattttcttatttgattaaggaactgaatgggatggcttaccttgcccccctccaccttttttttcagatgctataatttaaaattccttagagatatataacagagttccttagttcctgagtttgctttgatacacaattgttagaccaaaaataaaaagcctttttttttcatgaatgttcaaaatgtaggatcctctggatatcccttaaagagttcccataaattttatggattcatagccttcttccaaagaaagaattaagatagcaactgagctatttcagttgtcttttagttaagtaaccccattagagatacaatgtgaggtttcttaatattttaaacttaatatttccccaatattttaatgcagtttatactctagcactctatagtttctttttgaacctctatataccctagattcttctcttgccttctgcactctacaggtattacatgcattttagcagtttatacatgaaatttgagtcatcatacaaaacaatattacatgaatgtactaaaatagaaacagatggtcaataatactgtacatttcttcgtaaaccaactcccacagattgcctttcttcagattttttgcccaagtagaaccaatcatcaaacaagtgattagagaggctttattatggaaatattcctcttgaacaataacaacaacaaaaagccatttcaatcacatttccattttaaagaaagttatatttcaccctctttaagtttattgttataaagtctgagttaattatctctatcaacttatattcttattcaaactgtcagtaaaaaagtttgtgactctcattcttgaatttctattacaccagttcgatagaaagaaaacaaattgtatggaataaatgtttgtcttaggcagtgcctctaaatttaagtgaatttcatgattgctatattgagttgaattgtatagtccacattctagattgacaccacatgatcagttttcactgctttctaaaatgtatcaagtccaaaaaaagtaactattggagttttttgtttcttcatttgttttgttttaccggataattttaaattcctggttgtataattcaggcactagttcgttaaattataaacaaagataagagttaaatgaaactgaacttaaatttgttggttgagttgagtgttatatgagcaggtattactggaaaggagaccccatctagaccccaagagtgggttcttggatctcacgtaagaaagaattcacggcaagtccgtaaagggaaagaaagtttattaagaaagtaaaggaatataagaatggctacttcatagacagagcagccccaagggctgctggttgcccttttttatgtttatttcttgattatatgttaaacaaggggtggattattcataccttccctttttagaccatacagggtaacttcctgacatcaccatggcatttgtaaactgccatggcccttgtgggagtgtagcagtgagaatgaccagaggtcactctcatcaccgtcttggttttggtggggtttgtttgtttgtttgtttgtttgtttgtttgtttatgagacggagtctcactctgtctcccaggctggagtgcagtggcgccatctcagctcagtgcaacctctgcctcccgggttcacaccattctcccccctcagccccccgagtagctgggactacaggcgcccgccaccacgcccggctacttttttgtatttttagtagagacggggtttcaccgtgttagccaggatgatctcaatctcctgacctcgtgatccgcccgcctcggtctcccaaagtgctgggattacaggttttggtgagtttcgcctggtttctttattgcaaacggttttatcagcaaggtctttatgatctgtgtcttgtgttgactttctgtctcatcctgtgacttagaatgcctaatcgtctggaatgtagcccagcaggtctcagtcttattttacccagcgcctattcaagatggagttgctctgtttcaaatgcctctgacacatgtacataggtattgtgacctgattttgttaatgtgatttcttcgacataatatattaaatttcatttacatattgattcgtaatttacagtgaactattatttgtacgttatcattcaattcttttagcattcctaaagggaaaatgtttttacccaaatttagagatcaggaatctgaaacacagacattgcaaggactagccaaggcttagagcttacactctgagggctgactccattctaagtcctaggatttttcactgtaccgaagttgttcaataggaacattaacattattttagaaactttctctatattaatgttcttgattcggcaaccattttataaatgcagtttataaattaagtgattctgcctaaaatgtgttgaaggtatcaccgttgattcaaacaaaaagtaaagggaggaaaattagcgatggtttgaatagactgaaatttcaccaaatagagattgacatgtggagggaaaaaacaatccaggtatttattaatatttgactaatgaaaaatatttcatagcgtcttatagccctttaaagtttcagggctaaaagttgaaagtttttctctaattttgtggagcagaattaaaacagtggctttgtaatataattcaaaacccaaagcctgccaccttgtcattgtcttaacattatccttcatggaggttttcctcagctgggaagttccctttcttatatgctcatggaaagcccttgtctgagtgttcaatttatgccagggacaaggcaattgtctaaatgggcagttcctacagtatctgccctttatggcaggaataaaaatagagaataaagatttatatttgactaacccccaaatgctattagtttgatacttgctgggaatgcttttaggaaccacttagaatttgcttatggctatcttaattctattcatttgctgggatttgagaactctgatccttgactgatgtttagttagtgtactttgatagcaagaatatattacattattcaatggaatatagatcacatttgttgttccttacttttcttgaaattgattttagcacaactatctgggaggttaatgtaacctgatttattgatgtaaactgagcatatccatttgtaaagagtccagatcaagctaaaataagatcatcagaccattagaagagttgtttatattttattgtcatagtaaaattaacttttattgggaaactaacctcatataggctggggagtatgaaagtatattctctaagtgcctccttggactccttgttaatgtaaataaaaaatttgcatggataaacacctagatcattatcgtcttccctatctaacccatttttactgagcgttaggattacctacaccactaccaccccttgtattttaatgctttttttttctttgtaggactccatgtcctctgataaatgattgcactgtttcctttcaatcttagtaagaaaaatgtagtttccatggtttttgattttcaaaaagtaatctgatctcataagagcacttaaatgttaacctaatttaactccttcatcatgcttcagaagaccatccctttctatttttctagtatttcactttttgtatgtcaccacttcttcattctgcaagtttagattacgagtttcagttttttctcagaaggattaaacgtgaaggtcattaaaatagtaatggattaaaagaaaaggccattaacatctgtggtttgacatctgtttcatattttactctacctccaatttgccagctcaagattttaagcattctctttgacaactcccaaaagatattttactaaatgcagttataatccatctattatatgatgcttatttttaaaattcttcttcaccaaaatctagcccacatacgattatttaaatcactcatgtagtttgggagtcatctattttagttccattcaacaatctgacatggtaaataaagtctagagtattctctctggttatttttgtttaatttttctcagttttcagcaagattccattttcctgtgacttcattctcttacattagctttagctttgaaattgtaaggggtcattttatgactttcagattatcaagcattatcaaaacatcatgttttatataataaatatatacaattttatatgtcaattaaaatgaataagtaaatttgaaaaaatacattaattatgaatttgttaggagaaaagattatatgacccctagttacaagtgttacaggaaagtggaaattatattgtaagtttttcagtagggatgatcttaccaaatagctctataatgcgattgaagagaaatgctgcatgttatgtcagataaagtaggggtagttagtatctgccagcaagatgtaaagattagactactgctatagttggatgaactcccgtgttccttattgtgaattcatactgcttttgaccatatagaagtgaatgttttagacatagtgaaaccatattaagatcctcattttgttggtgggtaaactgggtcctaatatgtttaaatggtttgaccaagatcacatcattaacaaaggtaaatcaaggctgggcttcagtttttccaatactttcccactattgaatattgtaactcagggattagcaagtcatgagaatgctctgttttattaacactacaaatctctaaaataccagcaagaataaattaaataagcatgcattaagtacctactgtgtatccagcattgtgttgaatatgagttaaaaataaaaccatcatttatctcttctgtttctatttttattagataatgttaaacatttatattaatatgtaatgaagctatctttacaaagacagcttccttactccactttctctctttataaatggtttactccattttctctcttcacaaatggaataaacaactaatacctggaaatgtttctaagtaattttttaaattgattttcttgatcaaaactcatgaagctacaggccaggaggaatattttctctctcttctgcgtctgaagaatactggagcttgcttgtactggctggcaagatctcattgcaccatctcttcccaattcagtgttcactgatgtcaggttggtagcttgaaatcagccatgatggtaatatttacctttttttgagtgttcaatttatgccagggacaaggcaattgtctaaatgggtagttcctacagtatctgccctttatggcaggaataaaaatagagaataaagatttatatttgactaaccttcccaaatgctattagtatgatacttgctgggaatgcttttaggaaccacttagaatttccacagaaattgacaaatgctaatatatcattgaactgtctcccgacacccagtgtctgctttaaacattcaccaacgtaccaatgtacagcttgttggctgagtaaaactggataagctattttacttcttgagccacaactgcatcctctatgaagtagggatgataatatattctattgtgtatattataatattttatgaggatcatgtgaaagtggtttgaaactatatggagtaaaattattaatatcacaataatgagagttacgtattcactaaatatgagacagttggcaaaatcaacataatataggtagatctagaatttcttaacattgtatccatacttgatgtgacaatgtgcatagacagataaaaagaagaggggtgaaattcagagctaacagcaaagccttatttctctgatagacgtcagataacatacatcggtactgaatagaatttagtgatcattgagcataaagtagtatctccattcctttcttcatgccatgagtcctttatgcctctgatgaattaagcttataaagtttgataaagtattgtctgtatgtatactatgaagagcttctgtagaaaagattttctactttctttttctcagctacttgacacagacctctgaatacaaagggcacatagaaaaaaaaattaacaattgacctcttaaagttacagacttctgctttcattttaatgatacttcaaaataccttcagaggcatcatgcaattctgcatggaaattcataccctttggtacaatgtcattgcctttgtcatttgcaatgtggttaagtaaaatatatagtgaaagtacaaaattgtcttctgacttcaagcacttttgagagtgtacatgagaaaagtgggtcctttatactagtcctctcttatttacctttgaaaaaaattcccaaaaagcttcacacatagaaaaaaaaccactattgatactggcctgttaatcaccataacaccatacagatcattatttattttttccacctattaactccatgttggaaatgatcctaaggacttgctattccaagctgaatgttcttaagtagctaaagaatacaattttttaaagttaaaattaaaatagttatagccagatatatgtgagcttaaatcttggtcctgtcacctacaatttctgtgaccttcaactgattatttatcctttctttcccatcaccaccaagcctcagtgtcctcagctatgacataacatctactcacaggtttttggtgaggattaaatgaaaaagcaccacatatagagctctttacactgtctctggcccattatatactctcaataaattattcttattgctacctcttagtaatcgcttatctttttatccctaggtttactcttagcttgccaaatcatgttaaatatgtctgtctgtccctttatttacacacattagaagaagatttaagatctatcacttattgtctgtctggcatactataaggattacttcatggcagagtgaattattctcagcaagttcagtgctggaagttccacttttatttaagaaatttactatcatccctgctttatctgacaaacacaagccatctcataatcttaaaaggtatcatgaactgtaccaaaataatttcaaaacagaattaacttgtttgtgctttatgtaatatactgcagactagaatacaatgaaaggactattttaacagtagggaagaaaacagcagatattctatttcaatatgtccacggatgactgctttaagtttcatgttatgtagctgacacacatatactcctcataagaatgaatggacatattgacaaatgtgaatgatggaatctcaaaaaacatacatttatttattgctccatactgtgatttttgatgggaaaaataaggtcatcataaatggtctctattaggtttctggggtgactctagagttgagaatgtgcagatatgtcctgcaaagattactaatagaaagccaattatctggctgggcacggtggctcatgcctgtaatcctagcactttgggatgcagaggcaggtggatcacgagatcaggagtttgagaccagcctggccaacatggtgaaacccagtctctaccaaaaatacaaaaaaaaaaaaaaaaaaaaaaaaaattagctgggtgttgtagtgggcgcctgtaatcccagctacttgggaggcttaagcaggagaatagtttcaacccgggaggcagagattgcagtgagccaagattgcgccattgcactccagcctgggtgacacagcgacagagcgagactctgtctcaaaaaaaaaaaaagaaaaaaagccaattattttataatatctcaaattactgcagactggaagaaccaaaagacatttttttaacccttgacatagacttccagtggaatgcagcacaaatctcagttactggaagacaaatatgagaggagaaatagaggagactccttaattaagaatacaaaggtatattttgttatacacttcatctcacattccagatagaagaatttctgggctcattaatggaaactttgcttataatataacattaaattacaactgttggcacagtgagattccatccttgatattcaaattcttctagaaattgtcacatttgatttttggaagaagaataacattttaagagaaaaaactatcattattaggttggtataaaattaattgcagtttttgtcattactttcaatagcaaaaactgcagttacttttgcaccaatgtaatacttctaaacttttagacttctttatttaaatataaacacaaaccaatattccttgtttgtcaatatattgaatgtgagctctccttagtatcaacgttgttaaatataacatttttgttcctaaaactgtggttgcttgaaataatcaggtattttgactcatcgggtgattattatctgcttttattatgagataaaatctaaaatattacaggatttaaaatcaataagcatttattaggtaccttcttttcttcgcaatgtgttacaacctgaaggaaggaaagggaacaaaatggtgaggaggaaggagacaaggaataagagtgtttcacacaatttcacagagagagaagatttgaaactgcaattgaattttatagaggaaaccccaaagccatagaattaaatgtttgtttcagaattaaggaaacatgtccattgaggttaaacgacgttaccacaattgtccagccaataagtagtcacagaaggttccaagagagaagtgggtttgtgagtgggactgaagaatgattgttttgggatatgttgagagccaagtagtattgcttattatatgtcaagctttatgttcttttacctttactgtctcttttacagcattacaacctttcttgttaaatattgttaactgggctccaaagaagtgaagcagctttctcaagtacttataaacatatcacagatacaaagctgtgtcttctgactataaatatagccttctatagcacactgatttggtgggtagagacattccaaattttcagtttgtttgaagtaagaaattgaactaatattttggagcaagagtatataagacacctcacttagccaaaacagagctttcatgctctgttttgtatgtgagagagtagtgagatctacagaggctatcaaatttattaaaaagttataaatgttctattaacacataaagtccagagtgaatgtttcatacaacagaagaaagtataataataaaacaaaagggaaggaaagaaggaagaaaggagggaaggaaggaaggaaggaaggaagaaaggaaggatgaaaggaaattaataatattaaaaataaaacataacctctctgatgaaaaataatttgtatatgtctatatgtgaatgtaacatatattaagatccaaatcagccagagaagcaaaaggatgttgcatgttatagcagtaattatccttatgtggatggattataggtaatgtttttcttagattttttttccttcaaattttctacaaggagcttacatggatttggtaactcaaaaaaatcaatttacatagaaagaaatacatgtatataaactaaattattgtttgaatgtaaaattttgctaaattttaaaccataacatgtacagttgggataaaagctggaacatgttatactgaaacagtgtgaatattccattattttatcaatgcattattttcaatttaatatttttcctaatgaggatgaaacacaagttaatattctatttttgatagactccataaaaatttgcagttttcaaatatcaaattgtgtataggtagatacattcaggtatggatttcaaaattgtagtctgggctctagcttttgatgctgataaatattatctaaccaattatgctgacagaattaaaaagaagatctattcttgtccttttcacatgtggaatttgttactggtttaataccgaattgcaataatttagattggcctatacaatttcaaacacaacattaggttgataataaacacaaaatacagtcttattgactgtatttgatcagttctgtgtttttaaatttttagaaagttattacttattgcctacttagtgacctgatttaaggtatttttcaacttatctgttacatattgatgccatttattaaggtgtatctttctgtgacactttttagaaatcaataggataagtggcatttattttgtgttgtttcttcaaaaatgtcctgaaatattgacggtatatttttctttgaaattattcaaactgttgcaaatcaaatatcacaaaatttatttttctgttagcatttctaaagctaaattaattcagtattttaactgcatagattaatttatttagaacaagaccacaaaaagtttttaaagtcactctactcattattttcaaataagatgctttgcaatcacagtttcattttcaagacacttcagtgatattctatttgtggtgtctcataagatgtcctgtatcaaaaaatttggagtgatttcacgtctctgacaccattttaaagccaataattttgctttcagcatttctaacgctgtagttacttatttgtattgcatgtagaaattgctttggtatttgtcaatgagcaaccatagttacatgaacctcgaggaaacctctccagaattaggaaatggaaagcatttgttgatagtaagaagtctggagtttcatacaagtaatatagcagcatttttctcactttagaaataattcagcatgaccttcatactgccaaattgttcctaatcattgactttgcctaatggaaatactgttttctttttgactgattttgaatttgcttggcttactttaaaaatttataaatagatagtttttttttaactaaccaactctatcacctaacctctgcaaccatacatattcacaatactttcacataaatcacattcacaatactttcttataatcattatttcatgttaaaaaacacttgttttctcagagcccagagagcttcaggccacatcatagtttcttcaaagccttcaaagaagtttgactatgctccttgcatagaatcactgtctatgttttcttcattgtgtttatagtgtataagttatggttttgctcattcagttactttgagttatgagaaaattcctagatgttcttctctgaaaatttcttataaaatcgtctttactgagaacagatgttctcaaaacaattgtgataataaagagttcataacacatttcatacagctcaaaatatttagcccatggccttcactaaatgagaaaaaatagaatatgtgtgaggccaatcctgattcagagaagggagaaaatgaaagacaaaatatagaattatgatggccaggtatattttccctgttttggatgtttccagtgaagtttgaaagtataaatttatttaaggaaatgaagtaacatatcactttaagtttttttcatactcagtactctagatgtattttatctcccctggaaagttttataaaagttttagagaaaaagaaaataatatgcgaaatctaaagcaagcttattaaatacagcaacaaacaggatctaacataatattccccttacgtttggatggcagagcacatatctctccaaatagaagacgatagaaaaacaaaataatttttaaacttattaagtttttgtgtttatcattggacaactttgaaagtaagagaaaaatccacactctttcagctgttttcaaaaaaggtcattgtccttaaggaaatgaatatgccaagaaatattggaagtctccttccttccagagatgtgagtttgcgtgcttttcacaccaatgtttgacagcagtgatggatttaaacattttgaaggactttattgcctataaagtacttatcagcattgaaatatattttatatatctaacaaaatgttaaattgcataactggaaaactatcaattattctacaacttttttttattgttgttcttatgtgagtggaagtgaggcttctaatttgctttagtaaattgtgacttggaaaattggagctgaataaatcagttgatataacatagataaagcatttatttctttggatttttaattgcaatatcttacattttgaaaatctataggcatagtttcaaacttttttttctgggaggattacttaatctctacccaattaccatgacttctgcagttgtatttaatcctttttgagaaaattttactctgcatgttatataaatgtttgctattattcatttcaaaggtgagattctagagtaatattcacctacattccaggtcccttgggtatttatatgacctcaagaataagaaagaaaataaaggataaagaagaaataaaataaaagcatcaaattttctaaatgcttaaaaatatttcttcagtaattctttaaaatattattcataaagataccttttaagttttctgcattatatacttgctataggatatgctctatgtgtgtctaaattcttctcttcttgattttgttttttgtttttccagttactggctgaccaacaaagttcctatcaaaagacccagcacaggtcttctcatgtatacacttgccacaagattctgtgatgaaattcacctgtatggattctggcccttccctaaggatttaaatggaaaagcggtcaaatatcattattatgatgacttaaaatataggtacttttccaatgcaagccctcacagaatgccattagaattcaaaacattaaatgtgctacataatagaggagctctaaaactgacaacaggaaagtgtgtaaagcaataaagcacattttgaaacaaacaatatgcacttcttttctgaagatgcttccgaagatttgaaaataggatccaaaacacggctgggtttcagcatccaccaatgaactgaaaggtgaataaaggacgttcatgagaaatcgactaccagctgatgaaatacctgcaaagtgctctaaaaattaaatattttgactttaagggtcctagtaagtgccacttccactaagaatacagtttgaatgtataatcagtagtgtttacaagatccaacagtgcactcatcattagttaacaaagcaaatatgttcatcactgtcaggctgcccacagcaacaccaagcatattagaagaggaaccccaggaacgcaactcagaccttgggaaattaaaccatccttgtcagcagaagccaagatggaagcagtttgagcaatgaaatccgtaagattaaacaactcaagtaaatgcttcagtcaggactctgagtctgatcatgaattttatgttttaatttatgtttttttttttgtcttctggaatctcttttggtttggatattgggatgcttagaaatcctttctgagatgcatatgagtgaggaaataaactttaagtaattatttttaaagttcttatactttttaaaagctatcacacaaagactttttttttttttttgtctcgctctgttgcccaggctggagtacagtggcgcgatctcagctcactgcaagctccgcctcccaagttcactccattctcctgcctcagcctccggagtagctgggactgcaggcgcctgccaccacgcctggctaattttttgtatttttagtggagacggattttcaccgtgttagccaggatggtctcaatctcctgacctcgtgatccacccgccttggcctcccaaagtgctgggattacaggcgtgagccaccgtgcctggccgacatttttaaaaaagttttattttgcacggctctaaacctccatgttattttccagtggtgtagaaggtaccagctaaagtgaaccactatgtaatattaggccattctaaaggaaagatgttccatgtcatcagagatggtaaaataggcagggaaaaaaaaatctttggtaccaaagattacacttgtgtttctacacagcaaaccatttttctttcatgaaaataatatattattaacatgaatatattattttgctattaatgtgaaagttgtctctaaatattttttaattttcaaactcatactttattttcatttgaaatgtttttcacaccttttgcattacataataattttgtggaagcattttgccctttagaataaatattagattgatatagctgaaatgtgacttccagttctttgatattccccttgttattcaaatagaaatatggaaatgctttatatattactgttaaatttcttagtgcagaaataacattattaatagagtattgttttcaaaacagatgattaatttcaagaggtttaacagtgaaattgtgtcaatattttgcatttaaaatgaatttaattgaccgatattttctgtagttaaatttagtcacaatatcacatatgttcttcaagaaacacatgaaattattaataaagtaattaaaaaatttttaatgtataacagaattgaccaataggccagttttctggtaacttatgatagtagattgtttctttagaaactgggcagaagctctgcattctcacttgtactttgatttcttatttcttggtcaggcaatttgaggaaagaagaaatggcatggggaatatatatgttttgtttcttagggaaaacagtctgagaaatgaataaaaagcatgaagtacgtgtgtgtgtgtgtgtgtgtgttaccatggaaaaggatattcacagtagtacagttctcaatatttttaattagatgtcatatttttttaatatagtaaaaccttgggatatagaatattacatcttttgagaatgtatgtgtctctaagtaagtaaaatctaatgcgtataggagactgatagctaaaaatgaatggaacattaatgtacttttataattaaacctcttatctatcagaaattgtaagagaatagatacatgttttgaatgtaaagttgaaaagtctggtttactgaataaattgaaagtgatttataaaatctaaatttggactacttgcaaatgataagctattctagtagcctttagtttaaatccaacagaaatctagaagtcacaagcaaatatcttaaaggtaaaatccatctgggcactcatttaaagtatatcttaaaaaagcagcagcaaggtaccttgccatttttagcatattttcttcctttttcttttttcttttttttttttttttgagatggagtctcactctgtcacacaggctggaatgcagtgatgccatctcagctcactgcaacctccacctcctgggttcaagtgattctcgtgcctcagcctcccaagtagctggggttacaggcgcccaccaccacactcggctaattttgtgtttttagtagagacaaagtttcaccatgttggccaggctggtcttgaac

SEQ ID NO: 16413 - DNA, 18343 bp, Human
gccttgagtgggtttctccttttttctgaaacggctttactgagagtggctgtgcttaccacacgatttgcgcattgagcacgtacaaggcaagggcttttatatggtctattcacagaactgtgcaaccatcactcagtcgattgtagaacattttcatcacctcaaaaagaaaacccatacctttaggtaccacccctctagcacccactgcccacaaatccgctttctgtccccacagatgagcctagtgtggacatttcaaatgaatggaaccagaggctctgcggccttttgcgactggctgctgtcactgagcggaatgtttccaaatgcttctctctccacccagactgctagtcaggcttcactgcctgtcccgctctctaccgacatatttctccacgaatgagttggcagtgggggagggaaagagggtgggacagagatgagaccaggctgccaagagtcggacgctgaggctgggcaaaaggtaaaacacacaaacctgccgaaagacaagccatctcctttgtctggaaagggcatatgtggtctccaatctcctcattccaaccatgaaatcaagagagaaccagggttaccagcctggcccctggtttcccacgtctctcttctccctggcccagtctagaagcttcttgcaggcaggtaccacagtttggtcaaggtgccatgcgtcccaggtcctagccaggccctgggctgccgctggtgaacaggaagggggtctgtgccctgccatgcccccaggtagagctcccctgggagcatcctccctggcctgggacctcccagaccccaccccccggttgagtgatggcactgccaggggttgaagaccctcagccctcgacgttgtcctctctccattggatgccgcctctctctagccacccctctctccctctctgccccttcgagctttttctctcaatatgcaattttctcttttggtcttccgcactcttggcccccagttctattgcagatctgtttctcactccatctaaactcttacccctgtgtctcaggagctgctcttgctgagggaagaaggggacactacgggacaggggggcagtgtcgtactaaggacctgggctctagccactggaggaactggactcatttgggccctcaggaagcggctgagtcttggtggggtaacccggttagcccccgtaagtgaccagcacagggctgagcccagaggaagtggccacccacagagtggttctcatgtccgaggggacctgcagggattgagcaagaagactgactcgctggatccttcgtctctgaatcagttcagggcaggcaagctggggagccccctgccccgtcctgccaccaccagccggatcgggccctctttttaagggaagaaagtctggagtggaagggagggcacagggcgccaggagcctacatgaagtccttccagaaatccacaacagctacctctctgatcctggagaaaccacctccttgcttaggcccaagcaggttcctggcaggctcaggaccaaattccaggggccactcatgggcctagcagcccaaggccgcctccccctcgtctttcttccatctctctttcctctgcctggcgagatgccagccagcacctcagtgtccccatctgggcagtggaaagtttgactctctgggtccttgtttgagtgagtgcgagtgtgtccgttcctttgctgtctgccccaggcgggggagggggggggaggtggtgggggcgagggggcgggggctcagctagtccagccgtctacaagaaaattgctccctttgaagctgccaggggggccgggaagcctgccccctcctgctcgcccgccctctccgccccaccagccccctccctcctttcctccctccccgccctctccccgctgtcccctccccgtcggcccgcctgcccagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtagggctgggttcaagctgcctcctcagcaacccagagatgcccctggctctgctgcctccgctgtcccaagccctggtcctgctgtccccagtgccgcgagggtgtccacagatttccccggtgctctctgtaggctgctgatccacgccccttcatcgccaccctgcggcccccttggtccctgtcaggcttctgcctcgtctcgccgccctccaggcacctttccctcaccccttcctctccctctcccttctgaccttgctctgcttcatccacctcttgtctctctgcctcccactcggggtccgtcttcttggctaccaccctagagcgtggctgggtgactggtaccccagctttgccaatggccctgtttcatcattgcaagtcccaggcgcatgctccactccctcagcctcgctctgcccaggcgcctccttgctccagggcttggcgcctggcccgggttgggtcggatcggggaggaccgcccagcgcccaccgagctcagcacccaggagcagtcctccgctgcactgcctgaggccagtccttggcatgggctgaaagacttagtttcccaggcacaccccaggcaccctgcccagatgttcctcgctcgctcacccccaggttaatgctctgcctctacatcctctgtgagaagtctgggtcctgggagccctggctgcaagggccctgactgggggtgcctgggtggctcagccctgtctgtttccaggacccccttggactgggactcagaatgggtgtggaggggaaggagagaaaatcaggcaactgtgccatgctccccagggcggacctggcttggggtcccagaggggcctgccaggggacccaggagagggagcgagagagtgccctggaaggcccacggaggggagcgccccctcactgctccatgggcggggctgggtgcctgagcgcctgctgagcagagcagggggcccagggatctgcagggcacagggtacatcagtctccagtggtctgtcttggtgggcaggcctctctcctgctgtcctggctgccagactgctcaggtcccatcctcagggggtcctgtttctgggccctcgcccctccctggcctgccagctctctgccctatagcaactaattggaactgagacaagctggagatgctcagcccccctgcccccgtgccagaaaggctcccggggaccagcgcccaggggtgcgggtgagcacctcctggtgacacccagccgccggtgccagccgcaccccaggagagctggtgtatgagcatgggtgtcttggtgcggagcatgcccatgtatggccactgtgggccagcatggtgagcctttgagggcaagcccgtgtgggtatattgaaaggaagatgcagggctgcctccaagccaccagggctgggcggtgggagcaggttgcgagccagggagcagagagggctcccatggcaagctggccagctgtgggtggcagccctggcctccctggcccaccttcaagccccaaggacccgtacggcagtgggcattaaccctaccaacgcatagatggggagtctgggaaaggaaggggggtgtttccaaggcaagaatgagtttcctgtctttagcaacattccagagtcactcaaacaaagctatagcgtgtcccttccagtgacagcgccaagtccccagaggaggggtttgtaatgagttcacacttgacagttagcactcagagccttcagcaagggcttctgagtccttgccaccccgtatagaggtgggatgaggacctccccacctgccgtctcctgtgcttcccgggcccaccccccaccccccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacccctgcttgtcggaaatgtcttcccatgcccaccacgaccccctcccactcatctgtgggccggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttcccagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgtggggtgtgtgcagggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccagaagatcccctccaccacttgaatcccacagccagaagccccttctgggactctagactcctgggaaccatcccagctgcccccttcgctgtttcgctgtttgccttcttcccctgccccgtcatggctctaggtcagagcagcctctggggtggctatggaggggccaccagccttggctcttccgaggactgcagaaccctcccactcccagcttcccacctgcgcagctctgatcccagccagcccaaggggcagggtcaggtcccggctccctggcaggcctggtgaaggtgctgcccattcccatgaggctcatctctgaggcttaggggcctggggctctagccagccttcttgcatggaactctcctggtccactgcatcttaagcctgagctccacttaaacactggcctgagataagctggaggaccaggggcccaacggactctgtgggcctcttgaacttgcctctgctggccatcccagtcctgtttggtccctgaggtgttcagatgggccaaggggagcatggcgggcagactcctgggtggccagaagattagaaggcagccctgtccctggaggcaggggaagtctgggaagccagtgtgacttctatcctctggaagtctgagtccctgcttggccttgactgccatcccatggttcttggaggctgccctcatgcaaagagacacacacccatgggagcccagcagtcccaggagcctgaagctaagcaggctgtgggccaccctggctggctgaaggaggctaatcccagcccagcctgagcccccggcagagagcgggttgcggcagggaggggctgcaggaaaccttcccctcccctcctggccttggtgggcctgtaccagggagggagggaggcagggccccaggctctggggggcaggccgggaacaccttccctggggccctgaagtgctcgcctggggagacgatggcttttccaggagactccctgcagacagaggcagaggtgagaggctgggcgggggctgccctgctggctgtgttggggctgaggaggggcttctggatctgtgggccatagggagctactgatggtcctcagaagggccatgcttccaggggatccccctgcacagccccgagagtgtgaagcgtgtcagctttggggcctgtggcactgtgtgcattgggagagggtgggtccagacatgggggcaaggacacagacggacagacagacagtgtgtgcagccccagctctgctgtttcctcactgtgtggccttgggcaagagtttggggccaacttcctgagcctcagtttaccccttcatcaagttctaagagcattgcttccttcttatagtcaacgggggacggcaggatgctaagtaaagaaatcacatgagtcccctgctctgcctctgagaggtgacagcatcctcccttttccttggagactctagcaggaggccccggatctcttcggagagtgggagggggcagcagtagtccgtgtgcagaggaccaggagcgcacagtgggaagggctgagtcccgcactccgccgactgtggggacaggctggaccttgacatgggcgccacaggctgcaaagggctggcacagagaggtgggaggtggctgggcgcatcaagggagaactccacccttgtcgccaccctgccagaaaacctctggaaaggatttgagcagcagatgagccggggtttcccagcccctccacacgtggctgcaaggggagcagacgcccaggcgtggctgcctgaagggcatgctccggcaacggcaggggcttggaatgtggcacaaggtccacccctccccactccagcccccagcccctcaggcagccactcccacagatgaacgcacacgccgggctttggcaaggccagggagggtacacatcccctctctggttgatgcccaagtacaggctggagccatcggcggggagggactggtggactggggcctgggagagtggcagggggcaggccgggtgtcagcgggggcacaagcaccaggctgctggttgaaactgggcccaaaaggctttggaggccagaggggaggggaggaaggacacagtcccggggaccccgcagggctgcgtggaaggtggcacatgtgtcagagttcaggtcgggttgctcaggggggcagacgcccagggctgaggctgcggagacagcatccggcgtctgccacttggcagctgtgagccacaccatctgcaggcgagctcccagggcccgccagacctcaagccctgctcccgccgcccttggcctggcctgaatgcctggcacggaccctccatgttctcagaggctgccaacgcatcttgtttggctgtgacctcgagcaatccagtgcagaggactgcgctagctttcagaggggcagacaaggagggccctattggggtggtggcggaggctccaggaagcccagcctcctccctcactcacacctgcggtcgccaaacctggggcttatgccattgccgcccctgtcctttgctctaaagagatggtatccagggagctcagggcacactttggtggggcttgaaaccctccctgaagtccctgaagacacacccagagaggccaatgaagggaaactgaggcccagaggcctcagttgtggtggtggagagttgaggactggagggacttgctgtgggtctcacaggatctgactatggggtattcctgcttcctgggctggggtccccgcctgccttatctatgtgtggatatatgtgtatgtatgtgtatatgtatacatatgtatatgtgaatgtgtgtatgcatgtgtgtatagatgtgtgcatgtatgtgtgtacatatgtgtatgcgtgtatacaggtgtatatgtgcaggtatgtatgtatgtatgtgtgcatgtatgcatgtgtgtgtgtgtgtacgtgtgtataaatgtgtatgtgtgcgtgtgtgtgcgtgtgtgtacatgtgtgtatgtgtgcatgtgtgcatgtgtgtatacatgcatgcatgtgcgcatgtggatgtacatgtgcatgtatgtgtatagatgtgtgcatgagtgtgtgtgcatctgtgtatatatgtgtgtatatgtgtatcatatgtgtatgtgaatgtgtatacatgggtatgcatgtgtgagtgtctaggtgtgtgcatgtatatgtgtgtacatgtgtgtataggtgtgtgcacgtatatgtgtggatgtgtgcatgtatgtggatgcatgtggatgtgtgtacatatgtgttttgtataggtgtgtgcatgtgtgtgtgcacgtgtgtacatatgtgttttgtataggtgtgtgcgtgtgcacgtgtgtgtatgtgagcgtgtatgtgtgcatctgtgtgtgtgtttgtgtgtgtatgtgtgtacgtgtgtgtgtgtgcatgttctggcaggagggaggggcttggtgtgaggtggtggggagaaggcaggggccaggctttgggaggacagctgagcctatactgccaggacctcccaaactgccacccccagtcttgggcattcaggctctcacaggcccagagacatggctggagccctgtggctgaggagcacagctgagagctcaggcggggcctggaggcgccaaagctgagttccaagtcaggctgagtgacttgggagaaatcagagcctctctctcggccttagcttttgtgtccataaaatggggatactcatcaggccagctccaggggatcctatccttccccccaggctcccctggctccctctgacttcatgggccccttgctgcctcctgtgggctcagacacggagcctgccccttcctcgggagaggtctcagttttgtgccagttctttgaggggaaatgagggatgtgccgggaagcctgcccggcccccgcccctccagcctgcccactgcttgggcacagccatgagccatggaaaaccagccaaaccttgtccttctgcctctgtcacggggcccgggtgtatgggccttccagccctcagcctccctccccgctctgagggaacctcttccccttgcccctttctcagtctcttggagaccccccagacatcctactgtatcaggcagcctgcctccagagccctcgttgccccacagctggtcccgggaacccgcctgagaccccgatggccagtcttgccgtgactggcctgccctgtgcctgtgccccctgccctggtggagggcccgattccctaacaggagggcctgcagggaagtcccagctcctggggagaccccttgccccggggcaggagtccctgtagagtcctcctccaggccaatgcgtgggtcctggggggctccaagctggccatggtcagatggtcctctgtcccctcggccttccccagcccctccccacagcctcccgtaggcccagccggaccaccccaaccctacctgtccaggtggactgcccaccctggagcttgccagggctctggcggggtgtcccagccctgactcactctccctgggaggtagcggctttggcaggggcatcggcaaggaggggcagggcagtctcctccctcccccactccatcttgctctcctgcttccaccctgcccttcctgttctctcccactgctcctcctcctcctcctccttctgcccccgggtgtccactggcactgggagagggtcctacagcggcagcaggcatcggaggccctgccctgccctggaggaagggaaacaccatccaggtaggtgagtgttgagccttctccctacttgggggccaagaccctccgggcggttcccctaggttctgctgggccggcctgaggctggcaggccctgggctgcaactgtgggatctcaaggctcaaaagaatgagggaggctcggtgctgccccagcaggggcctcctggtgaccccaggggtcagcatgaagtccagctccacatgagggggaagctgagctaagccttgggctccgactcccactttgcagtgtggcccagggcctgtgggctcaggagggctccggggctggctgcggaaaggccactccacaggcctggcagccgctatagccacagcctcaccacaggcccctctgtccacaggtgtgggagggcgcatgggtggcttctaggggggatgccaatgcaggggggacgcgtgccagcagatgctccctggagcacccgaggagctgcatgggggcgacaggacaggcctccatcccaaccctctcctgggcttgtgctcagacccaacctggccctgaagtggcctcaggcccccggcccgctggtagcaaggactccaaagcggcagccccgggcagccagcccagcccccagggcaactggggaagcatcgggcagggcggggctgctcatagggtgctggcctgggggcagagcccccacctccccacggcctccttagacccctgcaaccagcagctgggcttagggggctcacctcgctctgctggagccccagacagcccctccccagctagtactggccctaagtgagggtctcctgggcgtgcgactgcttcaggtctgccagaggcccctgctgcccagctgggctccccatctccagatgcaccgagggccaccccaggctgggtggcaagcagggcaggcatgtttattcccacttaacagatggggaaggtgaggctgggatgagacctgggcctttgctggagagtcagggtggatgaagtggtgagagaggcagggctccagcctcttcctgtagggcacattcccggctgcctctggacgggagaccgtgtctgatgaggagggaggaggcaagcagaggtgggtgctgggggcaggctcgggcagggctgcttcccctccactcccactcgccgcctcggcctggggggcctcaggcaagcctgaccctgccctgccaccctggcggcagcctgctcccctggggggcctctctgggctgccgaggctgtgggcagggaggaagggtgcgagcagatctgggagctccagggctgtttgggccaaggcggtgtgggcggggggctggggcgggtggtccagaggaggaagccaaggcccaggggcagtgttgggggcgccacggcctccacctcgggggcctccactcagtgctgcctcagccaactttacccacggcctccaaggacaccccctctttctccgccctgcctccctaccttggccttagagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcggaggcgtgggggcctgcagacttgctgatgaggagacatttcatcgcctgattaagccaagtcctgtccgggatggggaggggggtagtggaagcagtgaagggagtggagtggaaggggcaccctccttgccagcagcatccactcccttcctgcctggagccctctgcccacactccgccctctccgcctcccgctccagggtctggccgtccctggtgagggatgggaacgcagtgccaccacacacgcggaacaccagcccctggcatggagaagacaggtgggtgctggtgctgatgatcccctcgcctcttcccccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaagggggcacatgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggtgggtgcatgtgcgtggacgtgtggggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggctgggagcggcaaggcagtggtggcactgctggggctcaggaccgggcctgggtgctgcctcctgccctgcactctgctcacaagcatggactgacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagtgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagccttcgatggcctgaagctcaactacctgcgcatctcagaggccaagctgactggcatccccaaaggtaggaagcccactcttcctgcacgcctgcctgcctcacccccaacagcacagatggccagggtgggggctctggatgggcccgatctactcagggaaaggctcaacagtcccctcccgccacctggggcagagctagggcccctgccctcagcacctgcattctcccctgtgccctcttctcctggcagacctccctgagaccctgaatgaactccacctagaccacaacaaaatccaggccatcgaactggaggacctgcttcgctactccaagctgtacaggtgaggccagcagggcaccgcccaagggtgatgccagagtccctcagtgctgtgtggcccctcgcgcccagccccccatccttacctccagcctttgagtccgtgtcattctcccgctcacaggctgggcctaggccacaaccagatcaggatgatcgagaacgggagcctgagcttcctgcccaccctccgggagctccacttggacaacaacaagttggccagggtgccctcagggctcccagacctcaagctcctccaggtgagagctgggcatgcacagccaggttccctaaggctgggctgggggaggcgtgtgtgtccccgggcagtccctcagtcccctggccctccttcccgaccggctctgggcatccgcaagggagcggtcctgatgctcccagctggtgctgaggaggcagggagcaggggctccatggtggataccgagcaaggcagcctggtagctcttggacccgagggtctccaggtgggtcggacaccagaaagatgtggcagagtccagggagtcgagaaactgtgggcgtgggagtgcacagatctgtgccaagacagtgacagcccagggcaggaagtaggctgacgagggggagcagggtcttgcctgggattctatcgggagcttccatccctggcctggcccgcaaccaggtgggtgatcttggtcttgcccagccctgctccatccacaagtgtttggagcacccccatccgcaccagctgcgagccagcaccgcgcaggccatgcccatgctgggccgagtgcgccctctagtggccattgtcatgttcaccagcactgggctcccagcccaacccagcaggcgcctcgcctgcccacctccgctcctcccagagacagcaagacggtggctccagagagttggaggggctgctagagggcgagctcctctgctgactggaagaaagaggagggcatcccaagggctctttctcctctcatgccccatggagtgtgagggtgctcccccgaggctcaggccacctttcctccacctcacaccaccaaacacacctctaccccagccccgcccccacatgtcctcaacctgacccacctgagaccctcatccttgtccctggtcacatccagtgccttaatcctggctgacacccacacaaataacacgcccatgccttggtttgctcctcccaacaacggggagcctctggtgtggcccttgaagtagggtgcagaggcaacagcaaaatgcctcctggaggcagcgggcttggcgtggagggagggaggcctgccgtgacccggcctctctgccttcaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctttctgtgtgtgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtggctccgtgcgctgctcctgtggcggcctggcctctccgtgcccctcctggcccttgggctccttgccctcagaagaggggccccgtcaccctcagaagaggggccccgtcaccctcaggtctgggctagcccggactagggaggtttcccctcccttctagacacttccatggccccagctgtcctgagacgcggctccagaatccaaccaggcctgaatggcacctgccctctcagcgtggagcgtttgccaagagcacgccgactgcagggcgccaggctagagcctggaaatctaagcggggcccggcctgcccagctccatggagtctagggttcacaacgaggcaccgccaaaacccagggggtgacacaggagggaaggggcccaatggagccagggcagggtgctgtgtgcacccacttgcactggcctggccttggctcccctgccagccccctggcaggtgacactgtgtgtaggcagagccgagcctgggctgcaaggcattcccacacacgcagcatccagagagaggatccaggtcagggccgggaaagcctgcatgctggggacacaggtcgtcctggaaaggacagcttggagggggacagtccccagagcaacgctaccgcctgtgactttccttcggccctgcacgaagagcctcagagcaggtggcgggacctggggcttccctgggcagcccaggctcccaacggaaatagagtgggcagggcccgcgtgaatggcagcctggcactgcgtgttggctcctcacacataactgcgtctttatggctggactggcactggcgcactggcatccccaggtttctcctttctgggataggaggtgccacacagtgtggtggcccagtgatagaaagtcaccatcagcatcacagcactattctgggccatgtgctctacggcccggcaatgtctgctgagctgggcaggcatggtgcaagggaactgggcaggggccgggagtcaaggcttcgggcaagtcccctcgctggctgggaggaggggcagccagcgccacggcctggcagagatggaaagatggggcttccgcccattcatctgtgagcgggtcttggggcattggctctgtgttcagtgggtccaacacagcccccgtgaatctgtccactcttcctgcctcgctcccatccttcctgtgcctcctttcctctctgtctgcctctcatttcatgcaccttcatcacacctgtcctctgcgtgtcccagctcagggatgcagtgtgggtggaggacaagctagtgggatgagtgtgatatgggtggtcagtgcagaggaaggcatcctgcaggctgcgtgcttagcccacacagcagggggtgccctgcaggcagcacacactctgcctggactagagtgccaagcccccgaggcaggagcccagagctggacagggtcacagcctgcaagggcttctgggtcgtggtggaaggtgagctccatcctcaaagcagttggtcctgaccacagtgtgaagatgaatcacatagcctcactctaccgccaagtgtgggaaaaactattagctaatactagccaaggtgagactgatttgggcttaaaaaagaaaatggctaggcgtggtggctcacggctgtcatctcagcactttgggaggccaaggcaggaagattgcttgaggccaggagtccaagaccagcctaggcaacatagtgagaccccatctctaaaaaagaaaaaactaaaaaattagctaggcattgtggcacacgcc

SEQ ID NO: 16414 - DNA, 7432 bp, Human
agagaggttaagcgacttgcccaaggtcacacagcctgcacacagcctgcgcagaacttgtgtttttcccttgtactctgtcaggcttccgatctgcaggttgacggactgggaagcaaggtatggagggacattaagctagaagggttaccaggggcaaaactgggcagagggatcacaggccaggctaaggagccctttacggttcaggctctgaaggtttaagagcagggagatgccctgaccagggccgttcactacgaagattaacctggtagagcagggaggactagctaggtgagagctgggaaacaggggagctactcatcagttgtctaatatgtgcccctctctgttctaggtcctggagtaccagtagtgaatacaacaaagatgcctgccctcagacagcctgccttctagtggagggacaacaaagagcaaaacaaacaagcaaaatatacagtaggtcagaaggggataagaactgttggaaaaaaaagtagagcaaggtgagtggcttgtttgtactgggggctgcaatacttaaatagggtgcctaagaggaggcaggcggagaggacaactgagacaaagatgagaggcaggagtgtggctggcacatgaggttcaaccacaaagccagtgttctggggctggagtgagccagacgagagaagagttgtggagcgatggaaggggacacgtcgtgccaagctttggagatcacagtgagaactctggctcgtactacttggggggatgatgatgacccaaaagtcaggaatctgttcactgctgaagagagaagagggcaaagggcagcagctccatttaaaaggttctaataagcctcgggcctttctctgtctgagaaacttactctctgccctctgtctccctagattactgcccctatgcctggaggaaaaacaggtgaaggctaaaagccacggggatagctaaagagggcaaactggacctccagctccacttctgcaggtctatgtcagtccacagcccttgcacacgctcccttttaattctccaagcatacctctcacttccaaaactcctgtgactctgctgatgagggcgtctcggcctggaatgctcctccttatctgcattgtgtgggtgtcaaaaagagtatattttgatgacctctccccgcccctcatgctcgctcacatccccctcactcctttcaaagtccgttcccaaaggccccagttcaccgtcctgggctgcttttagccaggtaagatctaaagtgatcctctcttggaacctggtctggggcctatacatctgggtcagtctaggggtgctctcgaagggccaccctcaaagagcgagcctcggctggattcagttcctaggtcccagccgtccgacctctgcgacaacactcagcacaccccttcccctctccgggtctcagttgccccgtgagtacagtccctgctccaacacgcaaggtaatcgtttctggctgctctgatgcactcggtccctaaactcagccttaggtcaacccagaaagcacccgacccgggcgaccccgtagctccccaccctcccgcactgcccagtcgctgacacagggtgacctccaatggcaaggccacgactcttacccgtccgtaggcgcccccctgtctggcctcagctcgcaagcaggctgcacccactgaactccaggcccggaccgccaccctttactcccctcccgcgtgagccgagaatcagccgagcttcctccaccaagaggattggcccagctcggcgacgactcagccaattggcgctcacggcgtgatcttgcccaataaagacggggctctgtcgccagcgtgcccctccccgcgctgggccggggctttgccaggttagtcccaccctcttcggccctgcaccaatagggagaggcggcgacgagcggacggccaatggggagcggggctgcgcgcgcggggcggtgggaacggcgccgagtcagtgtacacgtcggttgcctaacaaccggcagcggactcctttggctatggtgagtgctgccgctctgtcgcgccccacgcccagcggctgagcccttcccaggccccagctcggccacgccgcctctcctgcgcctttctcggctttagcgcaccagtctttcctttgagctctttcccgggagagtagggtacagacgctaaccaacctactgggcctgcgcttcgctgctgcctcctcttcacccacaacaggcccacacccgcccctcgggctccccttgcattccctgatcccctcggtgaacctccctgggcaaaaaagactcgaatccctcacaggcccctgactctctcagaccttggccccctggcctcctcattctgccaaaatttccacacacagctgggaaaaggtgtatcgtgttctgttacaatgttttttacaatttaaatacaggggcattcaggggatgctttagcttcttggagaaggcacgaaggtgccagatggattgagttttattactcggtactgacacaatatacatcttaacaacttactaatatttggccaaatctagaagtaattgggaagtcggagtacttactgggaaggggagtactgggagtgggcatcgtaagactgttttcagaaccaggatccccacgttcgggaagagctgattatctctagttattcacagtcatcttcttgactggctctcttttgggatgattttcagtaagaggtgtccttactgaacaagtgatctccctgcttctagaaacaacagtaaagaaaagggaggggtagaagttcatggaaagattcattgttcttgccagtaaaccctgttatctttctttttaagcaaagctttggaattggttatataaatgactttaaaaatacatatgggtgtctgtaactatgttatgtaaatatggactgtatgatatattattgtgcttgtgtattgcataacatataaaggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggcaagctctgtgcattcctgccgtactgcccttcctttcctctgcctcttccttgtcatctccctatcacctctctaccccttttgccctcttctccctgcagtaagtaacaggggaggttgtactgtgctgttttcctgtctttacttactttgagtattattcaataaaattgattgcaaatatcaattagatcaatgtcatagtgttccccaatcatattaacatgaccacatcagatgctggcttaatgctctcaacactgttatttttgctcctgctactttagatgtgcttattgagacgatcctgttttctttataggtggcaatgagggccctgggctttgaacccaagaaagaagaaattaagaaaatgataagtgaaattgataaggaagggacaggaaaaatgaactttggtgactttttaactgtgatgacccagaaaatggtaagtagctaagacaattatcatggtatggagccccagtcatctgcagaggtccatggcgtcttcctgttaaaacagtcatgtgaccacagagcagtccaggtagcaactgcatcaggaggcctgccctcccatcatgttactttgggctcccaaaacaagcccttgtgcttctttctcaagacttccaagcagatacctcttcccacagaattccaaatcagttaggaaatagatatgggatagggagagatatagcgataggtagcaaacgtcaccttggatggagtgcctggcttgcctggtgtttctttgaggccaaaatgggcttcctgacacttgccgcaagtctagactcgagttacattgttaaaaaggaaagggtgacctgaccaggcagtggcagggctacaggacagtagtaaccaaccgtggtgtccccctactcatgtgttttatgttctacttgttaagtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggtttgtaatgcatcacactggaacttaaaattcccacctttgagccctctgtgacttttccattacattttccctagtgtgagcacctctttgaagaaaagccagtgtactttgtccctctgcagacaacttaattctcctttaatagtcagacaaacctatgaaccctgcttccagaaaaatgcacatatgcacaattttgcttactattttaggttccaggaatccctctagtcaaggcaatcttcaaggtccctcccaggtgatatgtttgacaaagtatgagttggttttcaaataacttttcagaaaccaagctattatcaggagtagcatactggcattgggtggactacaatgatctattcacatagatacaaattatctattcacatagattaaaagtctattgcttgccaggcacagtggatcatgcatataatcccagtactttgggaggctgaggcaggaggatctcttgtggccaggaatttgagaccagtgtgggcagcatagagaccccatctctaaaaaaaaaaaagtctattacttagtcaccttttggcattagtttataaattaacctgaatctttactgtcatataggaaatgattgatgaagctgatcgagatggagatggagaggtcagtgagcaagagttcctgcgcatcatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaagcaaaacaagagcacacaagcgtgaagaaaaggatcttaaagctttgagcacctgccattttgccttgcatcgtttccctcgtcatgcatttccacatatccacaaacacagaacgactttagacaagcacatgttacacctgtgttgccacaagcagtcattcttgacggctccagtttttatttgacacttgagtttagttttctcttttataaacccagtgaactcctgcactggcatttggatgtgtgttaatgctatttgttttgtcttaaaagtaaaacctttctcagtttgaacttgtattctctaaggatgagttctttagctttgcttatgagttcctcttctcaattattgtgttgaaggcagcctattagatacaaaactccttaccagcctatggacagaaaatgaataatcctttgctactttcctggcatgaattgctttttgccttggaaggctgctggtttgtaaaactagcagaatttttatatcacctaagcctaaatgatgctctaaaaatagttttggcaaagctaagactggaaaagagtcttgttagtaatttgtgcttgaataaaatggggagagccaggctaacgcaacactaggatggattcagccaacctctcgtgaatttatttgcttatggtatctcatcgactcttggaggtgggttgggctgagtgaccccatccaaccatcttcctggccttgcccgggattccctgtgtgagaaatcctggtagatgacattaaagtctctgctccagggtgagagtggggaggcagaaggggtgagggagaatagaaaatgaacaatgatggaatgctcgtttgttcacatggagagggagaaaacagattttcaaacttctgggggtaggctagtcctctggggatagggttgcctgattcagctaataaaaagaaagttgaggtaaatttgcatttcagatcaatgatgccttttttttagtatgactatatcccatttgtattttttgtttattcattgttgatcttaaatgcaaatttacctaagcatcctgtattgccactggtaaccctacccggggagcacgttacagaggccagaagcctggccctcggtctcatgcctctggaccctgacatcctgtaggacttgggggcccaggaatatgaagtttaccatatcccccagatgagtctcatgccgagggactgctccttaagaaaaacttgggggaagagcccagactagcccaaaccctggattctcacacacacccacttcctcatcgggcaatttggggcaagctacttctctaggtgcctggagtttgatgtctgtgtgatggggagaagagttgtgcctactcagaatcactggaggtgaaatacaaacttacagagaggacctggcttgaaggtattcaagaacaagaggattcagaagtgttcagtcttactcccattcttttgctacagttatcacataagctttgttgttaaatgtgggtccatgaagcttttatcattactgtccccaaagtgtgttgatagcatttcctaggaggatttgacctttgttgtattgtgattttctaataagaggcatatgattggataaaagacataatattggaaaggagtgaaaagactgggccctgcctccaattttactgttaactgtaaccctggaaacactcttttgaaaaaaagttaattaaacgagatcatgtcctttgcagggacatggatggagctggaagccattatcctcagcaaactaacccaggaacaggaaaccaaacaccacttgttctcactcgtgagtgggagctgaacagagagaacacgtagttacagggaaggggacaatatacataggggcctgtcggtggcagtgggggtgggggtgtggggggagggagaacatcaggataaatagctaatgcatgtggggcttaacacctaggtgatgggttgataggtgcagcaaaccaccgtggcacacgtttacctatgcaaccagcacgtcctgcacatgtatcccggaacttaacttaaaaaaaaaaaaacagtttcagggataaggaaaaaaaagttaattaaaaagaagttttgaaattgacaacattgtatatatttatggtgtacaatatgatgttttgaaagatgtatacattgttgaatggctaaattaagctaatggactatcctggagacattcttatctcctcctgcttaatattcccataaatgaaatctctcaggaatctcttgagacaggacggagagtggcaagt

SEQ ID NO: 16415 - DNA, 42404 bp, Human
ttgagaaagaagcacaagggcttgttttgggagcccaaagtaacatgatgggagggcaggcctcctgatgcagttgctacctggactgctctgtggtcacatgactgttttaacaggaagacgccatggacctctgcagatgactggggctccataccatgataattgtcttagctacttaccattttctgggtcatcacagttaaaaagtcaccaaagttcatttttcctgtcccttccttatcaatttcacttatcattttcttaatttcttctttcttgggttcaaagcccagggccctcattgccacctataaagaaaacaggatcgtctcaataagcacatctaaagtagcaggagcaaaaataacagtgttgagagcattaagccagcatctgatgtggtcatgttaatatgattggggaacactatgacattgatctaattgatatttgcaatcaattttattgaataatactcaaagtaagtaaagacaggaaaacagcacagtacaacctcccctgttacttactgcagggagaagagggcaaaaggggtagagaggtgatagggagatgacaaggaagaggcagaggaaaggaagggcagtacggcaggaatgcacagagcttgccttcagttctttaacatctatggtgccagttccatccgcatcgaaaagatcaaaagcttcccggatctcctgcttttgctcttcagtaagctcaggcttagggctcattctttttcgctgagaacttgatgccatgtttgccttcttaaagttggaggcctttatatgttatgcaatacacaagcacaataatatatcatacagtccatatttacataacatagttacagacacccatatgtatttttaaagtcatttatataaccaattccaaagctttgcttaaaaagaaagataacagggtttactggcaagaacaatgaatctttccatgaacttctacccctcccttttctttactgttgtttctagaagcagggagatcacttgttcagtaaggacacctcttactgaaaatcatcccaaaagagagccagtcaagaagatgactgtgaataactagagataatcagctcttcccgaacgtggggatcctggttctgaaaacagtcttacgatgcccactcccagtactccccttcccagtaagtactccgacttcccaattacttctagatttggccaaatattagtaagttgttaagatgtatattgtgtcagtaccgagtaataaaactcaatccatctggcaccttcgtgccttctccaagaagctaaagcatcccctgaatgcccctgtatttaaattgtaaaaaacattgtaacagaacacgatacaccttttcccagctgtgtgtggaaattttggcagaatgaggaggccagggggccaaggtctgagagagtcaggggcctgtgagggattcgagtcttttttgcccagggaggttcaccgaggggatcagggaatgcaaggggagcccgaggggcgggtgtgggcctgttgtgggtgaagaggaggcagcagcgaagcgcaggcccagtaggttggttagcgtctgtaccctactctcccgggaaagagctcaaaggaaagactggtgcgctaaagccgagaaaggcgcaggagaggcggcgtggccgagctggggcctgggaagggctcagccgctgggcgtggggcgcgacagagcggcagcactcaccatagccaaaggagtccgctgccggttgttaggcaaccgacgtgtacactgactcggcgccgttcccaccgccccgcgcgcgcagccccgctccccattggccgtccgctcgtcgccgcctctccctattggtgcagggccgaagagggtgggactaacctggcaaagccccggcccagcgcggggaggggcacgctggcgacagagccccgtctttattgggcaagatcacgccgtgagcgccaattggctgagtcgtcgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacgggtaagagtcgtggccttgccattggaggtcaccctgtgtcagcgactgggcagtgcgggagggtggggagctacggggtcgcccgggtcgggtgctttctgggttgacctaaggctgagtttagggaccgagtgcatcagagcagccagaaacgattaccttgcgtgttggagcagggactgtactcacggggcaactgagacccggagaggggaaggggtgtgctgagtgttgtcgcagaggtcggacggctgggacctaggaactgaatccagccgaggctcgctctttgagggtggcccttcgagagcacccctagactgacccagatgtataggccccagaccaggttccaagagaggatcactttagatcttacctggctaaaagcagcccaggacggtgaactggggcctttgggaacggactttgaaaggagtgagggggatgtgagcgagcatgaggggcggggagaggtcatcaaaatatactctttttgacacccacacaatgcagataaggaggagcattccaggccgagacgccctcatcagcagagtcacaggagttttggaagtgagaggtatgcttggagaattaaaagggagcgtgtgcaagggctgtggactgacatagacctgcagaagtggagctggaggtccagtttgccctctttagctatccccgtggcttttagccttcacctgtttttcctccaggcataggggcagtaatctagggagacagagggcagagagtaagtttctcagacagagaaaggcccgaggcttattagaaccttttaaatggagctgctgccctttgccctcttctctcttcagcagtgaacagattcctgacttttgggtcatcatcatccccccaagtagtacgagccagagttctcactgtgatctccaaagcttggcacgacgtgtccccttccatcgctccacaactcttctctcgtctggctcactccagccccagaacactggctttgtggttgaacctcatgtgccagccacactcctgcctctcatctttgtctcagttgtcctctccgcctgcctcctcttaggcaccctatttaagtattgcagcccccagtacaaacaagccactcaccttgctctacttttttttccaacagttcttatccccttctgacctactgtatattttgcttgtttgttttgctctttgttgtccctccactagaaggcaggctgtctgagggcaggcatctttgttgtattcactactggtactccaggacctagaacagagaggggcacatattagacaactgatgagtagctcccctgtttcccagctctcacctagctagtcctccctgctctaccaggttaatcttcgtagtgaacggccctggtcagggcatctccctgctcttaaaccttcagagcctgaaccgtaaagggctccttagcctggcctgtgatccctctgcccagttttgcccctggtaacccttctagcttaatgtccctccataccttgcttcccagtccgtcaacctgcagatcggaagcctgacagagtacaagggaaaaacacaagttctgcgcaggctgtgtgcaggctgtgtgaccttgggcaagtcgcttaacctctctgagcctgtttctcatttgttgagtgagaccagtactgtctacctgatgggatacttttgcatctcaatgggatgaactacttatatgtaaagtggcctgatgttgagcaggtcttcaggcagtattacagttgacccctgaacaacatgggtttgaaccttgtgagtccatttacaggcagatttttttctcatctctcccaccgctgagcagcaggatcagctcctcctcatcttccttctcagcatactcatcaggaagaccgtgaggatggagaccatgatgatccactttcactcagtgaatagtaaatatattttctcttccttatgatttcatagtaacattttcttttctctagcttaatttattgctgggacacagtatgtaatacatgtaatgtacaaaatatttgttcatcaactgtttacattattggtaaggcttccagccaacagtaagctatattagtgaagttttaggtgagtcaaaagttatatgtggatttttgacttcggggctccgtgcccctaacccccacattgttcaagagtcaaatgtagttcttgtctctgatttgctcttgtcattcccccccgcccaccatgcctggagccttagacttgtccaaaatctcttccctgcactgcagccaaggtgatctttccagtcgcaacactcactcctgcttccaacttctaggggctccaccatctttccccccttgtaactccctagcttggcacacagcccccacatgttctcaactttgctcccgatcttgcttcacacttgctgtgacacagcttgtcactgttataagaacatgctggctctgtgccatcactttgtccttcccaccctggccatggaatgtctttcaggacaccatgcgctctgttttactcactcttctggggccttttgaagtcagcttagggatctcctagttggggcaggcttccctgagccagcagcctgcattggtgctctgggcttgccctcatcagagtggaaacgcacttctgtgactctttgcttgctcctgtctcccaccctagatggcgggctccttgaaggttggcagtgtgtctttgtcagcttctgcctggtagtggctggcatttgataacttgtgaatgaggaaattaatgcatgaggtgacacctgggggttcttttacaagttacagctcccgctttaaccctgggggtttgtttgagcctcacagtagctctgaggtagggaagaaggacgctgttttacagataaggcctcatggccagcggcagcacgataattcactcaaacccatcttccattccaggctgtctgctgggcctccaggggctcgtggtgtcctacagggtgctgagtgtgaggatgagagcagaaacaggtgctgtggaagcgactcaccttccctggggagggggaggaagtttcacagagggggcagttcagctaggccttgaaggaagaggaggcactcaccgtggagaggagagagaaggtattccatgcagaggaacagcgtaagctaagctcacaggcatgctgctgggtttctgagaggtctaccacaaaataaaagctggcgactttttttgtcctaaaagtaaatagagaaacaaacaactggtggaaacatggacaccgcaggtccgtggaaggacaaggtcaagctgggttgccccagcataatcaaggctaaagtgacacctctaaagagaaatgacctccaagctattggcctcactaatcctaatctgggtattttctttcccatatcacatctttgaattctgaaagggaggctttattgttgttcctacagggctcctgctttgctgtattttctctaagaaatatgtccataatgaaggtgtgtgccgcctcaggtgaatccttctctttgcatctgatcatctggcccagtcctgcagaggaggccaagcatgaggcatgaggtgatgggaaataggggaatcctcttttataatccaaggcttaggcccccatttcaggattccaaagaaagttctaagaaacattacttggcattccttggatagccaaactctactgaggtgtttggggaagggcagtttgcctggcattgtctgcccatggactgaagggatgagctctcagtggccacattctagcttcctgcactggaccttgtgcaagggtggggctccgacaacctttcccctttacaaagatgtcacacttctttctagaaggacgggacgctctcatctctctccctagtttgagacagaatgttctctccttttccctccaggaaatgttccccagcaggaaggaggaggttgggctaactcgcttctctcttctcgcttcacatgaggcggcacacaccttcattatggatgtgtttcttagaaaaaatacagcaaagcaggagtcctctaggagcaaacgtaaggcctccctttcaagatgtgatatgggaaagaaaatactcagattaggattagtgaggccagtggctacaaggtcacatctctctttttttttttttaattattattatactttaagttctagggtacatgtgcacaacatgcaggtttgttacataggtatacatgtgccatcttggtttgctgcacccatcaactcgtcatttacattaggtatatctcctaatgctatccctcccccaggcccccaccccccaggccccagtgtgtgatgttccccgccctgtgtccaagtgttcttattgttcagttcctacctatgagtgagaacatgtggtgtttggttatctgtccttgtgatagtttgctgagaatgatagtttccagcttcatccatgcccctacaaaggacatgaactcatcatttttcatggctgcatagtattccatggtgtatatgtgccacattttcttaatccagtctatcagtgttggacatttgggttggttccaagcctttgctattgtgaatagtgccacaataaacatatgtgtgcatgagtctttatagtagcatgatttataatcctttgggtatatatacccagtaatgggattgctgggtcaaatggtatttctagttctagatccttgaggaatggccacactgtcttccacaatggttgaactaatttacactcccaccaacagtgtaaaagtgttcctatttctccacatcctctccagtatctgttgtttcctgactttttaaagatcgccattctaactagtgtgagatggtatctcattgtggttttgatttgcatttctctgatggccagtgatgatcagcattttttcgtgtgtctgttggctgcataaatgtcttcttatgagaagtgtctgttcatatcctttgcccactttttgatggggttgtttgtgtttttcttgtaaatttgtttaagttctttgtagattctggatattagccctttgtcagatgggtagattgcaaacattttctcccatcctgtaggttgcctgttcactatgatggtagtttcttttgatgtgcagaaactctttagtttaattacatcccatttgtttattttggcttttgttgccattgcttctggtgttttagtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccatttcttgtttttgtcaggtttgttaaagatcagatggttgtagatgtgtggtgttatttctgagcgctctgttttgttccattggtctatatctctgttttggtaccagtaccatgctgttttggttactgtagccttgtagtatagttcgaagtcaagtagtatgatgcctccagcttcgttctttttgcttaggattctcttggctatgtgggctcttttttggttccatatgaactttaaagtagttttttccaattctgtgaagaaagtcattggtagcttgatggtgatggcattgaatctataaattaccttggacagtatggccagtttcacaatattgatttttcctattcatgagcatggaatgttcttccatttgtttgtgtcctcttttatttcgttgagcaatggttcgtagttctccttgaagaggtccttcacgtcccttgtaagttggattcctaggtattttattatctttgaagcaattgtgaatgggagttcactcatgatttggctctctgtttgtctgctattggtgtttaggaatgcttgtgatttttgcacattgatttggtatcctgagactttgctgaagttgcttaaggagattttgggctgaaacgatagggttttctaaatatataatcatgtcatctgcaaacagggacaatttgacttcctcttttcctaattgaataccctttatttctttctcttgcctgattgccctggccagaacttccaacactatgttgaataggagtggtgagagaggggacccctctcttgtgccagttttcaaagggaatgcttccagtttttacccattcagtatgatattggctgtgggtttgtcataagtagctcttattattttgagatatgtcccatcaatacctaatttattgagagattttagcatgaaaggctgttgaattttgtcaaaggccttttctgcatctattgagataatcatgtggtttttgtctttggttctgtttatatgctggattacatttattgatttatgtatgttgaaccagccttgcatccctaggatgaagcccacttgatcgtggtggataagctttttgacatgctactggattcagtttgccagtattttattgaggatttttgcatcgatgttcatcagggatattggtctaaaattctctttttttgttgtgtctctgccaggctttggtatcaggatgatgctggcctcataaaatgagttagggaggattccctctttttctattgagtggaatagtttcagaaggaatagtaccagctcctctttgtacctctggtagaattcggctgtgaatccgtccggtcctggcctttttttggttggtaggctattaattattgcctcaatttcagagcctgttattggtctgttcagggattcaacttcttcctggtttagtcttgggaggatgtgtgtgtccaggaatttatccatttcttctagattttctagtttatttgcatagaagtgtttatagtattctctgatggtagtttgtatttctgtgggatcggtggtgatatctcctatatcattttttattgtgtctatttgattcttctctcttttcttctttattagtcttgctagcggtctatcaattttattgatcttttcaaaaaaccagctcctggattcactgattttttttgaagggttttttgtgtctctatctccttcagttctgctctgatcttagttatttcttaccttctgctagcttgtgaatgtgtttgctcttgtttctctagttcttttaattgtgatgttagggtgtcaattttagatctttcctgctttctcttgtgggcatttagtgctataaatttccctctacgcactgctttaaatgtgttccagagattctggtatgttgtgtctttgttctcattggtttcaaagaacatctttatttctgccttcatttcgatatttacccagtagtcattcaggagcaggtttttcagttttcatgtagttgtgcagtttttagtgagtttcttaatcctgagttctaatttgattgccctgtgtctgagagacggtttgttgtgctttctgttcttttacatttgctgaggagtgctttacttccaactatgtggtcaattttggaataagtgtgatgtggtgctgagaagaatgtatattctgttgatttggggtggagagttctgtagatgtctattaggtctgcttggtgcagagctgagttcaattcctggatatccttgttaaccttctgtcttgttgatctgtctaatgttgacagtggggtgtgaaagtctcccattattattgagtgggagtctaagtctctttgtaggtctctaaggacttgctttatgaatctgggtgctcctgtattaggtgcatatatatttaggatagttagctcttcttgttgaatggatccctttaccattatgtaatggccttctttgtctcttttgatctttgttggtttaaagtctgttttatcaaagactaggattgcaacttctgcttttttttgctttccatttgcttggtagatctctcttcatccctttattttgagcctatgtacgtcactgcacgtgagatgggtctcctgaatacagcacactgatgggtcttgactctttatccaatttgtcagtctgtgtcttttaattggggcatttagcccatttacatttaaggttaatattgttatgtgtgaatttgatcctgtcattatgatgttaggtggttattttgcccgttaattgatgcagtttcttcctagcattgacagtctttacaatttgtcatgtttttgcagtggctggtaccagttgttcctttccatgtttagtgcttccttcaggagctcttataaggcaggcctggtggtgacaaaatctcccagcatttgtttgtctgtaaaggattttatttctccttcacttatgaagcttagtttggctggatatgaaattctaggttgaaaattcttttctttaagaatgttgaatattggctcccactctcttctggcttgtagggtttctgccgagggatctgctgttagtctgatgggcttccctttgtcggtaacccgacctttctctctggctgccctttacattttttccttcatttcaactttggtgaatctgacaattatgtgtcttggagttgctcttctcgaggagtatctttgtggcattctctgtatttcctaaatttgaatgttggcctgccttgctaggttggggaagttctcctggataatatcctgcagagtgttttccaacttggttccattctccctgtcactttcaggtactccagtcaaatgtagatttggtcttttcacatagtcccatgttatttggaggctttgttcatttctttttactctttttttctctaaccttgtcttctcactttatttcattaatttgatcttcaatcactgatatcctttcttccaattgattgatttggctattgaagcttgtgcgtatgtcatgaagttctcgtgccatggtttttcagctccgtcagggcatttaaggtcttctctacactgtttattctagttagtcattcatctaaccttttttcaaggtttttagcttccttgcgatgggttagaacatgttcctttagctcagagaagttttttattaccaaccttctgaagcctacttctgtcaacttgtcaaagtcattctccatccagctttgttctgttgctggcgaggagctgtgatcctttggaggagaagaggcacgctggtttttagaattttcaggctttctgctctggtttctccccatctttgtggttttatctacctttggtctttgatgttggtaacctacagatggggttttggtgtgatgtcctttctgttgatgttgatgctattcctttctgtttgttagttttccttctaacagtcaggtcactcagctgcaggtctgttggaatttgctggagctccactccaaaccctgtttccctgggtatcaccaatggaggctgcagaacagcaaatattgctgcctgatccttcctctgggagcttcgtgccagagggtcacccgcctgtataaggtgtctgtcggcccctactgggaggtgtctccagttaggctacatgagggtcagggacccacttgaggagcagtctgtcctttctcagagctcaaacgccatgctgggagaactactgctctcttaagagctgtcagacaaggacgtttaagtctgccaaagtttctgctgccttttgttcagctatgccatgcccacagaggtggagtctatagaggcagtaggccttgctgagctgtggtgggctctgcccagttcgagcttctcagccactttgtttacctattcaagcctcagcaatggcggacgcccctccccctccaggctgcagcctcacaggtggatctcagactgctgcactagcagtgagcaaggctccatggccatgggaccctccgagccaggcacaggagagaatctcctggtctgccagttgctaagaccgtgggaaaagtgtagtatttgagcgggagtgtcccgtttttccaggtacagtctgtcacggcttcccttggctaggaaagggaaatcccccaaccccttgcacttcctgggtaaggcaacgccgtgccctgctttggctcaccctccatgggctgcacccactgtccaaccagtcccaacgaggtgaaccaggtacctccattggaaatgcagaaatcacccatcttctgtgtcgatcacgctgggagctgcagaccggagctgttcctattcggccctcttggaatgaactgagttcacatctctttagaggtttcagtttagccttattttgctgtggcagctcagctcaactttgtccttccatgggcctgtggtgtggggcaaggtggttggatttcaccagtacaacatatctctgttttcctatattatttttagcttaagattttgtcccagtgtacatcgtgggtgcacatattggtttttaatggattcaaataactaacattttaaaggaagagacttgaggcttctgatgtgtgaaccataacaatccaccagcccctaaaacattgctctttggagtcttgttttcagtagttcagagctattcttctgtatgtctgtgtggtaaagtagacataacagaaaatgtaccatcttcaccatatttaggtggacagttgagtggcattacatgcattcccattgttgagtgaccatcaccccatccgccttcagaactcttttcctcctgcagcactgagagtctgttcccatcagcagtcactccccactcacagagcatttgtccttttgtgtctagcttatttcactgaccataatgttctcgaggttcacgcatgttgttgcatgtctcagaacttcattcctttttatggctgaagaatatgcccgtgtgtggctagaccatattttgtttatctgttcatctgtcagtggacacattgctgctcctaccttttggctgtagtgattaatgctgctgtgaacatggatgtacaaatttttcttcaagtccctgcttttagtttttgggggtatatgcccagacatgaaattgctggatcctattgtaattctctgtttaatttttttgaggagctgccatactattttccacaacgtcgcaccattttacatgcccatgaacaatatatgagggttccaggttctccacatcctcactgacacttgctattttctcttttctggcttttgataatagccatcctaataatgggtgtaaggtgacacctcactgtggttttgatttgcattgccctgttgattagtgacgttgagcatcgttttttattttttgttttttgtttttttgagacagagtcttgttctgtcgcccaggctggagtgcaatggcggcaccatcttggctcactgcaacctctgcctcccgggttcaagtgattctcctgcctcagcctcccgagtagttgggattacacgcatgtgccaccacgcccagctaatttttgtatttttagtagagacggggtttcaccatgttggccagtctggtcttgaactcctgacttcaagtgtttcacctgcctcggcctcccaaagtactgagattacatgcgtgatccaccacgcccagcctgttgaacatcttttcatgtgctttttagccatctttaaagtagatcttctttggagaaatgtctattcagtcagagctattctcaatgtacattttaacccaagcgtatatcacatggtgaatttaggtgagtaggcaggggacgggggttgcctatgggatctgactcatttgcgcggctagctctgggtactccaacccatagagacagctaagctgtcaccaaaattcttatctgactcatagtatttacaaactttaaaataattggtatataatttgagacaaaggagattttgttttgacaagaggctggtttgcaaagaattgtgtgattattgtttcagcagtacagctccgttggggtgagacatgtttcttctttgacctcctacatcctcctctagcaaacgaggagaggaataggctctaaggcttcttgcttttgctagtcatacaaggggacttgtggaattggcagctctgctatttggatttcggcactacaaaggatactcgtatagtttgctgggtctgctgtaacagatgaccacaaactgggtgacttagaaaagcagaaatgtgtctctcacagttctggaggccacaagtccaaaatcaaggtgttgacaaggttgtgttccctctgaaggatccaggggagactcgttcttcattgtttccaccttctagtggctccaggtgttcctttgcttgtagccacatcactctaacctctgcctccatcttcacatggcctcctcctcttctccctgcctttcccctctgtatgtctcttataagaccacttgtcattggatttagggcctaccaggcctccaaggacctctattggcccattcttttcctacttttcatgcaaaacttaaggctacgggagcagttaaagttactttttggttcaagaagaactgaatgaagcatttggtgttagtcattatgctattcattgaatgaggccaaagaggaaatgattctttccacccaagtttgcttgcgagtcccagtctttctttacactcctgccccatgctgtcgctgtacacctactttacaaagcatgtccttggttgtttatttgttagccagcatctagttgttgcgacaaccccaggagttagcctttaggcaggacctgggagccgtttccaggacagataggacagcccctgcctgcccaagcttataccgcatggcagcagattagataggggagaactaaagtggtggagagagtccaaaggcagcccaagaggaggcataggcagggagactcctgcacaggaagctgtgttacaatgataataaaattagctgccttgaatggcgtgttgacaggtatttgacacaatcctcataatgaccttatgaggccatttactttacatatgaggaaaggcaagctcagttcttttaaataactcccccgagggctacctgctggtaaggaatagtagctgggatttgaacccaggcagccgactctgggttaatttattgccagctgcactgaggagtggcgtgatttgtgatttctcatgtgtagagggtgagcagaggcttacaagagcagaactccacaggggtgggcttgcttagcccggctggcctagttagcctgtcatgcggtcctgtcactgccccaggcacacgcccctcagatcccctgccagcagaggtcaataaggccttggtggggtcagaggccagatgtgagccatctccttgcccctgtagatgccatgtgccttttcatttgctcacatttccctgaatatctggggaatctggataagaagccagcagtgggcattcgtgattatatcatcactaaataacagtcacttgccccactgaagcccctgcaccttagatgggatatgcatgtatgcgatggagagcagtatgggagctctggtgggtgtgcccacacatggtagtctcatgacccccggccgatatgtgagtgcccactttgtgctgggcactatgcttcatgcccaagttgcaacagtgggcaaggctttggtgcaaggtgccaaaatccttgttctctagctgctttggtctagatacacattgagtcccagtgagttcaatatcagccacatgtctttcgaatgaacagttgacagggcccctaccaatgtgaaggggattctgggataaagggagggacagggcaggcacagagctacagattgacttcaatgcattctaaaaatggccatgacaagtcaagttttgacatacagtttcttaataacttccattatgagttcagaaaaatgttcccccaaatggctcctccagacattgagggtcctgcatccatttcaaggccattttggctttctacatgcccgtaaagtctgtccccactgggacacatgatcatgcccattcgttaaaagtggcaaggagtgtaaaattcgaggtgtggggttggattggagcaatcacagcaggtggaatcccagtgctgcctgccacctcctcactgaagtgttctgtgaatctagcctttcatgagcaaagttagactcttgtcttgtcgtgggttttgccatctccagatgttaggggagccatgactaagtaaattggcaactaccaagaaaacatggatgcaagaccaaatacatcatagtcaagtggcatctttgtgtttgcagttcagtatcatgggtgactgaggagaggagcaccctaagggctgtcactaaagccatactcctctgtttggcaacgttgtcggattttattgctaccgtctccctgctgtgaactgctgggtgcccactgtactctgatcacttctcaagggtttctgatggcccaagatgctaagttcctccacgcatcgtcagggcggctttaacttagccaagcaggagagctccgtctcctattgcactccactcatcccccgtcccagcatcccatgtcctgagctcctagacatgagcccttgtgcccatttcattgatgggaaaactgagctgcagcaaagggaagtgactggagcaattccgtacagttcgtgataggcccagagcaggactccctaggtgtgggcactgctacaccctaatgagcaccacaggggaaatccacgctgactgaagcgtgggagagccatggaaaaagctacaatgccaaagacgttttttatgttgtcactgataagtgagctgatttaactggcctcctgtgcgcctctaatctaacagtgtggtgagtcataggcccagtcgttggccccgttagccgggcatggtggcagacacctgtaatcccagctactcaggagcctagtgtcttgtcgaacagctgtcgctatggttcagctatttgtaaaaacatgaacggggggatggcatctgcccaaaacactaacaactaaagatgttttgacttaggcaacattaatgtctgtctctaactatgtctttaagaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggtaaggagaaagttgacacgtacataccaacaggctgatactatttacctgtgggtgaaaaattgtatttgtacatgtattaatcaatgttgggtattttttatgtaagatatatagctttgtttaagatgtgtcagttacttattgctgtgtaacaatatcagaacacagtggtttaaaagaacaaccatttctttgcttatgactgtggtttcggctgagcccagctggggtgttcttggatggtctcccctgggctcttgcatgtagttgcaatcacatggggaccccttgaagcatatgctcccaggtggccttgctcacacctctggtagtaactggtggctgtcaactgggcaccttggtttgccttcatgtggcctccagtagaccaggctgggcttcctagtgaaatggcagcagtatttattaggcctaagatttagtgtcgcaagtctcagtctgagagaggacttgaagaaattgttgagcctggtcgttgtcaggcttcctggagattcttcacatcagtctgcaaaggtttgctttgattgattcttaatcagtgctgcacttcaaaaatgtggctgggcacggtgtctcacacctgtgaaatcccagcactttgggaggccgagacaggtggatcaccagaagtcaggagtttgagaccagccaggccaacatggtgaaaccccatctctactgaaaatacaaaaaattagccaggcatggtggcagacacctgtaatcccagctactcaggaggctgaggcaggagaatcacttgaacccaggaggtggaggttgcagtgagctgagatcacaccattgcactccagcctgggcgacagagcgagactctgtctcaaaacaaacaaacaaaacaaaacaaaacaaacaacgtaattacatcaagacaaaatgtgtttatatcaaatgttaataggttcaagatccctaagaggttatcatgggccgtgaaatcaccctgtatttggtgtagaactcagagtcaagcctcctctgggcctctgtggttgaagccacgtgccatctgcagttcctcatttatgtaaatttgggttttatggctacttggcagccagcaaacaaaggtggattccaatggttatagcaaactgccattttcagctagtttcaaatttttgtgtccttcgaaataacatttttttctctcattagtggactgattttataagaagtaaaagttctaaatttagactactaaaacaaaaagaacacatttgtcttaacttactatacgttctgcataagacctctctgagaaaagggtcccactgctgacaacaaagcaaaacaagaagggttggaaaaacccagcgccctagactattctgttatctcaagattctattgcaattagattagtttgcctaaatggttttttttctttttttttttttgagatggagtctggctctgtcgcccaggctggagtgcagtggcgtgatttcaggtcactgcaacctctgcctcccggattcaagcaattctccctcctcagcctcctgagtagctgggactacaggcgcctaccaccacacctggctaattttttgtatttttagtagagacgggatttcaccatgttggccaggctggtctcgaacccctgacctcaggtgatctacccaccttggcctcccaaaatgctgggattacaggcatgagccaccgtgcctggcccctattcttaacactgtctccaagaggttgatcttataactcacctcagtaacccattatggagtcttgctgtttccagtcttgagttttatacttgattgttagtacatgttcattcttgtccactgtggctgtgagaagtaaaaagtggtcatgaaaagtttcatgtgatctcctgtaatcacacagcattataggtatgattatcacacatttgacttccctggggtaaaggccagtttgattcccatcactacaagggtctccagggaacagccattggcctactcatcccaaacattattgatagaacatttcaatatcataaaataatccacgtcacattgtccaagagtagcgtactgattagtcacaattaaaatcgtgaaatgaaatcacactggactaacagcaaggttgttttttgaagagattagcaaccttttgaaacacctgtaactagagatgccaaatgaaataaacaaggcagtctgaaatctttcaggatgctttagtaacatatctagttctgactgtctttgggctcagccagacttttagtaaactgcagaaatccaggttgggaaacaggcagctcagagttattctaaatagctacagtttgcctgtacagctgacttgggaggaggggagaagaaagggattgctagaaaagggattgatgtgagttttgtatttaatttggctatgacttgaggaaatatacatctcagtccaggtgcaaatcatgtaacctggtatgattacatgtgtttaggaataatcagaataaagcctagaaaagaacaggttgggaagttagttttgggtggtagaagaatggtgaggctgattttgttagtagattgcacatggacagatgaaggtaaagtacagtgccagctccagctgggcctggtggaatccagtatgagtgctgtttcagatgggacaccccaactgggagggaggtggatctagagaggatgtctggccctggcatcccttgagtctcttgcatagctcaattgtgttgatgtttaaagaataagtagggagatttgtttgttttttaaatctagaacataatttctttaagatctttcatttccacaaacccaagttggatttactgtatatgagctaaggaaattggaggttgtcatcttaaggaggcccagatacagttttagaaagaccctagggaggagggatatcacaggtcctcctcacagacacccatagccagcttgtctggtgtgcagcagccacagtttggcatcaacatcctgaaatgagggtatttaagtgcctgcatgtgctactgtgtcctttcattatgcccagtcaccagagttggaattacccaaggaatcgtgtgtgttgtggaggctgagacataaacaccatggctctccccatttcttcaacttccttgtagttcggaggagggaaagcagagccctgggctcatccatcctcactgcagccccaccaggagatcccatcaaggcggtcttagatttctaggctgaggcaagaaggggttgggcgatgagcccagagccacacagcccagccctgttgtggccagagagggaaagggactgactttgtcctgcaagtatggagactgctttcttctttctgttgttttcagtgcaagctatcagctaccaaatggctgccgttttgttttgttttgttttgtccttagagaagcgcccagggatcagctatcgggaacaagaaggtatcactgttttttggggtattttttagattgtccagttttggtcataggtggtttgatttcctttcactgaatacaaagcatggatcttgtcatcaaacccaaccaaagtcaatctcagtgtcattcgctatctctcttccctccttactgatcccaggagagaaggttagggttgcactagtgatggaacaccaggatgatataaagcttccaacttggctcaagaagagttccaaacaaacaagtatatctgccattgcagtggctcatgatatgtaagtctggactctgtagcttccagtcctcactaccctggtcttccccaccgttcctctctttccacaggccaagagatgcacagtgatcgggggctctggattcctggggcagcacatggtggagcagttgctggcaagaggatatgctgtcaatgtatttgatatccagcaagggtttgataatccccaggtgcggttctttctgggtgacctctgcagccgacaggtaatggaccatgcagccttgctgatttcccacgagcccacgaagggaaaccacgatacttcccttgctcagaagccagccaatttgtttgaaaaacaattgtttcattgtgaaaattttcaaagttataggaaagaacaccacattcttactgcttagaatgaataaccatcatctctgtcacagatactcagctgtgtcctggtagcacaaaagcagccatggtcagcacttaaatgaacaaatggctgtggctgtatgccagtgaaacttgacttcaaaagccgtccatgggctgtattgttccaactgcaaaacaagtgtgtgctgggccacagggtcttgattttttaattgagatataattcatgtaccacaaatttcacatttttaaagtgtgcaattcagtgattttcagtacatccacaaagctgtgcaactgtctcccatgatctaactccagaatatttgtattaccccaaaatgaaatcttgtagccatcccctctcttcccctcccagcccctggccgccactcatctacttcccatctatggattggcctcttctggacatttcatataaatggaatcatgtaatatttgtacctctgtgcctgacttttttcacttagcatgatgttttcaagcttcatccatgttgtacaggtatgaatatcttgaattttattagatggtgccaaatggctcagcaaagctgctatgtcaattttacctccatatccacagtgtggcacaagccccattgcttcacatctttgccaacactgggcataactagactttttggtgttgccattctgagaagtatgaagtggtgcttcactgatgttcagagtcacatgtcctccctgaccaagtaaccagccactctgccactgggtgatcggctttcaggcttcctcctgtgtgaaatgtttgtctgtgtcctttgcccctttgtctttggggttacctttgcttccttgttgatctagttgggatgccaatcctgtgcccgttgtacttattatggatggcttccctcagcctgtcactgggcccttattcttggctttggtgtcattcgctatatggtttgttgatgaaatattaaggccattgcttccgctgcaaagttacggttgttttctctcccgtgctgcccacacctccaggcctggagatggggtagacatctttcatgctcatcattgctgcctccgaaccgttctccctcatgctgctctaagcctctccagctttgaagaggataccctcagactgtacaaaccccgacaccgttccctccttgtggtggccacccacagccgcctgctccccttcccagtgactccacatcatttctcagtgatttcagctcctttctggcattattattggtgaattcagcgttcatgtagatgaccctaccaatgccctcgcctctctcatccttggcctcctctcacccaatgatgttgccctccactcccctgtcatcaccagtaagcacgtcctctccttcttctcagttgcaggcattctactctgagcactagctcctctctgtccagctcatgccctctagtgcctcagctgtcccgattccttaaccccacccagacatccagccatgcccaccatggctcagcctgttcgtgcctcactgcctttagttccctggtctgcttgttcgcttgcatagtcttcaccccttcccctttctcttctggttgtatgtatccataaagtttctccagagaaacaccagcagggggatgtgtggagaagggcaaggagagagatgggtgggtgagacggagaaagagaggttgagatttaattcacagaattggtttacatgattgtgggggctgactaggcaagtctgaaatttgtagggcagaccagaaactcaggcaggaattgatgctgtggtcccacgttagaatttcttcttacagaaacctcagtttcacttttaaggtctttgaactgagtatatactgcctgtccagagtagcaagggtaatctccttacttaaagtcagctggttgtagatgtcaaccacagctacaaaatacctctacagcaacacctacactcgtgtttaatggagtcaccggggattagagcctggcccaggtggcaaataaatgtggccaccacagtgtacttcacattgtaacccccaccctggttaaatcttgccttgtgcatggccatggccctcaagcagacccttggtaccaccaagcaccatctccacaaacctgcccacatccacgtctctactcagcctcccctgctgttcccgaggacgcctcatccccaccaaagtgcccatcctggtgccagctggaagccacctcctcttccctacccagtcactgccaccagggaccttgaggcaaccatatctggtggttgaatctcagtcctcctctgacttggccctgtagcagcatctgatgctttctttgcttgccttctgagataccacctcactcatttctcctcctgcctcactgattgtctcctgatcactatcatttctaaactttgcagactccagaacttattctcttttcttctccaagtttagacagtgtcacagtgactccatcccatctcatggattaattactgtctagaagctgatgtgctccctgcttgttatctccaacccctagctctctcaggcacgtgtgtgtgtgtgtgtgtgtgtgtgtgtgagcgtatgtgtgtgtatgcctgctggacatccctgtttggatacctcatggacacttcaagcttgctacatccaaaattaagctcctggttccctgacgcaagcccctcccccaccacagcaaacctatttctgctaagtcttctctatctccataaatggcctactctgcttttccagttccatcaaccaaaaaccttagattcatccctgcccgattcctttctctctcatgcccttcatcccatccatcaggaaatcttgttggctccactcagaatagatccccaatccaacaacttctcaccccttccattgctgccaccctggtccaagccaccatcactgtctcacctagatgttagagggactcttaatggataaatcagatcacaccgccctctgtacagaagcctccagtggcgtccagtcccatgtcaagcaaacagaggcctctgtaatcacccatgaggccctgcacggcacgtccccactacctgtctggcccacttcctcccacacccgcctcatggctctgccccaggcacactggccaccaaccaagtttctgcctcaggacctttgcacttggtgtcctttctgtcaggaatgctcttcctgaaccacagaacttgctccctagcttcctgtaaatctccagccaccctgtgctaaggaacaggcccccgctggtctcccttactctgctctagtttctgcataacacctgccagtacggacgtcctctagatttacttgtttgtttgcttatttgtcctgattgaaacatgattgaccatgagcggatacagagcagaggaaatctctgaaatttgtcctctctaccatagaatgtaaactccacaaaagcaggaattttgtttttcgatcactgctttgtcccctcaaaggagacgagaatccttagcaagctttcacttctctccaaaaggctcccccgctgccatgctgttgttgctagtatgttatttcagctttccttgagtacagatttcaagggaaccctccagcatgccatgttgttctccagccacactcaactgctcagccgcaagcgtggagaaggggcgagttgcatttaaccagggttggagtttactagacaaatttaataaagggagaggggaacaaggcaaaggtggtgctggtggatcatgaaatctaagctaagtccaaggtcgatgtgatgtgggtgaaagacatggcaggagaggaccttttttattttattttattttattttatttttatttttatttttttagacatagtcttgctctgttgcccagactgtggcacaatctaagctcactgcagcctccgcctcccaggttcaagcgatgctcctgcctcagcctccctaatagctgggattataggtgcccaccgccacacccggctaatttttgtatttttagtagagatagggtttcaccatgttggccaggctggtcttgaactccttgtatcaggtgatccgcccgcctcggcctcccaaagtgctgggattacaggtgtgagccactgcgcccagccgagaaggacttttaaaatgtactttcacctgggtgtggtggtatgcacttgtagtcccccagctatttggaaggccaaggtgggaggatcacttgaggccaggagttcaagactaacctggactacataacaagaccccccccatttctttttttttaaaaatgtgtttttatagtcagtagagagagagagagagagaggagagagacagatatacatacatatagataaagtttatgtatatatagttatatagttttatacacacaatatgtattacataacacttttttttttttttttgagacggagtcttgcgctgtcgcccaggctgtagtgcagtggcgtgatcttgactcactgcaaactctacctcctgggttcaagcaattctcctgcctcagcctcccgagtagctgggattacaggcgcccaccaccacccatgactaatttttatattcttagtagagacagggtttcaccatgttggccaggctagtcttgaactcctgacctcaagtgatccacccgcctcggcctcccaaagtgctcggattacaggcatgagccaccgttgccaccgcgcccggcccatgacacttttaaagtcacctcggtcttgtgcatcttttgttgctgacaggaagtctactctcaagccggtcgttgttcgtttgtaggttgtctggctttccctcttatggtttttaggattttattttttatcatttatagtctatagagaatatatctgggcctgagttttagttttgattttaaatcttaacacctggtaggcctgtgcaatctgaagatgaatgtctttcctcatttctggaaaattcttcaaagattaactctaccccttttctctcttttctctctttctagaagccgtgctggacatatggtggtctttcattgtatcatctgtctcttatcctctctttcttgcattccttctctttctctttttgtactatttcataggagatttcctcctccctgcctctgctcatggccaatcgtgtttcacctatattcctcctcagattatgttgaagtcaatcctagacatcatatcattttatctgcaaatatttcagtatttgtctctaaaagataaggattatttttaaaaacattgacagtagttccttagtatctagccagcgttcagatatccctgaatgtcttataaatgtttttgtattattgtttttccaaataaggaaccaagcaagatcaagactatggatttggttgaaatatttagctctcttttaatttacgattcccttcatttttttaaacttcagtctatttattgaataactgatgtttagtagaaaccatgtttatggtgctgtagtatttcccacagtctgggttttgccgattacatccccattgcgtttaacatgcccttctgtcctccagtattttctgtatactggtagatctgggatggcgctgtccattaaggcagccattagccacgtgcaactattgggcacttaaaatgtggcaagtcagaattgagaagcactgtaagtgtgaagtccacaccagatttcaaaaactacctacagaaaaaaggaatgtaactgtctcattaaagttaatttcacctttttctttttactttttaatgtcattactataaactttaaagtcactgtgacttttattatgtttctactggactaaagacttgatcggactctggttcagtttttccctctggggtattattacttctgatactccaatagtaataagcatgcctagtgctcagatttgggtttctatataccatttcccataaaaagaactagggcttcttgggaaaattgctcattctaggaccctagggcaagggcagtacaaaatgagtctgggacattttcttagcacaaaatgaatggggacctgccaagaagatacaagagccaacttgaagggcttcccctggccaaatttgggacattttgagcattttgagcctctcaaaacataacagtagtggatgacaatgcattttgatttcaaaaagaatccgtgggctgggtgcagggctagcgcctgcaatgccagcactttgggaggccaagacaggtggatcacctgaggtcagaagttcgagaccagccttgccaacatggtgaaaccccatctctactaaaatacaaaaaaattagccgggcatggtggcatacgcctgtaatcccagctactcgggagaatcgcttgagcccgggaggcagaggttgcagtgagctgagatcatgccactgcactccagccttgccgacagagcgagacaatgtctcaaaaaaataaaataaaaaagaatccatgggtccatagaaatactgaaaataacaattggggtcagggagaaggggaagctctacagaggaatgccaactaataaatgtaaaggccatgaattaaaaggctagacttagaatgtcaccattttatacccagtacattgattattgttccaggcaaggactatcaataaatgctgaggttaattggtagaattaacatgctacagattacttatcaattgcaaaggaaaaggtacctttttgatggccggaatctggcagccatcatcatcaccacgtgctccaacttaatatcaccaaaagtgggacagacttgcacctcctgaggtaattccctgagaaggacacaccaccactgatgtggtattcttgccaaaaccattaagcctgaatctaatcttgaggaaacagactaatccaaactgaaggacagtctataaaataacccaaacccttgaaaaatggcagcattaaaataagacagaaaagacgggaatttgtctcagattaaaagagatggaagagacctgaggactaaatactacatgtcatgcgcaattggatcctggaccccaaaacaaaaggctataaaagacattactgggacaattgggggaatttgaatatagactaattattggataagaacatcatatctgttaagtttcttgagtgtgatcattgttttatggttatttaggagaatgcttttgttcttaggagatacctgtgaagcgtttagaggcagcatgatgtctgcaacttacttgactggtttcaaaaaaaaaatcatgtgattgtatgtagagagaggaaattgtggcaaaatattaattggcacataattgtcataattgtcttttggtgacaaacatgaatcatacttagatcatattacttaattaaggtttgacaaaatgatgacatgctattagtcttcatttagtagctccagtctttataccttaatgcagaataaatatttgattctttccctttatttacctgaatttttattcttgcttgtggtcaagctgtcccttctttgcccagtgggaacctcttcaggttggcacttgagtgcttttaacgtgaccccggtagtcttagctagctagcatcctcactctctggtacaaggtgtgcctggttcctcttgtgtgtttcctgtcccagatctgcaatcagccatttctctcaggagctcttgttccttttagcagtaaatcaaacagacctgttttaaaaatccctttcaggttgctgtattgtgtcaagtttcacaggaaggaatatgcctgtgtattggctatttactgtctttaatggtgtggaactttttcatgtgattcataatttctatctgagttcaccttcctagggagttttacctcctaggtgcctgctctgaaccacccaaaaggatgttgcctctgtgtggatcccacaggcttctcatgccccaaaccccttttgactggggactagttagtggggagaaggtgattaaagggacaacttggtttccatcccatgtacttcggtatcattgattcttttatgagaatgtatttccatattgattatagaattataagacaaggaacctacaagccacaggttggagggtgaaaacatgagaatgccattgacctgtcaaagcaggaatgattattttgtctttctttgcttttccaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcaggtaaggggaaggctggagtgagtgctgtcaggagcacgtgatggccctttctaagggtgcaaggccgtagttcttgcagtctccctgggcctaggcggggttgcttcttaaagtgttgggaagatcttagaaatgaagcccttggagtcactggagatggtgaaggtctgcttgccaaggctgatttgagatgtaatattctaactgcacacaaatagaacatctgaggacctcaagcctattggccttcagttaaagagctgcagaacttagacattgcttatatttttattgtgataaaatatatatcacatacaatttaccatcctaaccatttttaagtgcggagttcagtggcattaagtacactcacaatgttgtatagccattaccaccatccatctctaaacctttttcttcttccctaataaaaactctatacccattaaacagcaactcctcaatcgcccttccctacccagcccctggcaactacccttctactttctgtctctatgggtttgacaactatagggacctcacagaagtggactcatgtagtatttctccttttgtgtctggcttttcaccgagcatgatgtcctcaggggtcatccatgttgtagcatgtgtcggaatgtccttcctttttcaggcagaacaatatttcattgtatggatgggccacattttgtttattcattcagccatggatggacatctgtgttgtcttcaccttttggcaattgtaaacaatagtgttatgaacacaagtgtacaaatatctgttcaagtccctgttttcaattctttcaggcatctacccagaagtagggttgctagatcatatactagttctacgtttaaccttttgaggagccaccacattgttttccagaccttgcttatattttaaaagaaaagcaaactgtgtttacccttagccaatagaaacgtgttataactcaggcctgaggggatacgaattttctgcccatcatagcttgctgcatcgttaccaatcctggttcttagaattgtctttagaggactccagccactggctaaaacggctccctgtcagctcagtatcctgaccctcacagggatgcatgccacaggtactgcataaattaagagaaaaacttgaagcaagccagggggttcctctcccaacaacctgtcctggcactgttggctggtccgcagcatcctcagccggcccagcagggttggagctcttctgggcttgggccctggaaaagatcacttataactgacccctagcagttgacaagatgctttgccctgctgaagttttcacctaattagctcctcgttgggtgaccaggggctaaacgatgtctctttgctagtaaatgggagaggtggggtcaaagcagattctccaagtcccagactctgcactcagccatgctgatgtaactggagccctgggaagggccctgctgctctttgttaaatggaaggttgggggcatacaacaaagatttgtgccccaggtgtggcggctcacacatgtaatcccagcgctttgggaggccaaggcaggaagatcccttgagccaaggagttcaagaccagcctgagcaacatagcaataccccacctctacacgaatttttaaaagccaggtgtggtggtatgcacctgtagcctcaactgtttcgggacgctgaggcaggaggatcgcttgagcccaggattttcaggctgcagtgagctgtgatcccaacactacaccccagcctaggcaacagagcaagaccttgtctcttaaaaaaaaaattaaaaaaacaacaagatttgagaataaaacagcacctctccactcaccacagcatttaagaaacaacattactggcatgtgtaatgtgtgcccatcctcgatgccattgctctcttcttgtagccatggatagcaattctgaatttgggtttatttccatttgctccatgtgtaagcaatataaagtattggattgcatgttataagattttatacaatgatatcttattgaacagatcctcctgcaacttgcttttttccccagtgttatgtttttctttattcatcttggcatatgtaactctggtttatttactgaaggggcagagtggcttagtgggtaagagtgcagaaagtgattgctgtgttgtattgaaggaacattttccaacactgagatcaaaagattatttaatgtactttttttcctcaaaggttttaagtgttgctttccacatttcagtctttaatccaccaggaatttatgtttgcttatggtgtgagatagagatctaactttcttccatgtgtataaccagttcagtgccatttattgcataatccatcctttctgcatcgctgcacaccatctgcagcatgtcttaggtgtttgtgtcttacatgggcctgttcccaggctctcccctctgccccattgacctccctgtctgcccatgcagagaagctctgcctttttaggataagtctcagtgtaccgtagataaatcacgcccccaaccaatttcttcaaacttcacttggctattctgagccctttgttcttctacatatgtttggcttaaccagttccttgctaaagccagctgagactgctgttgtaattgtgttgaacttgtaggtaattttggagagaattgacatctttcccatattgagtgttcctgtccataaatatgggatatgtttctgtttatctcgctctttaatgtcatcaatagagttttatactttacttcgtaaagattttgcatatctcgttaaatttatttgtatgtacttcattttttgttatttaataactttctattacattttcagttattgctaatatataagacgagttaatttttgtatattgatttttaattcagcaactttgccaaacgctaatattttctacatatttgcctgtgttttctgtgtagatttttctctcatctgtaagcgatggaagttcagtttcttttcaaatcattataaattcgtgtttatcttaccctaccactctggctagagcttctcatacaatgttgaataagaatgggaacgatatgattcatgctaatggtgttcagtgttggatgagcttctcttaaccagcaggctggacgctggggaccctcataagagaatatcttcctttagaatagcatttcttaagaggtcgtgtggtgtgtgtattcctatgtgtgttcacatggccaggtcactatcagaatagccagtgatctttttcagacatcttcctagaagtttgcgggctgcccttcacttacaacagagaatcgctgtcatagtgagataccatgaatgcaagtctattctatctctcaggtgtgatgggatagaaaaaatgtgttatcccttgttttgaaaccaagatctcttgattcttggttagaatgtaatacatagtgtgtctggaatccacatagctgcaaaagatggtgatctttggattattttaagaaggcatgaaaagcaaaggcattgcagcaaataatttcttcagtgcctcgaatgcgagggcaacaaagggatgcccctgattctctttcatacaggatcatgcactgtttgaattgtgataatttgtgacttttattttttctgaccttcctctgtcagaaactcattttaaccagcagtgccagtgtcatctttgagggcgtcgatatcaagaatggaactgaagaccttccctatgccatgaaacccattgactactacacagagactaagatcttacaggagagggtatgtaccttggaactggttgagtgagcagactgaagggtttagaatcctaagaaaaatgtttatgaacttatgaagtttgtattctgaggcctacgtacctgatttgagatgtaaaatttgtgggtgaaattaaatttaaaaatactgtgagaggccgggcacggtggctcacgcttataatcccagcactttgggaggccgaggtgggtggatcacctgaggtcaggagttcgagaccagcctggccaacatggcgaaaccccatctctactaaaaatacaaaaattagcccagcatggtggcaggcgcctgtaatcctagccacttgggaggctgaggtatgagaattgcttgaacctgggaggcggaggttgcagtgagccgagattgtgccattgcactccagcctgggggatagagagagagagacgctgtctcccaaaaaaaaaaaagttactatgagaacagctttatgtggccagacactgttctgagtgttttccaggagtattttccttgtttaaaggtcacaattatcgcatcatcaccagattatagatgaagactgtggtgcacagatgcacagagaggctcagaacctttctaaaactgtgcagctaggaggtggctgaccccaggcagtctgtctacagagcttacagcccaccctcaatgccatgggagcttcctcgcctgctatgggaatttacagcagttgcaagcgtgcagacaggaatcaggctggaggcaccttcctagtggcactctcaccccctcccttacttagaaaaacaaacaacggaaggatcttgctttattttaaggaaaaagtacttttccacttggcaaaacagcttcatcaaagggcacctgattttagtatggttggattcagccacggtcgctaccaagccttcaggctgctggggctgtggggcccctgacaactgctagctgcagatggggattgtcaccctgaggccatcctaagctgcaggccaggagtgctcctgagcctgggatagctcgtcttagctgggtagctgtgagtatacccctcccaggtgtgtgcagtgtatcacacccactgaggttttctcgcaaagccggtacatgctgtactggagctgaacactgacctggctacctgagagccagctgcctcctggctgtttgccgtattttttttttttttcttttttgagatggattctcactctgttgcccaggctggagtgcagtggcacgatctcggctcactgcaacctccacctcccaggttcaagcgattctcctgcctcagcctcctgagtagctgggattacaggcgcgtgccaccatgcccggctaatttttgtatttttagtagagacggggtttcaccgtgttggtcggatggtctcgaactcctgacctcatgatctgcccgccttggcctctcaaagtgctgggattacaggcgtgagccaccatgcccagcctgtctgctgttgcttcagctcagaaagtcctggcagaactggtccacagggagacacaagggccacccagaccaggggtggaggcttgaactttggcaagccacagtcctggctccagactatgctgtcttgctccttggagcactcatgtgctcgaacttggcccaaggagtactaaagcctccctgcgccttgcaggcagttcagtcaccatggagaccctgtgtattctcaacccaatatgcctgattctgattgccaccagagctgagcccatctaggctcaggagcttcaaatgatggccttggcccagaccatcagtgtctcgcttatatcaacttttgggttctcaactggaaataagcaaagcctgcagatgactccagcagtaactcaccggaagcctcctttcagccgaggttgacatccactgttggctttataaccttcctactgatcataaaccaaatgtgatggggagctaggactccttcacctctcttccctttagtagtagagatgagccttggtggaagccatttgagggtttatttagtcatttcctccatcgctgtggggaccagagtcctggcgggaagaggagggccagctctgggaatctgttgagaggcagcttttccattgttgagttgcttaagatcactggggccaaaacatagaccagcactttgctaccatagagtagaagaaacccgaggtgacatgacagcaggaaccgtacttaccaagcatacagacacgcactgaagcaactcacatgggccatctcgtgtaattcgcatgcagccccgtcagggtaggtacctttatgatcaccacttttacccacgataaaacaaatcctttggaaagttttgttacttttgaggcgaaacccatttcactgtgctttagactcttgagttctagtttgtccatgaagtcacacagaagtcaccctttccttgcggtggcaacaggagcactggctctggaccaggcactgctctgaggactttacatgtctcggcctcctttgccccccagctgctggcctgtttctccccaggcatggtcttcagacccttcaccttctctgaccctcttctgggcccacttgggtttctcagagccctcccctcggaggtgatactcagaattgcctggaacagacccggcctggtggaaacgtgggcggcacatgcagttcaagtcactggaggctcacggctaacttgtttgccagaacctttggacgttttccacaaactgctgccgaggcatgtcttctggcagtgttggtggattttagcctttgaacgcaaaccagggccttctgatttgatcttaccagtttttgcccagctgtctgtcctgcattttcagattttggtgtgagggtgggtggggtagagaggtagcccagaattataccagccactgatgtaggttgtcagctcaaggcagaccactgctcagtggccacatgccagcagagtgtgtcatctgtctgtcccccacgagtggtgcttctcacccagcgaggcactctcttggcttgggcctaggaatttgcaatggacgtgccccttctcccactctcctccaggcagttctgggcgccaacgatcctgagaagaatttcttaaccacagccatccgccctcatggcattttcggcccaagggacccgcagttggtacccatcctcatcgaggcagccaggaacggcaagatgaagttcgtgattgggtgagtcagcccacagcggctcttccctagtccttcctggtccatgctcgcattcagagagcacttggcaggagccacatggcattgtagctcttttcttatgtgactgtcttggtccatgcaggctgctgtaacaaaatacctaagactgggtaacaaacaacagagagcttggaggctgggaagtccagatcaaggcgttcccagactgggtgtccattgaggccctgttcctcatgagtggcaccttttcaccatgtcctcacatggtggaaggggcaaacaggctcccttgggcctcttttatgaggacactaatcccattcccgagggcagagcccccatgacctaatcaccccctaaaggtccctcttcacagtaccattgcactggaggttaagtttcaacatatgaatgttgcggggatgcaaagattcaggcgatagcagtgaccttgtccgctgtcctctgtattcatttcttgtagttgccataacaacctgccacaaagtaagtgcttaaaacaacaaatggattctgtcacattttgggaggccagaagtcctcagttaagatgttggcagggctagtgtcttctggaggttcgcagggagcgtctgttccaggcctctgccctagcttctgctggcttccagccatccttagcattctgtgcttggagaggcatcactcctgcctctgcgtccctttcacatggctgtgttccttgctttctgtgtccaaatttccctcttataaggacatcattccctggatttaaagcccaccctaccccagtatgagctcagcttaactaattgcatctgccgagcccctatttccaaataaggtcacattcacaaggcccaagtggacagaagctttgggaggatactgttcaatccagtgtaccctctcaggtaggctgggaaggtatttgtgaccctgtttggaaattgaagaaaccgtgactcagagggaaagcaatgggccccgggtcaaaggccagggcttgactgtccttgcatctgggaaggcaggcgggggcattacttttctcctcgggttaagtgcaggtggaggggcctccacaggggacaacagtgtgcctctctcccaaataggctttctcttccttcatttcctccttttctcctctctctcttccttcctttttccctctgccttgccttcctgtttctcactcagcctcactgctaccctgacttgtcaccttgaaggattacagggagactggtcaataaacgggggaccagagcaaggcgttggccccgtgtctcctgggaaggggctgaaaagctgctacccaaatcgggacaggagagacagcaccagtgttggccatgctggaatgggtgggcaggtcccccagctttcagattccactaaccctgaagacccaggagtcccggcccagtgtacatctttaaccagtacaggcatccatgagtgcctgggccggccttgccaagtgaggtggcagccattctgtaggtcacagtctctcaaatgccaagacttgggagtggccctggccttcgtgcaggggctcccagcacgtattccatcatcccttgtgcacctgcagaaatgggaagaacttggtggacttcacctttgtggagaacgtggtccatggacacatcctggcggcagagcagctctcccgagactcgacactgggtgggaaggtaaggcctgctgcaccggtccctgcacaggtgcctttctgcgggtttcttctccttgccattggatttgctggcaagttgctcctgtgatcctgtatcatggaggatctgccttaggaccccctgtgccaagatcaagcccctctgatagagcatgtggtgtcactgcagcgtcacatcacttgggcagccaaatttggagagctgacgagctgggattgaacagacattcagctcacggtcatctatggtcccctgacctggctgcccacctgttggcatggctccttgtggcaggagcccacgtagattgggcagggtgcttgctcctcaccctttctcccactcattcctcaggtctctccctcccttgctgtttggtcctcttttattctcctgaacctctgccgtttccccactgataaccttcaaataagttgggaatagggtgggtgtggcattttttttttctttttttttttttgagacagtctcactctgtcaccctggctggagtgcagtggcgtgatctcggttcactgcaacctccgtctcactggttcaagcgattctcatgcctgagcctcccgagtagctgggactacaggcacatgccaccacgctcagctaattttttgtacttttagtagagacggggtttcaccatgttggccaggctggtctcctgacctcaggtgatctgcccgcctctgcgtcccaaagtgctggggtgacaggcgtgagccaccgcgcctggcccgggtgtggcttttgatttaaaacaagcagaacaccgtcaagaaatgtaatatgaggaattcattgcatccaaagatatgtagatgagttttatgatgattaacaattatcaaattaacaaatgtgcctttccaagtgcaatctatgcttcatttaaaatcctggcccatagatgaaactttcattgtctgccctttctatgccttagcagttgtgcaattgagggcaggccacgtggaaagctgcagcaattaggcagtgagaatgcgatctgcacgggcttaatagatgcttcaactttgggcaggtgggggtggtgtttctaacttcttgttcttgttctcccgccaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtctttttgtgtctctctgtttaccccctcccttgccccctcttctggtttatacatttcattccagtgtccttgtacataatcaaggaagctgtaggaagctacaacccatttgttagttctgatggagaaccatttccatgcagaccaatactagagtgaagcctctagactttgttcaagatactctatcttcaaaatatcccagaagaaaaacagaagctgttaacacacaggtgagactttacatatacatttcatactgacagtgagcttagagcaaaagctgaaagctgaaatgactgtaattcctccccagtctctgttgcttgttcaactccttacatgttccacattctctttcaggtacgttgccgtgcctgcctgcattgttttttgttgtggtcgttgtagagacagagtctgagtgtgtctgttgcccagctgagagtgcactggctaatcacaggcccaatcatagagcactgcagccttgaactcttgggctcaagcagtcctcccatctcagcctcctgagagcaaatgtgcgccgccacagcaggcttgcactgttttcacaaaacatttctcttatcaacagagttctgttgttttgagaggcaaggcagtgatccagcccagtggcaccctgtttcatctgttcagctcctctcctaatgtgggacactgggctgggcgacagtaagccagggagcaggaggggctccttccctgcagctcaccctcagaacccttcaggccagtttccaaagggcatagcgtagaggataattcctcggaatgaggagagactgtgctgccctctgctgatggggcagggggatataaacataaataagacagcctttgcccctaaggcacttagaatcatggacttaagatatgttcgcaagcccctgtaatgccaggcaggacatgatacacacacttaagacgcagtggtgaatgttcagcttctgtcgaggaggtgatgccttgagtcggaccttgaagaatggataagcagtgagacttcactgtcgaagttggcatttcaggctaaagatgtcagagggtcacagtcaatggcatgtcatagtttaattagcagcacgttgtgtttcttaggggtccatgagataacggtgtcttagattcagtgaaggacagacgtgccagcctggtttggctgatggtgcaaagctgaaggggatgtacttttatctcccaggcagtggtggccaagaatcaaggaaaccatcgtggctcttacgtggagccttcagacaagaagcaacaaaggcccacgcgatgatggagttgggcgggggcggtagggttgggggtagaaatgaagccttacaagaaatggcctggagggggtccgcgctcagcacctgatttcctgtggggagtgagagggagggaggaggccactcaggctggaatgaagccgcagagcagctctaagctggtgggaggatggtgtcgggcccggagtgggtgaggccagcagaccttgctgatgagcaccaaggaccaaactgccctcagcttcgacctaaccactcgctcagaaaaatactagctgccatctagaccaaagatgtccctcatggaacctcttctctgccctctcttcactcattagaccacagataatcgttgggccctgccctgcgcttcagtggtgaataaaacacgcagcccacagaccaatagattattcaaaactgctgaagtttccaaaaaagaaaagtgcagggtgctatgagagggacatagggctgcaagcaagcctggcccaggtggcgatcacggcagaacagttgcagaaacagtgcctgctcagatccgaaaggtgaggctgtgcacagagaccctgagccccccgctggccaagctgacgacctcccagccgctccttgtatttccctgcattcctgacccacacctatctcgacccacccgtttggagaaagtctaaccaccaggaaaccata

SEQ ID NO: 16416 - DNA, 48471 bp, Human
ggtgactggagctcaggaaggcagggagaaggcgccctggcaggtgcaccgtcacaagcaaaggtcctggggtggggaggggaggctgtctcgagaagacgaggagtccaggtgagagccgaaagctgccattgctgccttgaggggtcagaagtgggacacccagctgtcctctggctctgccacttccccaagccagcctcagtttcccgcatcagaaaagcaagggcaattcgtccacacagcacccccagaaggagcccgcctcacctgggacagcttcgcttgctgtcctggccccctctcctcagctttcactccttctagtcttttccccccaatgcctgtccccagacgccttgcctcacctttgccccagctgcaaccccacagctcttggccctcgggcctgctgttctccctgtcccagctagagagggacggggttagttgaaacttgttgagcacctgtcccagcacatcaagccagtgccaggcatgtagtagctgctcggtgaatatgtgtcaggtgaccaactgcaagacagggcggggagaggtggggagagaggacggcacaggcacatggccatcattttgtccccacatctcccagaagtgaaggctgcttcatgtgcaatgtgtcgcgagagtaaacgcgcaggtgcccacgcttttcaaacatgggtcactgtggatggatgtttcgtgaagtatccaccagggcctctcctgagaataaggccatggacttggccgtgtctgctttggctgcctgagggctttctcccctttcttcagggctctgggccactcgtttccaacggatgcttctgagccaggagcttccccagagacggggggtcagggccctgctgagctgccaggagggctcttggctgatgtcaaggccaggccatgtgcactgaggccatttcagttccatgaggatgtgacaggcttagctcgggccgggaaggagcggagagagaggagctgcagtgggccccgccaaacactgtgatggctgcagaaggggcagcctgggccctagcggatccttgggtaaggtgacggggacagggagagggatgacaactttgcgatgctcggcagagtggggccagggccgtggcctggatgctttcagtgtggggagactttggctccttactttgtcatctggagggaagaagagcgtggaggggagtgggtggcaccatgctgtgggctgggacgttggcagactcgccagcgacctgtggctgctttggctttctcctgtgtaccctctcctcctctcctcctcagccactccctttatcccctccctcttctccctccctccatccccctttccctccctctctttgcctttccgtcttgtccctctctcccctcccctgtttcccacccttcctctgggcctcctcctttcctcgcccctggccccccaggtactctcagggccacagaaaccgtgagccactaaggccacaccagaagaccaccagggactcatggcatgcccgctgcacagggcgcatcttaaccaggcaagagcagggagtgaaccggagtgaacaagcgcaggactggtggtggggcgcgggcaagaccagccactgatcagtcccagcacgctgccctcacttcagcgtgggttcccgaatggatctggggggcagtgacagcctctgcctccagctagctagtgttagccactgcagggtcctggcaggaggcatcgacacttcccctcccccacctgggcaagccctccaggttctgggcacccatggtgggcaggacccgggagtggcctggctggtggggcctggcagagcatgagggccactggcccagcctgggaggtgatttctgcacttcgagggtcatggcacagactgagtgaagatttgccgagaatattctggaagatgggacctcagttttgtctcaaccactcccctggcttcttctcgcctccatctccccaggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggtaagtccctctcaggctgcatgccacccagccctgctcccagccttcagaggagcgacctgaaggcatccttagccccaaggctggccagggtcaagggccacctgtgcccctcctctcagccatttcccttgagggggagatgccctgggtaacctgacctgaccccctcatctccacacctccacaatcaggagttctccgctctatagagcgagactggggagggggagatgggaacttcatgggacacacacacaggcggaatgggccccaaacagaaacccttccgaggaacagggcagggcagggcagggaggaggaagacagccccatctgtatatttggggatttccggtgtgctcaaccctgtgttcacttaagggggatcagaacaggaggaagggatgcagggtgcaagccttcggagtttcgggtgaccggggcctctcctgggaagagagaggatggcctggggatggcacaagccatttgggtctggcaggaaggggtgaccgaagctgggtcacgggaggcccagagtgctgatcagaggtggcactgactggccacaggctgtcccaaagaggcacaagcccagggtagtgtcggtctcactgctgagggaggctctagaaagcccggtgagcactgtctagaaagatctggggcggaggcctgactatccctgtgggaggcaatgttccacccggccttgtgaggcctgcccagccctggttgctgcggtctgccatgaagcggggacccccaggagccaggcccagccccagattccaggagccacagcattctctggcgctgcgtgcctggcagggctgctggggctatcccagcctagtgccaggcctgttccccagccagtgcgggctgatttgatctgctgcccatctgggcaacgcctgggcccacccatctcctctgctcccagccgtgaggctccttggcacctccagcctcccgctctgccctcaccctcaacccagagactgttctcttgtggctccggcctcggccccgtctgtctgcaggtggcactcaggctgcagggaggagtgaagatggaggaggggggctgcgggccaggtcaggaactccagggtctgcctgggtctccctagctttgtgccctggagctgatgcgcccgtgacacccggcctcgccgccgcacacgccctcacggtgcagctgctgctggggctgatgccttggctctgctcccgagcatctcttgccttccctcctccttgcccagcccccgaggaggctgtggagggccatttatccacaagagctctggcctctcccagatcaaaggaagcagatgggcctcagctgtctgctcttcccctgtctgccaggccttgttaaatatttaaaatgtcaaggcccctgggaacctgcccgattctgccatggagctcaggagctcttgcgtgcctgtggaggcaggggcacggagaagggcaggtgcacaggtgggtggcttggcctctgacgggcttccaagcacctgggtccccaaggccacagtgcagggagccggccaggcctggatctgctgcccacagaatgagcagcagaggaccggcccctcccctcttcaaccctcaaggtcctcgggctggagctgtcgggcttgagctgtctgggtgccaggagcgggtgactcgctccccgcatcccctagcccggccgtgcacccggaccctggtgctcagacctgcctgcccctcagtcctcctcagacacaagggcctgagccacgggggcagctggctttgttgtgccccaagccccatgccaatcccctgacaaggtgggcagacgtggggctgcccaggaggcaggcactcccccgtggggcaggtgctttatggcgcatagtgcattgcgggaaggggactttatcttctggcggtacactcatcaatccactgccctccctgtcttgggagcactccaagaggattccagaacccatcctggaaaccgcgctgctgttgtcaggaaacctgggtctcaggctgaactcagaggtgggttcgcccgggaacctggccccgcccagtgcccctctgggctccacaggcagttctggaaaggagggggcggattcgctgggagccgacacgagatgctcctaatccaattctgatggcatctggcctctgctccgggcaggccgcccatctgtgtccatgccaaccggccagcccctgcccccatgccctggacctggactgccctcgggcctgctggggaagcatgtgctcagagccagaggggccgcagctgtgttcctcctccccgtcaatgggtgctgcagtggggcagccgtcgggaccccgagcccacaggaaggctaaggagaaacgagcaaggctacagctgcaagggcaggtcaaggccaagggagaggctggcgagggcgagggagctcctggggaatgggccaggggtcccggctgctctcagggacaaactgggcatgtgaggaggggcaggcaggagagagactcgcatggaggctccaggctaagggcagtggagaccccaggtgtctggggagccctcccctgctcctctccctccgcagaagccccacggttagcacgtgcttcttcttaagtcacttggggggtcttgtactccctagtactgtccccacctggcttagctcctgtaattccaggagacagtcccagtccagagcgaggtgcacacccctcagttgggtccctggtccccagccccctccccaccacccaggagctgaggtcgtgcgttaaccccaggctcccgattggggcaggctcgggcctcagcaagaggcctttggctcctgaagaaacctgagccaggggcagagaggcacggacagctgcggctcttctgggtggggaggacgccatgtggccgtcgcctagctggggtgaatgagccacggttgtgcgggcggcagcttctgttccactgcggccagggctacccctgcccctcctcagaagccccaaggttagcatgcgcctgttctccagtcatctggagggtcttgtgtgccttcccagacccactgtgagtgccccatgggctggggctgggctctctggtcatcccgtccctgcagcagatggcaggcgtgagcctagctgcccagggctgggagctgcaagctgctgtctgtccaccaggtgtcagtgtgggtctggtcacggccgcgacagcactgggcgccgggtgagcgcccgggagggctcctcgggatcagccggggctgagaatcctggggccaagggtggggccagaggagggtgtcatcccacatgcctgccccggtagaaggtggctgagtgggtgtccaggcccggatgccagtcacgcacgtaagcttccagtaccttcaggccaaggaagactgagaagtgagcgtcctcaaggatgacaagtgacagaattggatagggacaggtggctctgattgtgaaggcaaagccaatttgggggcttctgagtggctttgggtgtcattcaagtcgccatgtagacaagctgtgagccctggctgagggatcaaagttggtgctggagttgcattagaaccaaggctgctgggtcctgagggccctgtgctcaccgggtcctgtcgggcagcgtaggttctgtcctgacctgggccacaggccagagctctgactcatggttacagggccctctccacctccggcctcagtggccttgtctgcaccctgcagagagcagctgatgagcagcccagggtgggcagtgtctccccgacccctgcgaggccatgcagcccagaaaaggcttgaagacttcccagtcccctccctcagcaccgtgactccggtttggcttctccccgcctgttccccaccaggaacccactcccattcccgtgcctctctctctcctcgcgtgacaccgttcttcttctttgggtctctggacccaagaacttgcatctcccattagctctcatgctccctccccactgcttcttccccgagaaacttctggaaagtaagcctccgctccctgttgccagcagccacaggcaccctggagactgctgattcctcggcactggccgtgctcatgccccaatccctcgggccctgcccaccctctttgcaggctgtccctgcccccacaggttgggctgtgtgacactgccagtctttgggaccggctggccccatcttacagagctggggaggggggtgttggtgacaagcctgctcagggaattcataggctgggagctagagaggtgtttcctgacaggcacagagccctggcctagtctttggcatctggtgccatcccagcctcccctgattggtggccctccccatgtctccactaaagtcccctggacactcgctctcctccccaggggaccattggctatactcttctgtcctgtctcctagcaacccttgttgacctggacataccctgctgggtcccctctgtgcccccttgttgggtcctgtcccctgccttccagtgccccctcagcggtagtgtggaggtggccaggaaagcacagggacctgggacccgctggagtccaggagcctcctggcctgttttgtcatctgtgtgtcaggaggaggatggctagggactccccatgacagcagccagagagccgcatgctcactcccacgtgcacacccccagcagtctgcagaaaggctcctgtctagagggagagccaggcgctggccagacggccccagagggctgctgccaccccaggagcagtcagtcagggccacataggaggcctgggacacacaaggccgacccgtcccatcccatcctccccttctgtgcttccggggcaccatgcaggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaaggtaaggcccgggggcctgggctggaaggaggaagaggaatggggcttgagatgagggacggtcacaggatggtgatgtctcctccactgcttcccttctgtcctccgcacagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggtgagtgccctggtcttcacccaccctgtcaaggaagctcagctcctgcttctggggagggtgagccagaggagacccccagcacaggttctccccggtggcctgcgtgtcgtcacctgcaggaggcgggaggtggcgggggtgggggaggtgggggaacacggggcagggcagagtggtttcagacacagcaggcccccgaagaatcaactgtccccacagcctccacggcgggctttccccctacaaaggatgcaaatgtcctcgttccccagagggaggagggctcctgagtccctttcccaggcggcccatggcacctgacgggacctcccctggggcagccgggaggaggcggtggggagaaaggcctctgcttcccggtgctctaggcgacctgctgccagccgacggcgtgctcatccaggccaatgacctcaagatcgacgagagctccctgacgggcgagtctgaccacgtgcgcaagtcagctgacaaagatcccatgctgctctcaggtgagggccaccctcccggccagcctggcaccaaggggcgtcagcagccgtgtggcccagcatcctgtccaggctgcctgctgggctcagcctccacctccaccagggccttccagcataaccttcaggttgggaatctgaagactccgcccgtcttgaggcctgatggtggcagctccagccacagggcgaggaagctggccctccaggcccaggagagtgctttgtgtcctgaatgggaagccccaagcggagaggcttgcaggggccagcacagcgctgtgcttctctcaatccagaccctcgacaatatccagtgggggtagtgttccctttccagaaggtttcagcatagtccggtgtttatcccagttggaaacgtagtgtgaaacgggacaggaaggctggaggccctaggtgggccctgtgggcctcggggtctcctccaagccagggaggaggcttcagcctagttttaaggtggacaccgcgtccctgcttccgggagaccctgggagacaggttgtgggcgctgaatgtgtctcccactgggtgatacaaattcctgtctcagtctctgtgttgctgttccaggcactcatgtcatggaaggttctggaagaatggtggtgaccgccgttggcgtgaattcccagacaggcatcatcttcacgctgcttggagctggcggagaggaggaagagaagaaagataagaaaggtagcgcagcagtgccgccagtccctggtgctggtggcggctccttccacgctgcccattctttctttgcgggccggtgccactgggggctcagggagagccagcccaagtgggtgggaggccgggccctctcttttgattctccgtggagactcctcttctgaggatatcccccctgagagccggcaggccaagggcccctccagtgccgtggacggggagtttccctgagaccaccatccccaaaggctccgggatcccatacctacctggacaggaatggcgttagagggacaggagctacggggagcctcatgcttaccctcagggcccgtgcccagtaaggtgccgaggatcccaggccagcgtgggaggcagccagggaggtgggggtcagaggtcagaggaggctgggacaggtgagggccgggcagcccacctgtgggtggtggccctgccctggggcttacaaagctaggcaagcccgagccaggagggcccattcctcgtcctgtggctggagctgccaccatcaggccctgcagcgggcggagtcctcagaccttctaacctgagtactattcagggaggccctgatggacaagatcgaatggctgccacagccccttctggctgggcagccttgctctggcctggacttgccttctggcctctcctgcagccaaaacatggtagggagccacacccgcatgggaaagctctgcttcctgccagtgacctccagccagggccctggggccagtgcgcggggtgtgggggcgtgggggcgtggggcgggcagtcagggcccggggaaaaggtcagccctgagcccaaagctccctggaggcagcaaaggagtagctggatgaccctctgtggcctagaagcttcgacgagccctgcctcctggcagcctgggcctgtgtctccctgcaccggctcttctttgtggcaccaagtcctgtagggctcagtgcagtgtctcaccccagtgagtgccctgggggtgcgcaggcagatgggcagccctgggcctcgtctgggctgggctggagtccctaggcctctgtcctgggaagcccagctgcccctgcctgggctgcctcctcatgtcttgcacacaatggccctctcccatcgtccacgggaacccacgctcctctggagtctccagccgcccttctcaggctgctcaccttctctgtaccttaaatgagtgtgtccttcctaactgttccaggcctctcctttcttttttaaattgacaagaccattcagcccctcccaggccccacctggccctcctctccagcaccctcaggctgtcctacttaggagtcagagctagagggcttcctggaggaagagaaccctgagggggccctggagggagagcagcagctggccagctgggtagagggtaccagcaagaccagggggctccctgctcgccctccccgtctctcccgccccatccccattgtttggcgcagcctgccaggtacacgcttaggatacttgccttctacctgcacccaaccccctatttcttgtctcttgaccttgactcctatgcacctttctccaagtgtgcttctcctcctcaccttccccccactcctgtctcttctggcggggcccagccctcctcttccagcaatgctcatcccagacttccccctgcctccctcctccagaggcctcccagggcctgtgtgcaggctgggtccagagtccatgcttccttcgggcccccacggccccaaggctctgccatctcccctgctgtgctgtgcggtcatcgcactgccatcttgtgtccgtgggggtctcccctccctgcaagaagggccctctgtgcccacaggaaccctgggcggagagggcctgatcaatgccccacccctggctgagtagggtcgggggggggccctccctgctccctggggaccccggatcccaaccccaactgcctgggagtgcagatgtggcccccaggaagctcctctaactgcagctctcagaaggggtgactgtgcccaccacctgagcccctggatagggccacttggggcccagcctggccttgcagggctgctgtgtgccggggctcaggctggcactcctgtgctgcagccctgggttgaccaatgacctgaaagcgccccgcagagtcctagcgtctcattcctttgtccctttaaaacacacactggggccaggcacagtggctcatgcctgtaatcccaacactttgagaggtcaaggcaggtgaatcacttgaggtcaggagttggagaccagcctggccaacatggcgaaaccccgtctctattaaaagtacaaaaattaactgggcgtggtggtgtacacctgtagtcccagctacttgggaggctgaggcaggaggatcgcttaaacctgggaggtggaggttgcagtgctcaaacacacacacactgagctaactgctggacgtgactgcagggaaaaccaatccctaggcaagggcagctgggtgctgtctgcctggcttccaggggttaggagccatctaagtgaaccccttgagctggtttgcagggagcagacgtcccgacttggggaggttccagcttccgggaacctcccactgccagccatgtgtgacccagggcccttccaaggctggctttaggggttcactgtagggctgagcttaaggccgaaggggagccctgggcagaggtctggctcaggaatgccagtgttcatggtgaccgtgtgctgggaggtggtgacggggtgagcctggagaggacggggcatgaagaaggccaccagcaatcaggcccctcctccccaccccctctgccacgcggcccccaggctggtgtcctcaagccttcgtgtctgtcatccctcttccattgtaggcaagcagcaggatggggccatggagagtagccagaccaaaggtaacgggcgccgctgcttgggcacaacaagcttggagccctgggggtggggctggtggagggcacagtgttgggggaggttcacctgcctcggtggcaggagcaacacttggagaccaggtgagtgggctggctgcacagtcccgtcccagtgcagagggaggagagagcacacccctggggctgctcagggcatcctggccacagacactgctggcagctcagcccagccacctagaggagaccttagcccagcatgggcataaggatcacctgtgagtgggcgccccgagtccactctggccagatgagaaaactgaggcccagaagggctgactcacctgaagctctgggtcccagtcagtgtgtttcccaggccagcttcctttcagccaagcctgaggacctgggagacagagtggtcggctgagggccagaggcccggctctcctctcagccccggacagctggcaggtgccgacaccctggggccagcatgagcctggctgtgagacgcaggaagcaggagaaggggtgggaggagcggggaggaggccagccgtggcccacggaggacaggagatgtcggccaatgcagcagccagctctaggtgctggagtccatggggaacaaggcaggtcctgaccctcaggaaggtcacaggcagagatgacccaggcaacgccctgtgcggagctgggtttgggagggcagtggggggacagcccgatggctgcagccctgggttgaggaggtggcagcaggtggggcacaaagctggaggggcccagctgggtggggcaattgtgtcctgacgccactgggaagaggagccgtggcgaatggccttgggctggcaagtgaggaggagcaggaggaggcagaggtgatggcggtagtgccaagagccccagtggatcggggaccagagtagtgagggagaaagacgagtctgctctccccaggtcgctgcgtcggtcccggggcagaagagggaggtggggtggccaggattactctgggccgtggagtgggtgcggccagagcttggcagggagggagatgaggaagtgacagaagcagaggagtggggagaggagggagccggagtgggggacacaccaccaccatgtcgagggcagcaaggatgaggagcacaggacccaccagggaagaagggagaggagccgtctgctccaggggagaggcagggagggtgctggagggacagatggagcccgaacaggcgcagggctggctggtgggaggagagtgcatggggcttctgggcctccctaagggaggtaggaggtggctcggacaccagtaagcagatgagtcagctcagggttctggaagattcctcgggccacaggcctctgctctcaggtattatttggggcattccaggaccagtcaccctgtctgtgtgcccaaaagccttgtgctgtgtctgtcctcccttctcccgagagaaccatctctgtcccacctagaacagtgctggagccaccccacccaccccaagagggcctgggcttaggaggcgagagaagggaagctgatagacttggaaataggagagctccactgaatcccgtctcctctctatggtgtggcatgtctttcccccacaaaagccccttataacgccttctccccagccaggcactgaccttggccatggggttcctctgtgtgcagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcaggtagggacagcaggaggtggtgggcccaggccattgactgggcgtggaggatgctgggctcctggagatgagcccaggctgtgtagagcaggtgggaagggatgtggcaggtgatgtgtgggccaggcaggcaagggcacaggccaggccggcagtggccatcagggcctggcgcagcccttccctagtgagcagaagtcccaaaccctcgacgaaagcccgggtcacacactgagccactgcccatgaggtgcccctacccaaggctccaggctctgccccggcaccctcaaaaggcagctgggggcatgcagggctggtaccccaacttctggggtgcagtgggggattgactcttgctagtcctccccagcggtgcttctcctgccatcagaccacaaagtccactccccaaccccagcagcactccagaagaggccacacagagcccccttgcaaacaggccccagctcacctgctgagccaaacctgggctgtttatcctgaaacgcaaggcaaatctacaaggccttcacaaatgcctccgagaccgtgtccatacctcttcttccctcttcctgtccccctccttccctcacccgtggcaacccctttcgtctcctccccgctctgtggcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaaggtaatcataaaacttacagttgatactgtttacagactcggaaactggggtaagaagtcactgggcgccttggtggcagtataaactggggacgtttgggatagctcaagggaggagaggaggtgccgagcagggacccagggggcagctttgctgatctgtcagctcaggtccctcggcatgagatgggccagaaagcaggcaggcggtgagatacccaggggttcagcatctgcacaatgtgggcagtaggacggaggggctgggaggcagcggggaagcggagaatcagcagagggcccgggacactgggaggcagtgggaggaggtggggggagccaggtgtggggtggtggggtggtggggtggtggggtgggagagctgcagggctggtgggtaactgagagggggctcgggcaggggaggtcccgggtgcgcatcccgcccccaccattggatgaggttgctgatgccttacagcctcgctattggctcagggctgaccaggtgcccagtgggcttagtgccacacgtggagctagctgagcagaacagagtcacgcgatgtttgtgttgacatctctcactcctccaccccaacaagcacctgggccaaatgcccacaccctcgccctttgcagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggggacacccactacaaagagattccggcccccagcgccctgacccctaagatcctcgacctcctggtccatgccatctccatcaacagtgcctataccaccaaaatactagtgagctggggcaggagcgggcgggcagggccgggggcaggagcaggggagggtcctggccagggtgccaggtgagctgttgcaaggtgctcattaggcccccccttgagaacttttgcccatccctggcctcacaggtggctctggctgggaaactgcctgtagctaaggccgaccttcctctgctccctgccgcccacaccctaacaatgtggtgaccacgagggggcagagctggggctccaggggcagcatggagggtggtctcaggcccccagtgcctgctagccctcgtcatcttgcagcctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgagtgagcagcagggaggtgccggggtacgcacggagtttctgattctattgtcgtggtaaaagaggccgaacgtaaaattcaccatttcaaccactttacagtgtacagttgaatggcattaagcacgttcacaatatcatgcaaccgtcaccactacccagttccaaaacacctccatcaacccggaaagaaaccccaggcccatgagcagccctccccacgcccctccccagcctcatgtgcttcctgtctgtatggatttgcctgtctggacatttcctatcaagggactcatacactgtgtggccttttgtgtctggcttctttccttagtgtaaagtttttccgtttcccccagatattagaccttcctttctttttttgttttgttttgttttttccctcaagccatcctcctacgtcagtgtcccccgtagctgggattacatgtgcatgctaccacgcccagcgaattttcaaattttttgtagagctggggtctcctcatgttgcccagggtggtcttgaagtcttgggctcaagcgatccacccacccggcctccctaagtgctaggattacaggaatgagccactgccaccagcccgaacttccattctttctaaggctgagtaatatccattgtatgctaaagagcattgtgttggtccatccatcccttcatctgtctaccagcacgtctaccagcacgtgagtcgtttccaccttttggctgtcacgagtcacgctgctgtgaatattcacgtacaagtttttgtttgaacccatgttttcaattcttttgcgtggacatctaggagaggaatggctgggtcgtggtgtccacgaaactgttttccacaggggcagcaccgtttcacattcccaccagcgacataggagggttccaccttctccccatcttcaacagcacttattttctggtgtgacaatgctgatgggggccatccttgtgggtgtgaggcaatatctcctggtggttttgatctgtgtttccttgatgactaacaacgctgagcctcttttgctgtgctgactggccatttgcctgtcttccttggggaaatgtctgtcctagccctttgctcattgctgagttgggttgtttgtctttttattgttgggctgtaacattttttctgtattctggatcctagatccttatcagctatgcgatttctacacattctgtcccattctgtggcctgtcttcactctcttgatagtgtccttaggtgcacaaatgttttaaatcgtgatgacgtccagttgatctattttcttgttgttgcttagagatgatgaaaattttcttagagatgatgaaaattttctggaattggagactggtgatggtcgtgcagctctgtgactatactaaaaaccattgaattatctactttaaatgggtggactgtgtggtgcgtgaattatatcccaataaagctattagaacaaagtaagggagagtgcacagcgtcacctccaaatgccctggcttccccactcccactcagccttcccggactccacacccttggccttggcgtctctgtccacaagtcacctcgctcctcatgactgccgtcccagggccctcagggcaaggtcctctgcaggacgcccagggctccccaaaggcccaggcccacgctccttcctgtgttctgcggactggaccaccaagtgcaccctgcctggccgccccacccacagcgctctcccagaactctgccaggtgcagcgctcactgccagggccaggaccacctcctccctggagccatccctgctggtgtggggaactcagccctctttctgtgcttcttttttggtgggcactgagggacactgaggcactgcggacaaaaggcccagcccagcttcactcccccttactcccatgcctcagtttccctggtggcatggagatcacagaatacttatctctggggaggggtgtgagggttccgtgggtgaatccacatccataggaggccctccgtccacacagcttctgttatgatcatttccttcgtcaccagcctcccatgcagtggcagcacctggcactcacagccccactggcttcttccaccatgcccgcctctgtgaccctcggctcctttgctccctcctctccccacctgaatcctcccaagtcctgtcccttttgagaagctcctggagtcatgagcgctctactgaggctgtggctgcctggacgtggttatagcgattgtccacagacttcagtttttgcccaggttccacccgcttgccctatgaagtctgtggtggagctgccatgagccacatgctcctgcctccctcccggtctctcagcctgcagcagtgcatgagcgtcctggtgccctcaagcaacagaaatggattctcccccagttctggaggccggaagtccaaaagcagggcgtgggcagggccgaagcgcctccaaagcatctcagagaggatgcatcctgcatcctccagcttctggtggtggctgccagtcctcgcgttcctcagcttgcagctgaccctctctaatctctgcctgttgtcacacgcccttctccctgtgtgtctgtgttctcacacggggcactcctctctgataaggaccccagtccttgactaagcccccaatccagtgtgaccagcgctgttccttgttgttctctccccacctccacctcatctctgcccaccccctgcctaggtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtagccaccaccttctctgtgagctgccctggtaactgtgccctctgcccgagcttgtccggactggtaggggcggccttccttcacacacagctgctgcggtccctccgtagtacacttgagccccgtcctgggtgctctcaccctgacacccgcacaaagtctctgtcctgcctgctggaaagcccttcccgcttgacctatgggcccagctcaggctccaccttctaccaggtgagaaggtggcagtggcggagagaccgtcgacatttgggatctgatccacccaggaccgatggactggaggtggtgctgaagcctgaggggacacaggtttggggcacagggtgggcgtttattggttgagggtttggctggggctactctatggtcaggacgtcctgtggcgagctcacagcaaaggtcctggcgggaaagggagcccagaagcatatccccatatggacgatgccaccaggggagtccagatgaggggacctcgagggccgcgtggcagatgccatggccttgacactgggaagtcactttgttgttgaaagatcccagaccctggagagtgtggaggatggccggccccggagggagaatgcaaggcatggggtgcccctctgtctccccagggcctctgcatggcacccacctgtgtcacaagcagggccactgtgaccctgacaacttgtctttgtaggagccaccctgggggtgcaggtgcaacctgggaggagaagcttctgggctctccttcgggagacaggcattcatgtattggatcatgtagcaaaaacactcaattcaaagacagtgcgtctaaacgccagccatggctcatgtcaacagagcagccccgtgccccgaggagaacatggtcactgcgcccagagagggagcacctcgagcttgccctgggagaaaatgggtggtagcggaggacaggggacagaagtccagcgagggaaatgggccccgcaaaggcgggcagcggcatgagtcccgggccccactgagcctgggagagcagaaggagagggtgctggtgaggcgaagcaaggccacacttggggacaggagccatcgagtccctctgttggaccagggagcaactgaagcacagagcagaggaaggaatcttgccagaggggcctggggaatagggacagctcctttccagcttaagagtggctgagagagagtccaagtggtagaccacagtgacagggccaggctgcggaggctgggcagacccccacaaagactggccagcctggtggtggctgaggaggacgcacagaaggcccagcgaagtcctgggtgccggcaacaggcagtaggacacaagggcctcactgaaaccgccagggtgcttggagatgcggcacggctgcagccagaggagggcccgtgaggctgggccctggggagccataggaagcctgtggctggggtggtattgatgctggagctgggccggccgggggcactggcaacttctccagacacctggctggctgctgtgctgtggggccttggggagaaggcagggagcagggctgagcaggcgaggaaggacagcctggcctggccctttggggccatggggaaggaactgggctacacacactgggcctgaggagggaggaggcctgggttcgcagctgctggttttcaggctcgtcacggccacttggtggcagcagaggggtggcttccagacttttcagggacaggcattcgctggctcaaaggagaattgtcttcttgtggctcgtgatcttgttatccagcaccccaagatcctcagagagtacgaagtgtccccgaggctggcagtgaggccacttagtggtatatgctgcaggaaccattggatcaccctgtcacagcttagagtggggcccccagctgtctccctggcaaagatcacagcccccctgcccatggcctcagggggcgccaggattcagggactcccaggtcaatgtcctcccctggtgtctcccggctgccctacccctggctcccactcctgcgtgtctactccccaccgccgcaggctccccaggcctggcggctcggccacacctaggcttctacacttacccgacggtgctcacaagccccactgcctaggcttgacctcctcattcaggttcccaaactctgaacctggctcctcttctcctctccccctgcccgtctacctcagtggcatcagctgcctgaccctgtctctctgtccccgagcctgaagagccacatacctcttcatttgggaactgtcttccctgtccccccaccactgggacaatgccaccacctcccggccagtctcctggcttcccgctctcaaccccttgcaggctgttcgctttccactcagcactggggaacctctttctctttctccagaatctaatatgatgcaggtggtccccaacttttaacaattttgtaacttggtgcaaaggtgatgcacattcagcagaaactttacttcgagtcccatgcttttccctttcagtgcaggattcaatgagttacatgagataatcagcactgtattccacaataggctttgtgttcaatgcttttgcccaactgtaggctaacacaagtgttctgagcacgtgaatcggatggctttactctcacctctgctggaccttgggccacctgcagatctgatggaggaaggggtactgcctcaacccaaaatacgtcttgcctcgatggccccgcccacctctcttgtctcttctaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgaggtagcacccggctgtctgccaccccagaccccccttctcctcaccccagccccctgcgtgcccgccttagctctgcagcgtccttgtgcttcccctccccagatagaacaggagcggctggacaaggtgtggcccaagctgagggtgctggcccggtcgtctcccaccgacaagcacacactggtcaaaggtagccgagctcccacacccctttcctggggtggccagcccgaggttgtctgcttcctgacaccaaaagccaggttcccaaacaggtccccagggcctgcctaggaagctgggtccatttgtcccattagcccagagcagcagggcaggggcccatgagggaaccagggttcggggagggctagtgactcactccaagtcacacagtgagtctctagaagcagtgggtctagagccagggacccaggattgtgtccccaggccctaaccagatccctatcctcccaccctggccctgtcactcagtgagatttgcttacttatttggggataggagatgatccaggtgacggggagcacagataattgggacagtcaggacggggtaatcccaaagggttttcacagccaacctacccccatagctccctgggcagggctacacagggttgtggtgacagatggccccagccctgccctgccctgatctgtcttccagggattatcgacagcaccactggtgagcagcggcaggtggtggctgtgacaggggatggcaccaacgatgggccggccctcaagaaggcggacgtgggcttcgccatggtaagccacctggtgcccgcccagctcaccacggcagatggggcctgcatctgtcccatggacattagctttgtaccaggaagtgggagccagtgtcggggcaggttacagagtgcctgaaggttctttctttcacatcctggccacttgggcctgcgtgggctctgccagtcgggggacatgtggttaaaggcatctgctgtgatgcccaaggtgacagtgggccccagacatactgtggagaggaaggggaatggggggtgggggctcatcactgatggcattgcccacccccgtcctctctaaatggactctcagccccagatgaggtgagcagagtccccagatgtgctcttcctctgcacttccttcctgttgctcacccactgagcagggtagccctgcagacgccacccacatggctggttgcggcccctcagtggccccacagccactgaacgcagcaacctggtgagcccctctccctgccctaccgaaaaggagtgtcacccagggaacccagcccagtccttcccagcacccgtagcccagaagggagctccagcccaagcttcgagaggtggcagctctcacggggccaggcttggggcagaggagaggactgcgcagcttggcacagctgcagctgcgcctccatgggacagggactcctctgcaaggagccgccccgcccagggtgtccccatgcaggacttcccagggctccttagccagcaagcctctctggagtgctaagaacagaccacgctgcttggtggccacgtggtggcagctgggctttatgtgtaaagctgtgttgatgccatgtcatcagcaccctctgtgtttatgagcaaagcccccccccccaccgtgacatgtgacaacttactgtttgtagtacaagaatgtgttgcattaaaaaaaagcaacaaaaaacagtgctgttcttggctttggggggcggggtgggatgttattcagaaggggagagcagggagccagcccaggcgggccaggtgatcaaggggggctggggaaggggcccccacaaacactctgtgtgagtgtgtgtgtcacccccccagggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggtgggtactgggggctgccatgccccagctaggacacctgggctcaggcctgagggccagattgtgagagtgagggttttgttttctttgctgcagattattttaattgagatcaaattcatatgccaaaaattcaccattttcaagtacataattcagcactcgaatttgtaggacattcaccacgttgtgcaaccattggctctatctagttccagaagattgtcatcatcttaaaaagaaaccctgtgctcttgagcagtcatttccccatttctcccccaaacatcccagcccccggcaaccactcacaggcttcctgggtctatggatttgcctgttccggacatttcattcctatgggatcaaataatatgtggcctcttgtgtctggcatctcgcttagcaccgtgttttcaggctcacacacaccgtagcatagggcaggactttctgccttttcatggcctcataacactccacggcacagactgccacattatgtatgtctgccctgatggacacatggctcgttcccactttttggctcttgtgaatggtgctgccaggagcatctgtgtatgagtttctgcgtgggctatgcgtcccatgggaaccctttctcaacagtcccattttccccattggtgagtgtccagattttcttcaccccgccttagaaagggggtgtttaaattgcctgctgatcaacttggtcttttcaaaacaattttttaaattgagataaaaatcacataacaaacttcaacagaaccattttaaccttttgaaagtacataactccgaggtttatatccctccactgtctattcccagaacattctcatcaccccaaaaggacacccagaccccgtgagcagtcactctctactccccaaaccccagcccctggcacccactcatctgctttctctctctatggatttgtcagttctggaagtttcctatgaatggaatcagacagtacgtggccttgtgtgtctggcttctgtgaggctgatttttaacgaacaactcagaggagctgagaaggaaggtccagttcagagtttctgcctcctcctgcccctgaggtgcaggagacaaggagagcagccctcactctgttgccccaaatggcagaccccatcgtcgggctgttttgtggtctggggtttttcacctcctgcgagggatttggagcacacctgctgccaggtgagagaagggaggcgggcacgtgacagcccaaagaaaacgccccactagcgtaaaggcgatgtagggatggagatgtctgttttcatgggcatgaaatcctggtgatgtggaccccatgaggagcccccaggagctactgggtttccacccccaaccttcccgggcaggcggcccatggaaaggtgactgcctcctctccataggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggtaggctggccagtggcacccgggaggacttcgggacactgttgccaccacctcgggctcagattctgtctggtgtgtctccacctgtgtctccgcacccagtacggggtgggacgctgcacttcctgactggacagcacacaggggaaggagcagatgggccaggctagcaaccctgcagccaggcctgctggtggcctacagctctttcgcaagcctctcctcccaggcccctgagcagctgagaaacagttcatgtcttgacatcctgcccacggctgtgtagctgtgtagagtaggcagcttctacccagccccagagtggccacggtaaccctaggaacagaacagcccacatttaccctgtgaagattgctcctgtggagtgactggggtgccgtgctggaagctgtgaggtgggtggggggtgaccgcaagagagaggaagaggaggagggcgtccgaggaaagccagccttaagaacttcccttcttaatctcttccttcctgccctcaggctcagggtctggcccctggcccagaggggtctcaggactctggttggttgagcctggggtgggtgtggctgccttgggccatggccgtgagctggaagtggccatcccctgggacaagggacccatctcgggagctacacaccgaagtctcgctcctgagtaatgcgtcatgcgctgagatgactgtgcctgagtggggaatgttgctttccaggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcaggtaggaggggcggctccactcttggcctctgccacttgcaaaaagtggaggtggtgggcttcaagacccctcgtccacccctagtactggcctccccacctccactcccagaaggagccccaccccacctggctttcctgtagcccccgtcctctctgcatgtcggagagggccttcttcatcttccaaacattgccggccttgccctgggtgagcgcgctggcttccagaagggtttcgtgagccctcatcggaacgaagttttctcacagatgctggaaggagtcctccctggctccctctaggtctgccattcccatttctagcacttaattccttggcatgaggctgccataactccagaagtttcttttggagatgacctctgtgcccagtgctgacacactaacctctgcttcccacagtgctgtggacaggctggtcagccccactgtctaggaggggctaagtgttctaaaatatagtgtatttgtagaaaaattgaggtatagtaaggccaaaaggtcaagagacagttgccactgaaagacagtttatgactcagagaccccaagaggaggacacatgccacaccataggggcccacatgggagagcgccaggcaggaggtggggtgtgagagctgtggacaagagcctttgctgtggttccctcggggaggagcgggtgaggcagtgctggtaggctcaggactggctaggttgcgtcattgcagcggttccagggcatacgggtgctccctggctgtctggtacctggtcctgggtaatgagtgcaaggggatagtggcccggaatgtgacagtccaacagaggacggggtcagtttgcatttggacagcttgcccctgcaaattggatgcctcccgaggaggcaggaggccaagacaaggtgacctcggcaggttctagggtcctccagaatgaggcatgtccagcgtgcccgcagggtgggtgtcacagcctccgtcttgctgaaaataggagcatggtcagtggagctgggccccactccgaggctggagtcagtaggtgcctggcacccaggggcgctgggggccatgcactgctctgtcatcgcgcccccggccttgtggtcctctcgcaaggagcagcccgtgcaactgggggaaccaaccagggtggctgggtcttcaaggggttggaggacaagggtggctcaggagccgcggctggacctgcctctctcccacttgcccttcgcagattgtcatcgtccagtttggcgggaagcccttcagctgctccccactatccacagaacagtggctctggtgcctgtttgttggtgttggggagctggtctggggacaggtgagtgacagccctgcccctcatttcagactgccctgcagacagcttctgtgatgggcccacttgccctaaccctgcttcagagccttggggtcctcaccctaggaagcacactgagggctcaggcctgtgacacaccaggacccagggacaggacgcaagggaaggtgtcagcaaaagaatgcaaaggaacatggctgggatgtgacagggcccaggaaaactgcccgcagctcccctttctatgataagagccaaaaattgccccttccaattgggtgggtagcttgggaaatccccacatattttaaatcaatcaaacagcaccctgatcaataatccatggggcgaaaagaaagtctccagagaaattaggaaatattttgacctgatggaaaggacagagagtcccacatcgagctctgtgggctgcagctgaagccgcacactggcaggtttctaggaccccacaattagatcaggaagaaacagcctgggtatttaggatccgcttatctctgtcttcatcagctccgactgccatagcaaaataccatagactgggaggcttagacaacagacacttactttctcgaagtcccggaggctggatatccaaggccagggagccagcggggccagttcctggtgagggctccttcctggcttgcagacagccgcctcctcactctgtgctcacatggtggacagagggagcaaggtctctggtgtttcctctcctaggagcattaatccagtaggatcagggccccaccttggtgacctcatttaaccttgatcacttccttactccaaatccagccacactgggcactaggacttcaacacatgaactggagagcacagttcagtccatagcattccggcttttcctttttttttttttttttttttttttttgagacagggtcttgttctgttgcccaatgtggagtgcagtggtacaatcacagctcactgtagcctcgaactcccaggctcaagtgatcctcctatctcagcctcccaagcagctgggaccacaggcacatgccaccacaccaggctaagttttgtattttttgtagagatgtgttgtgccatgttgcccaggctggtcttgaactcctgaactcaagtgatctgcctgcctcagcctcccaaagtgctgggattacaggcgggagccaccatgctcggcctggcttttgtttcttgatctctgtgccggccacaggggctgctgcagctgctgcagatgccagccttcttgctggccccagcattagtgtcctcggggacagcccacccagttcctgtttcattttcagaattctcctttccctctgctactgcacctcacctccgaatcacacttgaacctggttgctccatggagtcccttcacttcccgaaacctggactctaaccacagcccagaggggtgccaggccctcttcttgctcttcaagctcccaggccactggccttctggtccccccaggaatgtggcaccagcctgtagctcggcctctcagggctactgggttgtccttttcatttttaaccttgttcagttacaaagataaaacatgttcaagagaaaaacgaaaagaagggaatctctgtgaaccagtcctcaagtcccctcctggccatgttcgacaaatacactggcatagacacacaagacagacgagacgtcttgctctagaactccagatgcccatcatccctttctgtggcttcccctgcgtccttctagactgttccccccacttcccagtggcctacaatatgcgaagccatgccctctctttactcctgccaggctccttatccagtcaccctttccagctgtcaccctccttgtcacctcccaccctctctagcccccaatgcacaggtcttctctaggctggtgttcctccaggagatgccctctccaggagagactaggccagagctccagctgtcctctcccaggggagttgcgcaaacagcgcctgtgtctcccagcaacggtgtggagcgacatgcagggagtattgtcaaccagggcagctcacccaggccccggtgtccagggcttttcttgcggtggttcacagagccatgctgtggtcacgtggctggcctccatctccagccctctggaggtccagctgttagtgtagcctacggggcacggtccccagccccctgccccactgagccatgctgctctcaagcaggatgttccaggggcttagcgatccctcccaggagcccttgctgcaccgcgttccactcgggccactccctgggccctttggctgaatggagctccatggaggatccgcttatctctgtcttcatcagctctgactgccatagcaaaataccatagactgggaggcttagacaacagacacttactttctcgaagtcccggaggctggcccagagctccacgtactcctgaaaatgcatctcagccccccgggggaacactacgccagttctccaagggctgccagttcccggggggactgctctagctttactccctttgcttagtcacaaaaacaaatgacatcctttggaagaaggaggccggcgtctccctctggagagggaccttacgccaggcagatgctgctcagcctggctctcacggccacttccgtgtggctcccccaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcaggtaagccccgactcgctctcgccctggcacttccaccccaagagggtagaggcaagctggccagcagcagccgagagccggccgtctgcacccgacacccacagggaaaccctttggtcttgctgccaaggtcacaaaagcagctgccagtgtcccctttgccattccgggctgtgcccgctgatggctgtggcactgagatcgcctctccctgacagctccttcagagcccaggcatcccctgtagctaaaggtgtgtgtgggtgactaatggctctctcagaggcacaggccagcaccgtcctcatcactgctggggctcccttcacttggtgggaacggccccaggtcataggcaagtgacagtatcgggaagagaggcccatttcaaacagccaccagcgagctcaaggttcactggttgacactgtaaatgcgatggggagacttcatttgggaagtggactctggccaccgagttggtcctttctggtcatccaaatcaccaagggttagggccggccaagaccaagggcgtcagctgtgttcctctctgaagtcagatggccaccactgccaccagtatcaggcgcttgccagagctaccatgctcccttgttcccatctcctcccggccaacagttttgccagaatgctccagactcgctgtgtctccacacccctccctggaactctcttgtgatcccactacagcctggcctctgcccaccactccccagaaacggcgctcgcctaggcctgcgaggctcccttccggctcgtggggtcgggctgtccctgcatcgttcctgcctgctgtgggcactgcctggagacttgctgtcctcacccgcctggcacccccacctcctgctcagccctcgccccaccctgctgtggcccttgagtgctgaaaatcctggccggggaggaagaaagggcccatggggaccccacctgcggcctggcccctctcccaccgcagcccctgcagcctctccttcatggcctgcccctcccccagcagcctccagagggccacccagcatgcttcacactccacctccttctgcaaggcctgggccaccatctctcaggtcacagccatcactccctgcccctccaggccctgtccaggatccccagttgcaatgcccctgacatggagcgactgaccctcctccctgaggtcctgccagagtagggacaccactgcacacttggctgcggagccagggcccgcctgagccaccagccccagctcaagcgggaataggcggggcctgaggccacaccccttcccagggtcagtcacacatcaccaagggcctgtcccaaagaatcatccatgcaacttgcacaaagctgttcttggtgccctgggtcctgtgttccctcccagtggtctcaagggccgagtctcaagggacccagcctcagggcaaccccactccctgggcctcagcctcctttgcttgccttggctcagctcagcccctccaacaccaccctctgcagtgggactggtggagcctctctccattgtcctaaggatgaagtctacgctcctgaccatggccttcaagcccctgcctcttggtgtcaccccaaccttcctgcacacctgcacccctgcacccccggctgcctttccaatcatgccctctgcccgcctgtgccactgcacctccccaactcccgctgcgtcccctgggccctcatgcttacaaagccctctttgactcctctcactctcaccacgggctccttgcaaaactttccagagctacagagtcccccagagaccacgatcacgcagggctaggtcaaggggcaacaaagaactccacatttcaagagccccccaggggtccaaggggcctctccagctgagaaccgggaggcgaggctggcatcctaggcaccgaacacagcgtagcctgggaaggatgtgttaggtctggactctgaacactgtcacctatgccctggcctggccagaacacagagagccccggtgaggaaggggagcaggctttgtcgccagatggcctgcgtctcccctcccacgtgcaggggctactgcctcaagcacaatgctcggacaggccaggggtgcagcacagatagtctgttctcgttccctgcaataaatatttctgcgctaaatcttaaacacatcgaatgttagaagcagcattcacatctcccccagtgccctcctagcggcccaactgtgccttctacgagaccatgcctatgggccccccagctgcccccagatgggctcttatctatcgtacccctgttgtgctacagagcccagagctgcccaagcctggggtggggggtgaggacagcaggaccttgcccctcggcggcccacttcactcctgccgccgcagccgaaggcgacgttaggttttccagcagctgagacaacagccctgccctgacctgaagcatcagtggtgtcagtggtaccccggccacctgtgtgtctcgtgtcctctgtatgtgggggccgctgcagcctggctagtagaagcgagtcccatcggtcagagtcttagagttccaggctgttccagttgtcggtgctcacagagacacgggcagctgagtcccctgctttacgtatgaggaaacagggtgcactctttccccttggcaccagccgatccgactcttccacgggctcctgacccccatggcttttcgctttgactttgtcacatccaactcaccatgtttctcaggaatgctgaaccagtcggttcttttagccagctatgtaagagcatctgctctctttgattcgaaacacctgcttgaaaaatggagctaaagcttgggagaagcccgtcaggttgtacgtatgccccaagccaagaaaaacatttcctaggcagctggccccaggtttctgctttttgggaaccacaaaatcgctccccagattttggaggccggcacaagcttttctgttgctaagtgaaggcattttgtaacctgctcgcaccatggttccatactaacatatcaacgcaccagatggacagggtgtcattccagaataaaagagtccttcaaacccagaacatgtagctttctgaagcgctcatgactcggtctgtcttttttgcatcccattataatgcaaagagaagcttcgtcagcaactgggccttgctcccggctcagctcttgggcttccaggtgtggggtggtggcgactgtggtattgtcactgatgtggctctcccactgggacaccatctgtagccaggccagaccaatgcaaatctgaggcaggaaaggcatctttcctgtccctcatcacttttgccgcagcgagagtcctctcctgaatctagacaggagaccccccaccccgcaagccaccgcgacgccatcacatcaaccatcctccttccgtgcgctgacacactcagtatgcattcctcacggtcgcagcaagtgccatgaggttccccttgtgacaagcaagcgagtgggatgtgctgggcggaaggggactgggcaggctgagaagaaggaggagtcctttccacagcgcgtcaaaggctgaagtggcgtacatcctcattttggccggtgcagggggagtctgaacactcaagctgccttcttccacgaagccctggcccgtttcaagacacccaggtgaacctggtggccaccacatagcactgcagggctcgggctggagcaggtagctttgggctccagatgcgcacactggctttgctgttcacatcatctccagtgagacggacatgagtccccatcccagccaagggcaggtcaggaaatccaaagacactgggtcaaggccctcctgcaggcctcagtttccccagccttgcttccccttcaatttgcaggaagctgtaagagtggggacaaagcgaagccacggctgccagtcggtgggaaaaccccctcctccgctaggtccattcttctgctgaagtttcgagggggcgccccctgcccagtcactcagatgagccacagaagctggcggagacgggcaggcggatggagcatggggcataagtcctccgggtttagaggaagcagggcgggttctaataggagcgtgtcatgtccctcaggtgtgttggagaggaaaaacaaggttgagaactatgaagtacttcctgataagtggcttgcaaggggcatttctgacatgtttgcagtgtgccctgacttgtgacccccttcccttcccaatctcatgaccactaaccatctgctcagcaaaccctctctcggtgggtggcacagaggctggcctcagtcagggccctgtccaaacatcgccagctcccagtgagcggggtgacccgatgaggctttgctgtcaccctatgtgcccagtggtggcccctatcctcgcccagccctcccctccgtgatagcctggacaacagtgcaagccaaactttatctcattttctctcccacagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatggcacttccggacctccccgttctttgctttgtttggtttttcggtttgtgtttagtgctccttgtgccattggttctcttttcttgaacttgtctgcctttgccgatggttcttcatgaacttgggccgcttctgggggtgtctggtgtcaggctagggccttgctcagtgttcagtggtgcagcatcagggcagcacgcgggctcagggccgccttcccggggctggaggggtggcgggtgcctttcccacactgtttgccacagaagaatctagcccacgtacccaggaactggagcggcgcttccagcatcctccttgaagtggtttcctaaggatgccgctgtcacctgtccccaggtgggctcagtgctgaccaatcactactgcacaggtggtgcctgccctgtaggccttgccccaagccaccgggtgttagaggtttccccagaactggcactcagaggcctcttcaagacgttgccaggaaaatttcccaccatgttggtcacagtttaaagagaacccaggggctgtcctaaggaggtagaaacttccagaattgctcacatctttttacaaagacaaagggaaggccactccaccgctgaccccactaccctgatgggagagaatgcagggaacccagtgggcccagccaggcagcctgctttttccagcaaactcaagagagtttatacaccaaagagtaaactttcgcgcgtgggcccagggcctttgccaggatggttctatgctacctctttcctttccttctagcaagcccccgaagcgctcccctctgccaacacgaacacgccactcccctgcaggtgggagtccttaaccacgcctttttccatcacagactcttccagcttgattgcttttcttttcctttctttttttttttaggaactggtgagaggtccctggtgggggtcacccctcctcttgcataagctgtcattttgggccactctgtcctttaaggaagggaggaggcccatcctgtcccccttgggaacagagcacgtgcgcgcgtacacacacacacacacacacacacacacacacacacacacactccttctccaaaccacaggccacgtacacctccagcttgctccacactcatcatggggccacctacccttgtcacaaatattggctgacaccgtggcagttgggctgaaaagcagtcggcgcctccagtgccctagacgtgggcccaaaggggcctcgccgccactccacccagagaggcggacaggaggctctgccaagtcagttaaagccagaaatggttcgtggcctcccagcaccttccttcctgggagctgagggcagcagggggcatggctgtgcctccgcctccctcccccttgacttcctccgtatgtctctttgccatctctctctgtgcttcctgtctgtctgtccatttgcccatttgttgagttaaggggaaggcagccaccacggccccactccacgcgttcctcgagccttctccacagctctggcctcatcccaccccaggaccagctccttgtccctctccaggtccagcccagcctctgtggggcctgctgtcttttctccctctggattcctcctgcttcctccctggggcagcctcttgctcctctcttccttggctcctagcacttccttcctgccttcattccgtggccatctgtccccctcctccccacctccggagcctggcagtgcggggtaagtagagtgggagagacgccacccctcctgctgttcacaagctattccatgggggccctaagtggcggatagccagaaggagggcagctgtcccttgcacactgtgtgctccagcagaaggtgggtggcagggccctctgaagaggcccatcccagctgaacatcagcatcccagaaaggactctgccgtggaggaagatgctggctggggacctggcaacaccaaggacatgcccacttctggaagccacctgccagaaccacctcctgccatcatcacagtgcagcggattggtttagaactcagaacccaacccccactccacgcttcaaggaccccaagcaatcaccaagcccagcactctcatcctagagatcaggggaaggaggttgtccccaagggccaggacctgcactgggtcccataagcagccaggcctggcagagtggggactagcaccagcgcccaccctctacttggaactttctggtggatgagagatgctctgaaggctgtgacggagctcccctagacaagagggctgccccaactaggcctgcaggggcgtcgagtcacgtggtttcctaaggcaagcccacagtttcccatcctctttgcctgctccaggccaggctgcctttcagcccaccaggagtctggggcctttctgggcactggagctgcctccgtcccaagcctttcctactaaggacctcaggtcctccagagagaagggccggtggttggtagcatgacatcccctcaccctgtgcccctggggccaatgcaggaagtagcaagggggtggctaggaggggtcgagagatttgggatcgctggggctcagtgctcacacactcgagccctccccaccctgtctaacctcccacacctttgctgcttctggactcaggagtcccaacacaggccccatccctcctctgcatgcattgtcagactgtgccggccacaacttctgacccccagctccaggcagcctccactgcccctcccctgcccagcctggtgactaccccacaccatgccccaaccacacactcacacaccgaggccacagtatcaccctccctgttgggtgtccatattccggagagctggtcagggacagctggttcagtcactcgggtctaccaagggcagcaggcacagggggctgcgcgtctgccactaggaggcacgggagggtgcgcgatcatttggaaagccccatcaaagccacttgagaggccttttatgtctgttttccactgggacacacagacaaaccccagccacgcatccaaagtctatccttccagcagcgccacaccaggcctgtgtgagatgcttactgttggagtcgttcctgagatgcctcctgacctggcccagcaaaggagcaggggttaggcagcaggccatgagtctggtcccatgtggccaccgggggtccctccgggccgtttagttccagttaatcatgctggaaacagatcacagcagttgcttggttttattggctttggcaacatgaaaaccgtgtggccaaaggggccaaaccgggccacgtgagtcccaggctttccctggacactcctttccagggcccagggcgacatgctcaccacactcccagccccgtggtggaaggagtcttgttttctggagtttgctccattctcaggaaggtcatgtgctttgagccaagcctccctacctggtttctgggaacggtgtattggcattttttctcagatctttgacagtctgcaccctgcctccatgctggaagcagtagcaaccctcccccaagagccctgccctaggctttcctggaaccctgggccctaccacaggggaatgcccttccaggcaaaccctaaagtaggcaccagaacgcagcctagggcagaccccaggacccctggtccaaggccctccccatcaggcactccgagtgtggactcccaagctgggaacctgggcagagacctctcaagactaattggaggtcccgcagctggattcagccagtacggaggcaagggctcagctgggccttcctcctgggtcctctttagtccgaccacccgacactgactcgccgcgcccaggtcagttcagcttgctggtgttgggagcacaggtctaggctcacacggtcctgggcatgagtgtgcacacaaggtgggaggcaattttcatgaaacttgccagctgcaagcagttctggcttgccaacacacacacagccatgtcttgtcttttccgttctttggttcaattccttggggaaagagccagctgtggagtttgcattttcattgttcctaattcaagcatgtgacatccccatggggtagaaaggggccttccccttgctcttcccccacatagagaagtgaggccgaagccatcttctcctcagtgttcaggctatctgagcttggcttctcattgcccgagttgactgatggttcctattgccacaggctcttgaggacacctttgtctcgctttcaagttgtgattcaccttcacgcctacaggggttgttttgagcctggaaaccctaaagttcttgacaagaagttccccatgggtctccctggctgctgtgttcagaatctgctctaaattcaaagctcagatgcctggggagctgacaggtccctgcctccaaaggaaggttctggaccagtggttggtgctgagcagtggataggtagggaggaaatcgaccagaagcatccgagttctgtgaaccttagcggctgagactgagcagagagcatggagcccctcgggtcggctggtgcccagcacagaggcagcaggatagggcttgtttctgcttgaggaattagaaggaagagtgagaaggtgtcaggcacagcttctgtcgtttcgttgtcactgcggtcaggagtctttgctttgattgttctcttttcctttcctttttctactcttctcggtccttcgcttgtctccctgcttctgcggcccttctccaccctcatcctcctccccagccctgcactgcaaactccagcacttgaaggctaaccaggggcacgtctccccatgcacatggcgggcacctccactccagctggccggcagtggcatcgcacatggcactccacacctgcaccccttccgctttggctcagtgtggccagggatgggccttgtcagtctgcagcgtcacccgccctgtgtaaggctcagaactgctcatccacgcaagtcgggagcccgggccaagcccacagcactcagcatgtctcctctgggcagctggtaacaaactgcccgggacagcctctctaaggatgcgtacttgagctaagttcagaggaaggagaaaggccagccaggcagcagaaagggcaggggtcatggctccggggagcccctgcgtggggtgttcagaaacagctccagccggctgggcattgcaaagtgggcaaagagctatggggagggccgaagccagcacaggaggctggtgcaaagccgtgtgggccccagacattcagccccgtccactgagcccctgctgggtgcagcgagccagacagacagacccctgccccagggggattaccttccagtgaaaggtggatggatgtagggggcacttgaaggaaggagcagaagtgggcaccatgctgctggggaagacaagagtgaggggagccttcctggtgtggggtgcagccacagcaaaggtccccaggtgggatgtgccggaggctgaggggtaaaagagggcagagtgagaaagactggggccggctccgagggccacagccagtggagggcttgtagcgggggagaccaagacacgctctggttttcgggccgccgtgctaagggcatggaggggtgggggcgaagtgcaggttctggatggcgtttgaagggagccacggggctggggccgggggggttgggcctgctaagtttgagacccagcttagatgcccaagtctggagccggagccgagaggctgttagccgacaggtggaatggaaggccgagagccagaagagagtacctagacccagaggaggggccctcgggtgtcagggatgggagaggaggaggggctggagcagtgtcggacagcgctgggggactgtgaggagtaaaggactgtggcctctcagggccatcagccatgatggggaacggagaagtgtggcagagggagacagcaggaggacacaaggaggtggggacacacagtggggagccacctcgcctcacccggatgagatggggagtcctccagcccaacctgaccctcctaggggcatctctcccggaagagtgctttcatttcctttctttttaaattgtcacagtaaaacgggcttttgggggtacagttcaatgaatttccacacagtcaggacacgggccagttccatcgcctactggaaggtttagagccagatgggggaccaagagtctgacttggcagccagagagagctcggaaactccacctagagaagggacaggaaggatggagggctttgctggtgggggttggggtcccaatgtgaccccagggccccaggcaggacatagcagcagcaatggaggtgaggagaggctcagatgtggaagatgcttttgagttagggtagggcccacaggacacgtggatgtctggtacatagggtcagggggtcaaagtgcctctgaggtttggccagagccctgcactgggatgggaaggctgctggtgggcagagttcagctggagcactgataagagtcctcctcgggcctcctgcaatttgagaggtcccttaggcatccgagggggaacacccgggaggcagccagggcagaagtctggcagtccaggaaaaggtggacatggtgcagctggtatctgcagtatttacggtggcctgatggtctatagacagcattgacagccctgggggccatgagattcctttgggagcagtagggggcgtggcgcgtcctgggctgagagcagagcaggaggcggtgcaggagcctgagatgaggacagagtgaacccaggctggtggaaggagggcatccttgagcacccaggtaggagtgcagccctctgggatgggcctctcttagaaacgtttgttgctttccattgaaccaatctcccaggaatcgactgcatccttcagtgttgggtgggctgaaaacaccccaccttaacaccaacaccaaaacattgtttaatggcccaggattaggatgcagggaaaatagagcctggagaaagctgactcactgtcagctgtaacagactcaccaggactccagccaagcttagcacccccaaacagcagaatgttggggggcagcccttccatcctgcagcggttcactcagtcacttgtgcattccccaagtgtctgctgagcagctgctctgggccaggctctgttgttaagccacaaacaaggcagatgccatccgggaggggcacgctggagtagccggtgagaccggaggagcagtagcagcagaagcccagcctggaaggaagggctggctccgtggcctggctctcctttatggaggtctttggagttgagccaggtgcagtgagacctgtgcataggtttgagcaggggcctggcctgatcacatgcccccaggtctgaatgaggccaccagctcagcgagatctcaccccacacagccctggggtcaaggcctgcagcactttgtcctttttgtgacttgatgggcaacagctttagcaggcgatgtcccaggcggcttccacaccacaatcctgtaccagaaaaggcctaaataatgaggcaacatctgcattggctacgaaaactgaattctgtttcttttcattaaaaacgtcaaattattctcaatttctgtgttacccctaattcagaaaccagtctggggataaaggcctgagtgagaatagctgaccatctgccgtctggcagatgtggctttcccgaatgcagagaaaatccgaaccagatttcagatggggtgctagaaaattccaatgtggagctttttggcttacttttttttattattattttaaataggaacggggagtatcactctgttgcccaggttggtctcgaacacctgagctcaagcgatcagcccgccttggcctcccaaagtgctggaattacagctgtggaccaccaaacctggccctggctcactttttgcactggagaggtgatgaggttggcatcatttcagctgattccgaagcactgtgctttgcctagctgagcccctggagggctgaaagaaagtcaccgaaaaaaggtgattaattgtctaaacgacagagccagagaggaaatatttttagctttccaggcctggtctctgctgccgtgacacaactgtgcccttacagcatgaaacttaaaccagtaaaattttattaaccaaaactagcagagagctggggttagcccctcagcaagccctgacaccttgtctaaacccagaaaaccaaatcctaggtcgaaccttggccccagaaatgcttcagaactcctaatgtgtccacctgctcacataggcaggggtggacaggtgttggatgaaccccagggtctgcctggcagctcagcgctccgtctgctgccccctatagggatggcagtacaaggtgggccagctaccattggcggctgtgctgacactggcctgtgcgaggccaggcagaggcctccccatcaactcctggcttctagaagcaggagggggcccaggctgaggggccagggagcaaagagaggcagcaaggacttgagtgcgtgaggcaaggtggagaagccagaggagggaagggctcgctcctggagcagtgccctgccggagggtcagggggcttaagggctgccgtgcgctcagctgggggcagagggccactgtgccgggggagtctggggcacagcgggagctctttcatgcgggaagttccgctgatctgaggtctgcaaactcctgtggggagggatggccagggaacaacacagagcggagcccgggaggcagcagagacgcaagttttggaatgtctgactggaagatggaggaggagacgggagagaggacaggcggagtgaggtcagaagagcagggacaccagattgaaccagacccagtcagacacgggggctgtgaggaggccacaggggcatctgagcagagacaggctttagtgggtgcaaatcaaaagtgtggccattttcggtctcagatacctccagctggggactgctgggctctctggcctggagctctgagtacaggcctgggccacagtttctggttatagccagatgggccccagcactgtggccagggtggagaggtatggacagagaggaggagggacagagccaggccagagctctggggcacccagggacagaagagagggcagtggaggagatggggccagggcagctggtgaggtggaagagggccaggcaggggcaatgtcaggaagccatgagaagcttccagaaagagggatgatcttctgtgttgagtgccctgagggatcaaatcagacgaagatgcagaagtggccagtggagttagccgcagggagaccctcgacatggcaggtcccggctccagccatgggagctgggggatggagggagacccatgcgagaaaggccggcagtgcccataggctgggaacttgctcataccagcaggtacttcggactttctggtaagatcgaagaagacatcccactcaccagcattctctccttttcaaatcatctttcttttctaccaaattggaattcagattgggcagagaccccagaggtcaccaaagccactcgtctccccaggacagggaactgcggggtcacagccaaaagcctagtgcagcactctcaagttccagaatacctgcccagctcagcctagagaaagacactgccatcttttcctgcatgcggatcggttgacgagaccaaggcccacacctgaaaactctttccaaaggcaggcagagccatcccattccgtagcagccctccaacaaatgggtggacatttctcatgccatgacccccagccattgacgtgggtggaatttaccagcaccagccggccactgactgtctccttccttccttcctaccttccttccacgtttcctttcctttcccttcctttcctccctccctgctcccacctcgcgccctgtccctccacctcccactccagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatatttgcattcctcttatcaggcattttcatttggaaatttcattattgaatgtagcaaggttgtagttgttgtttttttttttttcagggaactagactgcaagaatatctttctggtcaacccatttttgtccctcatcaccccgcccccacctttcgctcctgccctctgcccggccctactgagattcccaaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacggcagggacgcagccacagttcagaccctgtcccctcagcacctggatggactcccactgtttgctttggcaaatgccgaggagtcctcggtagaccaccttgatgtctgctgtgacatcagaggtgccaccaccaaagcactcttcccaccctagtctttgtgtccagcggccaagcttaagccatgaagtcatggatttgtggctcagcaccaggtcccgaggggagcctatcctggcagtgtgggcacctggtggccaagcctcagtttcccccaaatgagcaaaggggataaagaggggcccgacttttgccaccctcctgaggaagcccctaggtccacacagtgatgccatgggggacccttgccttccacacttgcaggtgtcacgttttgcagggaggtgtttgggcctggggctcagccactgggagacagttgggacctgagggacagaggatcggaatggaaaccaccaacgtgcactggcaccctcagaaggcttgtctcacctccaccggcatccacacaaaaccaaacaggagcaggcgtcatccccactattcccatgaatgccatgtcacccctgagcagaagcagtcaaatcttgggcaaaagaatttcggttagaaaagaaaatcccactttaaaatgccagctgcagataactcaaagccatcccttttttctaaagggcacattgagaatgtcacccatttgtaaactgttccctgatgtccttgtttaaacgataataagaaaaagggcaactccatttgttgagggtctttgtgttcttcaatgagaaatcaaatttgagacgttgaaattggagctgcgtgctgctgcactcaccggcttcttctcactctctgtcgtagacacaccgataggaccaatggccaatagatattaaaagcaaaccctcactgctgctgtataaagttgcctaatgtaaatgtctattgtttagt

SEQ ID NO: 16417 - DNA, 11706 bp, Human
tagcatggcatctggcacacagtcagatctctgtaaaggttagatattattattaaccactattccagttaactactcctcagaaagtggtgttcagtaacaagggacattttctagggtcagcctaaattgcgacctaggccattggaactattggccatgaaagcacaattatgtattgtaataggcaatagaatatgtggctctgacattagactaacatccatcccttcaatatagggaccttaggcaaattaacctctttcttactcagtttcttcttttaaaaaataagcatgataatagcagccacttcataatattgtgatgaggtgcaaatgagttaatgcatgtaaagtgtttaagctattaactcaacaaatattacccattactgaaaacatcagagtgtgccacctgctaagtaagtgcttctggggagatagagtatttcaaattggattgtcatgaaaaatttggaaaatttgaaagctaaaactcttgctttcatttcctactgcctcaattctctgtattctgaatttactccctgtgtccccctaaaattgcatttgcaaaagccgatcttcaagttacatccaatgcccgctctgcctcatcttctatgggaaacaagaattttagaggtcaggtagcctaacaccatcaattctcaaaagaggaagctgaggccaagagaagtcctgtgaatttcttacagctcatttgtgacagaccaagaattacccactttactgggttgttatttactaagtgacagtgagtctatatctcttttgacaagtgaggtgggggcatggaattcggcatgtggttggtgtaagaactcccctctctcctctttaaccttacttaataagaccctggcacagttgatattttaagagggctactctgttttcccagagggacctaggcacggtaaccctcttagcatgcagaccttgtttcctgaggggtaatgtttcccttccctgtgacttgtttcttgggggctgtgttctgattttcctgctgagccacttgttgccttgggctggctgccgcgcttggcagtttttagtgagggctctgatagatgccaggaggtgaggggaagggctctgggtggactccgtcattggacaagcagacttagtgatggatgagccttcccctgaggaagttttggatcagaagtccaactgataagtttttccagaattgagtaacccagaagcagtgccgaaaggatcttacctctcttgtggctttttgtattgattttaaaagaaattctcagaggcagttccacattgtactggaagcacagctatatccacaataggcttagatatatgtaacatgaattgctttagaaataacatttgaggagaggggtgagaggaaggaagagagggtcttaaaaaatagccctatcaaaatattttctttcttctaagtattgaaaagacacaatataaccctttcttctttcaaatgatctcatagctatttgttgaggggaaataccaaatgtttattattttttttgaagaagcttcttcggtcctgatgattcatgttgatatcattttcctcctgactacagaggctctgagacaaagctacacctcaagtgatatgccagggtcagaacaattcccgtcctgaaggagggtgtgcaaccttctttatccctccttcacagacgtccttgagcccttgagacggatgtgagtgagtttttcagtcctcatgcaaaacaaccatctaaacataacagatgacatcagcttgggcttttcaattcctggatggcagcagcgtgttaatccagccttcatcctggatttcataaaccaaaacaagagagcctggcaggaggacagcgctgctgctgggttgaggaaattgatgacgggaaagcatgcgggcaacccagtgtataaaactcataaacgtgtaggcagaggctcagctaccagtttggacggctgcttcccaccagcaaagaccacgactggagagccgagccggaggcagctgggaaacatgaagagcgtcttgctgctgaccacgctcctcgtgcctgcacacctggtggccgcctggagcaataattatgcggtggactgccctcaacactgtgacagcagtgagtgcaaaagcagcccgcgctgcaagaggacagtgctcgacgactgtggctgctgccgagtgtgcgctgcagggcggggagaaacttgctaccgcacagtctcaggcatggatggcatgaagtgtggcccggggctgaggtgtcagccttctaatggggaggatccttttggtgaagagtttggtatctgcaaaggtaaagagtgaccccttacctctcccctcccggggcatgctgagagcttttagccagcttgggaggtgaggtggctttgctcctcaagagtaagagggaaaaggcaggtggattcttgacaaggcaccacacaggtattgtcatgggtagagactgaaggatagctccaagtagcaactgaaaccagtgtgcaggaaggcacagaaagaagtgtggcattttactcgttgccttaggagatcgcaaaaagaaagctgcaatggaagattgtgttggctccttttctggaaaactttagaaacttgacaggtaatctgttaaggatggcttaggtgctctctcctctgcgaggcagcgattacaaaggtctgcactagataacctcttggaatggtttctagcccccagatttagtgattctttgatcttgaaagggtccacaggatggagggccactctcaagatcaaatatttctgataaacacaaatgcactttatggaatagagtgagcttaagtcatctaacaaaataactcactcttcaaagagggtcccctgaagcataaaacaaacctcatctgactttataaaggttttggtcatctggaaaaatagcagatggtgttaagacaaggaaaaataacaatagagaaaaataaaaactggaagtctgtaaagaatgaggttgaccacttgtacacttaaagaaaaacttcgtcggttgaaattttagctaaataatgtagttaagcatttgtagaatttattttaaacatagtaactagtttaaaatatttaacattttaaaaatgtttagaataaaaagaatgatgatttaaaaatactctacgtatagatatctcatgatcttattatgaagagctattattaagaagcaacacatgctataaccccatccatcagttgtgtaataccaggaagctttcaaaattataaaaaggactgagaaatttctaaataattattatgttttatgtatttaatacattttttatgaataatatttatccagtattgtgctaatctcattaattctcctacttcttagacatataatgtataaattaatcatcttttaatttgcaagacatacaaaattaaaaaaacaaattcttaaagtattaggagagttttattttttgcttagtttatttttgtttatatacaataagaaatagaatattgagaaaatattttgtttggtgaacacatatgcatgtttctttcaactgaataggatctgtatattttgtaaattatggggcttattgaccaagaaaacagtacttcacataaggaaattagggaggaagtggttaacacaatcatacttatgatatagcatgtatatgcagtggattgctttttctcttggcataatatgcctttgtacatgtgattgtaaatgtacattacatatgggcaaagaaacaagctgtgtggcatctggagtctttagcactgtagtattctactgaatgatcaagatactaaaaagatctttaagattgcttcttttggctttcttcaggttgctgatgaatctagttttaagcatttttctctctgctggaaataggagactttgtgagccttagcaactcgagatagagataatacatttggcaatcatctcccttcttcagctttttaaaagaacatccacgtgaaaactgtaaacttcagctgcgtatccaaatgtcttctaaatattcagatgtctgtgaacatcttgcccagattaacaatcagcagccaacacatatttaatgaacacttactatctgcccagcactgttcagtacatcaggggatacactagaagtatctctgggaatttggctaaagttttagttttcaatatcgctgcaggcacagtcaaatcctaatcctgtgtgcttttctggaacaggcctttgcaggatccctttttaagatctcttcttcccagcaaagagaacagtgttcaaaaccaggttcctctgtgatctgaaccatattgaaaagagcactcatagatctctttaaaaaaagatagctcattgatgatctacttggtcagttagtggagtattagactgctagagactcagatggctcacaatttgttctttacccacctgtgattgtacatttacaaggtattttcacaacaagagaatattctatatctattctgctggcttttaaaggttggttagtctactgagatgctgtttatcctaaaaacagcattttaaataattttatgcattttaaataaacgactttgtcctctttatttcaatgtaggatgttttggcataagtgtaagcactggaggtctaaaagcttctagttcttggtaggtgtacaaaccctcagggtgtataagccctgagctttcttgctcatttagcatcttgcatgttagccttgcagaggattttactagggagccctcttaactactgagggagtcaggcaagttgtatgacatgccgtttcgacaaataaggaacttgataagggttggagcagatggaagattgattgcttcatggtgagctaggatgatagctctctccctggttagtttgaagccctttcctatacacttaaaatagtaaattatctgtgaatacagtagattcaaagatagcatcacattttaaaaactctttgaggagctgatgcatatatgtctgttcaatttcccacctttgctgagctgttacagaggtcatctgtgagaatttattggtatctaagcagaacatcaccagaatgaagactggtccaaggagactggctgtgtgtagctgtcttcaacttaactttacatcacaacactaagcccgaggcatccattatctgttcttaatgtgtgatttcatatttatgactcaaagtttcaactttcaaatcctgggtttggagaattggattttactttacagtcaaggttcatgaggttggttcaaatcgcaaggctatgcacccagggctgttaggatggagacgtatttacaacaagcagcgtcctctccaacctttcctttgtccccagactgtccctacggcaccttcgggatggattgcagagagacctgcaactgccagtcaggcatctgtgacagggggacgggaaaatgcctgaaattccccttcttccaatattcagtaaccaagtcttccaacagatttgtttctctcacgggtaagcactgattctggtataagcattggaagaatagtctcatttcagtgtgaataacttagaaaatatctgtgagtagaataagatgtggattggaatgattttatttcctttgctttactcaggggaacggtgggtggtagctgagtttggttgctgttgctgttttctaaaaagagcccatcaataattttgaggtttacatataatttctcataaagtttacctggtttaaatatgatttataggaggataaatatgattgattaccaaaaatctgtaataaaaaataaccaactgagatacacaaagttctttaaattcttcagtgatctgttttatatatttactagacaaaactatttatctcccaacttcacatagaaaaagtactgtgaggaatttattggataagctttaagagtcaagatagaaaatatagaacgtttcttttttttaaccaaatgaaagcatttaagtgtaataattccaagtgtgtgtttttatggattttggagaggataagaaatagtatgtgattgaaattttggaaatgaatgaaactgtagtaatacgtgctgcttgttagtccgtgtgtatttcttatacaggtgttagaatgtgaggaatacacaacctatgagatggtgctatgtacatatttgtttattttgttgaatagctggccagtacaggagagttccattaaactgaaagtagctcatttaaagcaacatacatcactaaagcttaggcctccattgcacagaatggcgattgtagttaataattcttatatatttcaaaattggtaaaataataaattttaaatgttcccatcacaaaaaataagtatatgaggtgatggatatgctacctagtttgagttcatcattccacagtggagatatatatcaaagtatcatattgtaccctaaatgtatacaattattatttgtcaattaaaaactgtatttaaaattataaaaaataaataaataataagcccaacatatagtcacagagatggctagtatcaacaaatgatatactttttcccaccacaactataaataacaattcaagtccattttatttagtttttgcttttggtcttttgcatttcaagttaataaaatataaactatttggcaaaggtgcttgttttctaattttacctccttcttatgtatgggtcaactaaacacattaaaatgaagcggaaatatcgtgcttttaagtgaattattagttttaagtatggtgatgcccataacaatacttacattataggttacacaaaaatatttccacatcaaagttaggcattgagattcttatcagaaatatttgaaaaaagcagtcagtttctctcttttctgacctagggtatttcctttcattagctaaaggtgcaaccagcaaaagatgatttttagtgtgatcttggtaaaccttagtcaggttcaggatggagagcagaaaaccctaaggacctcttggggaggctgcctagggttctttgtagtctacatgtgtctttgagactacatgagacttccaggttcatgcactggagtttacaggagaaggcttgggcttcactcctgacacaggcttcacatcacctctgcacaaacctgtttgggcccagcctttgagagcaggctaaatggctgcaagcttcaccagcactaggacccccagagcacgagcttgtcttctccaactttccacctgctggctacagcactcttgtcaaatgtgcttcctgtccacagtgttccacttggtgttcttttttttggcagtgagcttcccaagttgggaattcacaagtaagtttttgtgtacgagggtcttgggggagtaagatctggaatgtttcatggacttacacacattcgtctgctgggccacgctaatcttcttaaagcattccacatcagaatgtgcactgccaaagcaagcacacctcactactccttgaagtagaaaatttcattttagcaaatttcaaatattacaaacttttctcatatgtagagtgagaagtgtctttatgaacgttctacccattggtctgccttttgccttctggatgcagcaaaagttaatctgtctttcataccagttagtgtaagaatctaacttgagacctgtttgtacaacatttgcctattccataagtatttattaagtgcctactatgtggcaagcactgtcctaagtgctggagatatagcagtgagcaaaataaagtccctacctttgtgaaactggaattctagtggtggagtgaaataatacacaggaaaaaaagacaaatacatgtagaagataatgtcaggtgacgataggtatacaaagataagtaattcaaggggtgctattgtatatagaggtgctcactgatatagagcagtgaatacagttagcatggaatcttaaattgattaaagatttcattgtaaattccatgtaaaacaaaaataaagcaaaactgtgttgtctttgagctatagatgtttggacatgatttgtattccgtctactttcagagcatgacatggcatctggagatggcaatattgtgagagaagaagttgtgaaagagaatgctgccgggtctcccgtaatgaggaaatggttaaatccacgctgatcccggctgtgatttctgagagaaggctctattttcgtgattgttcaacacacagccaacattttaggaactttctagattatagcataaggacatgtaatttttgaagaccaaatgtgatgcatggtggatccagaaaacaaaaagtaggatacttacaatccataacatccatatgactgaacacttgtatgtgtttgttaaatattcgaatgcatgtagatttgttaaatgtgtgtgtatagtaacactgaagaactaaaaatgcaatttaggtaatcttacgtggagacaggtcaaccaaagagggagctaggcaaagctgaagaccgcagtgagtcaaattagttctttgactttgatgtacattaatgttgggatatggaatgaagacttaagagcaggagaagatggggagggggtgggagtgggaaataaaatatttagcccttccttggtaggtagcttctctagaatttaattgtgcttttttttttttttttggctttgggaaaagtcaaaataaaacaaccagaaaacccctgaaggaagtaagatgtttgaagcttatggaaatttgagtaacaaacagctttgaactgagagcaatttcaaaaggctgctgatgtagttcccgggttacctgtatctgaaggacggttctggggcataggaaacacatacacttccataaatagctttaacgtatgccacctcagagataaatctaagaagtattttacccactggtggtttgtgtgtgtatgaaggtaaatatttatatatttttataaataaatgtgttagtgcaagtcatcttccctacccatatttatcatcctcttgaggaaagaaatctagtattatttgttgaaaatggttagaataaaactatgactctataaggttttcaaacatctgaggcatgataaatttattatccataattatagtaataataaccttaataagcataagaaaaacagagtcactctggatttcaaaaatgtcaaaaaatgagcaacagagggtccttatttaaacataagtgctgtgacttaggtgaattttcaatttaaggtagaaaataagtttttaggaggtttgtaaaagaagaatcaattttcagcagaaaacatgtcaactttaaaatatagtttattttcatatttttttcttttaaacttggttgataagtggaattaggagtatatttgaaagaatcttagcacaaacaggactgttgtactagatgttcttaggaaatatctcagaagtattttatttgaagtgaagaacttatttaagaattatttcagtatttacctgtattttattcttgaagttggccaacagagttgtgaatgtgtgtgggaaggcctttgaatgtaaagctgcataagctgttaggttttgttttaaaaggacatgtttattattgttcaataaaaaagaacaagatacagcttctctgtgttgatttgtgattttgttaaattgctaaatgttattttaacaattcattcaataaataagaactctcattcatattaaaggacaagctcttcaacagaattttctgctctggataagcctcttctatcaaaacagggggtcaggatatttgcttctctgcctcacatttttggtctactcattttttagagtttcctaaaagtaggtcccaatatattaactcattctgcaaaacaacaacacaaggtaaacacttctgttgacatcattagttagatgcagagctcaggcttgaaataaccatttctattttgctacctgtatggctcttgaggtcctagacttagagcattttttcttctttgttttgtgttctcttcctggattttgtcattttcaatggtagaaactttgctattaaacagctactgagtactcctttgcactcttccatgttctatggggaaaccccttataattaactctcaatcagttgttagctgttttactgaagattacagctctaaaaatgtcgaacaatttttacttttatcagtttaagtttctcattcataattaatactagcattttattttcatttattttctaatatttttgaagggggttgcttttagaaaacatagccaaagacaaacctttcagtacctatgaaagaagagagtattttacagctttgaagcttgagtatcatattcaagaacagtctatgttcattctgccttgtgggcaaattatggaaacattttaggtgaatcgataaaaatgctaaaaaaagtctatataagaaaaaatcctgtttgctcgaattgatatattttgtaagatgatagaaattgggtgtgaatgagatacaaagttacatgaatgtcagatatttacattttcattaactgaaaatctctattttcacctatgggcaagaaagtttgaggctactctggtagggagtgaggttatttaaagatctgccctcttggtttgaagcccgggccacagtccaaatgcttctttgaggaagtgtggaaaaagagctagactggagcaggactggcctctgtttctggtgctgcagtaaccacctgtgcaatcatgggcaataaaatcagatgaaagtgggcccatttgctctgagtggcaggcatgttttctagctgcccagctttatggtgctgggggctcttcatggttttcaccccaaaagctagtacctgtctatcccaaattgctctgtagtcttaccactaatcttcatagccgtggtctccaaaatctttggatctgtacacccctgactgcacactttgctagtgcaaaatttttttgagcatgtaatttcaaactatatacacactatcgtattaatatattgcgttcattataaaacatacactccaactagacattattaaaatgaagagataagagatataaatagaagttttgaaattttcttcccacacttcaatgtaccattccagaaaacacttgggaaacaagaaaattccatagatcaatgggcctaatctcatttgatattggagagaaactaagctgaggcataataaatatttctggaatgaatggatgattggatgaatgaatgggtggataggtagatagatgaaggtaggaaagatggatgggaagagggatggatggctattggatgaatggatgactgaagggatggttggtggaaggatggatgaatgaatgaagggatggatggatgagtgaatgaataaaaggatggatgggtgaaggaattaataaataaagcttgtaacaggccctgtgtcttcaccagagcagcagctgctcaagaagaagacaggctttccttccctttcacctgtcagatccccatctgcccagctacttatccatcctgttgggttgtgaggtgattgaaaatgttgggggcctacacagttagtgaatctgacaaatagggctgttcaagacaa

SEQ ID NO: 16418 - DNA, 77100 bp, Human
cccaagatacgatgggcccttatcaattcatgggctctctgtgttctgttaagggatagtgaatccaagggttgttacttggggttcccagatggtgtgttctagtgaatggaaacgttttgccctctgtgcaggggcagcattgcatcatggaaagatcacctacccggagccaggaggcctgggctctggggccacgctagccctaactagaagtgaccataggaaagtcactccaccttttcctcatctggaaaatgaggaggcaggatgtggtgatgtctgagacccctttgggctctcacagtgtagaatcaagtggcacctgaactccatcctgaggagaatgacaggagaaagcacccacagataatcacacttgcactgcgggcagtgaccccgcggcatagtattccagcacagctctgtgtgctgcgaccacattcaggagaggcaggggaagactttttattgctctcaggcaagaattcagtcctgagcctcagggagccggcagtggtggtctgagcaggggagaaactagctgccctagattactctatttcttccaaaccagtttttggaagtctgggttttcccctctgattttcacagatgacagcgtcagcatcttccccctgcctctgcccagggccccatttctccccttatgccctcctccttcccttttccatccctgtctccaccacatcacctctttctctctgaagcctctgctggctttctccgtgacctgccttgtctgttgctggcatggttaggaaggccgcacccccttcccagccccaagcaggccctctaatccctgcagtcggctgaggacaactgtagtctctccatcaaataagcatagaccaagacctgcagcagctctgcctgcgagccggtcaccatggcaacgagcatcacctccattctactgtgaaaagaaaatggctgttggaaggaagggctcactgaatctccattccccaggctgttttgttcaagcctgtccctcctgttggccagaagaagccccatgcactgaaccaaatacctgtttgcctttagatttggggtttacttaagagaaggaaaggcagaaagaagttgaattcaaaggaataaagcatttttccacctcgaaactctattttcatgaggaatggttgtctgctcccagcagataaacgaggagcagatgaacacagggatctgtgagatctggcgcagtgtattttgtcttatcggtgcagtggaatgacagagcatatggatgttcaaataaatattcagggaaagtagccaagggacccagggaattccacagggcacgggctacagaatttccaaagggtgtctgactaattggggtggtgatatgtgatgttggctcctgttatggaaaaaggtgtgttggtcctgtagtcgtgagggaaggtgagggtttacccttaccatccccacttcaaaatcagtgtgagccctcctagtgattgtgtccggacagcctggggaactggcaggagacccctgagcttgattctggagtgcagccttactgcacttgacacagctgtggagacacttcagatgacatccagaaggaactggttgggtcaccatttctgtgaatcccaggatgttgctgttttggagcaggatcataagtcttctcaaggggttggaaacatttagtgcagagatcacccagaatctcccagggcaccttgcactctctgaggggaaatagctattccataggagaatggtctgggccgtgtctctctctggctgcacatggccctggctgttggtggcacaagttctcaaactccacacaacctcctcccttcactctttcttaaagtcagttgggaagcctatttttgaatggaagatctgggtttcattcttgaacattggaatgtacgtttgaactgaactttgtgggtttttttttgttttttgttttgttttgttttgttttgttttttcagtttctctgcaggtggatattgttcccagccagggggagatcagcgttggagagtccaaattcttcttatgccaaggcaagtgcctagtgctcagctgcattttagaacttgcttcagaaactcactgggtagagcaggagccctcaggccatgtgagctggctggtcaagccacacctagaattcttggcattgctctattacagggtcaatagtatggccatttaagagccagggcctcttccttccttttgcaaaaatctgcctcaacatagcaaatctgtcatctagacttcaccttgactacagaggaagtctaggagttttcttagaaaaatcagcacaacttccagaatagtgaatcatcccccatctcctattctgtatacattcagagttctgtaaatgacaatggagaacagcactggctcagaaacaatacttcggtggatctgtttaaggcttatttcttagaattccccagagcttgaaaatctaagtctaaaacttgcctgtaggtaaatagaatactggtatggcttttgttgtgaggacatatatcctgggtttaccaggtctattgtgaatatcgatattctgtgccatggtccccaccagagctctgagatatgccagacctggtgaccttgttttacatttagaaaacatgccccatttccacagcccagataattgccagaaaatgtcctgtggaggaaaaggtttcaaattaagcctcagattctctgtatatgacatgactgggattcagaacatggaagaaccaggaaagagctgagctaggtgtaaatggtgacatttagcaagcagcttttggcagggaggggcctttaaatgctgtcatgatttgcgtggacgaggtggcttgtggccgtcggatgtgttcactccagctttgccttcattacagcaatttcaatgatctggagacgcagccgtggagcccacagcacatcttgcaaatagcgatatttattgaaaacatgatgggccctgaaaggaagactgcttcatttccatactaagcatctgtgcagggctgggtggtgcaggctgagaagggcgccacgcgaagaggcaggggcccatgcaaacaggcagggcgccgccacatccgccggatctgagcgcccttccagctcagtgtcctgggcagtttcagtgtcagagccctgttccagctcagtgccgggggcagctcagccaccacagtctgttcctcctcattgctgcctggggaaaggaagaatgggtggttctggctaccttctttgcagcatgcaaggaaatgaatttgtctgagcagggagtgacgaaatgacagtcatgccagtttgtgcaggcagatgctagaataaatgtggctggaaaaaatgaaataaaaagtggttggaatctgcactcctatactagccagtatttctcgccttcatctcaggagacccattatccaaggcttcaaaaacaagctgatcagtagactcagaccagttaggctctggcgcccgaatcctaaatacactaattcccttggttacccgttgtgtgaggcatgtgtgttcctagcttagtgcccagcacacagtatgttctcaacaagtatctcttctcttccatcattagggataggaccatgataacaactagtacaagtggttgttgagttctttccaaatattgtaagaggtgttaagtatataatagttaaatgcagaggccaaagaagggctgcatgtcattccagcagccatactcacccctccctgatgttcaagccttgactgatctgttgttcagtaactcttactgatcagccactgtcagtctggaggggacttattagtcttttcgacttcagtagcttaaaaataatctcttcctctttagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcgtaagagcctccttcttcttctgcattctctggcctctccttgccaaggagacatgtgggtagtggaaaggtggaaatgatgacagaaggaccagctgagggcctaaccagtcccattctctctccctaagtcttttctgaccttggccaacccagaactcacaaccctggttcacactggtcacagctactcccccacaggcgttcattctcaaaattcaaattacatagttcccagagggctattacgggtttctctatcccttccccaaatgttggctgactgttctgcaatttgggctcctctcccttcttatttccctctcccctgctggtaatggagcccagggctcagtggggtgggggatcattatctgaacactctctgccactcagagcaggcagttcctattgcctctgaaaccccatctgtaggtggcatctcgttaccttgttatttatatcatgcatccatcccagtggttggagtaatggtgggtgacagctaatggaacagtattgattgcacggtatttattgccattaaatgtgcttttttcctgttcttttcatcagcattctgtctgccgtaggaaagttggggtgggactgggagtagcagttcgagtgggagacaagaaaaggactgatgattcttactattcgttgtggaatggatgttccaccagttcattctacctataacctgtgcttcactggcatcatcctgcatgacaaggaacccttggtgaagatattcctttcattctgtagacccttttctgcacaaaatgtgataaatttagcactcaatgagcagatattggttgccaagcattggtaacctatgcttgggccagctgctctgcctgacgtctctgagggtgcccctcttatacaactgtacatcaggatcgagacttgcccaggactcaagtccaggtaccatggctctagtgaaaggggttctttgtgagagaagcagctgttttccctcactcttctgttcatcttccagagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatggtgagacctgaatttcctggcatctgccttttccccaggccaccaagttccctagctttttcacctgtactgaggcattccagtccaaactccaattcatgtgtgcccgaaccctcatgtggtttctgggtcctgaatagatgcatatctgaagttggtatacttaggtacctgattttctctccagtacgaaagacaaatttctaatagacatttactcttggctgtatttcaaagccagggacgcattttcttatttgggcttaaaaccccaccctatgatactgaagttaggaaaaaggaaagagactcagccacctgcctgcagatgctctctgactgattcttggatgaacctgcctcttatctcttctagtccgattcatagtcctgtccaacaactacctgcagatccggggcatcaagaaaacagatgagggcacttatcgctgtgagggcagaatcctggcacggggggagatcaacttcaaggacattcaggtcattgtgaatggtgaggagagtccgttcttcctgatctctgcattgctacaaccttggttctccaaaatcattctctttaacttcctcttgggtctgtaaattaaatcctgtcctgactcaatcatccgtctgagctaaatcccctccccaccgtaacatctagatttctttttttttttttttttaatatacttgcctgttggatcttccttcaactacgagggattttagtgcagcaactgaatgtccttcaccgttctgcagcactaaaaactttccccctgcttacctattaatcctcattgtccttgatgttaccataattgtgaagttattccgctgcttaaatgttcaaagaaagtattaagtcaactcaggcctcagaatagtcagaatcatggtccataggcttgttaatcttaacttgcagtgtcaaataaacacacccatggaattgatctgacatttacaagatgtttacaggaaattataatgtcagtactaagaaaataagtaaatcagggttgaattgttttgactattgacacatattttttttgccaaactctccccatctcattcctttggtaaaaaacagttttgtacaaggttgtttatcacagtcccagagaaatggcactctttgttatagctgatgcattcgaattggtgttaaccatttaaccactgggagcagtaatgtccaactttttccagtacaaagagctcctttttaacatcaagtttcactgaacctggtagttattaagtttagtatgcattgactgagaaaatacataatgaagaatagtgactataaattgaataccatcttaacatgcataaaatgtattactatagcttctcaattaatgaaaaacaaaaatgcatgtttgtagaactgtctattcagtttgcagaagttatttagtacatacatgaatttcaattcctgacactaactctgtagctgcacacgacgtttgtcccacaggctgagaactcctgacctggagtggtgtctcttctccaggccattgggttcttccaaattttcacaaccaccccatgacacccttttttccttcagtgccacctaccatccaggccaggcagaatattgtgaatgccaccgccaacctcggccagtccgtcaccctggtgtgcgatgccgaaggcttcccagagcccaccatgagctggacaaagtaagaaactggctcataccttttatcatggactagaggagaatggggcatcacaaagtctgctccatgttagtgtctgcgtggaatggatgtgggcttcttaggaatattaaccccaggagaagaatggactcttttctataagattctcttgcttgtgcattgattattccttcaatttcagccttgtgggggcagagtcagagccagagggtgtggtcttgggagcccactttgaaacatttgtgggtacagttgcagcccttggatagtcagaggatggaatagaggaataagaggtgtatgtggacgttcaacttggtgccttaactttttgtgaagactgaggagtctttcccattgactcagtctgcattctatggaacctaattaaaaataaacgtcttatttctgtggtcgaaatcatgctactttgcatttctacatgctctagggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttggtaggggcagtgggggcccaggtcactgctctgccacaattccccttcctctgcacattcagtccatcagtaagaccctggccactgtccctcagaacataacccaatgcaaccatttcttgccagttccaccacctagtccaagccctagtccaagccaccatcatcctcacctgagcagtgggacggtctcatagctggcctccccgactctccctattggtccacttcattcacttctgctcacagtagtcagaatgacctaagtaccactcatctgtttgaaagcctccagtggctccctatggcaaccagaataaaattcagactccctgcaatggcctacaagaccagagatgaactagctcctgccttcttctccagcctcatctttctttcgctttgctgcacatgcaaagttctccaaccacacaggccttcttcatgtccctcagacataccaagcttgttcttcatctcaggatcactgccctaggtttctcttctgcttggaatatctttccctctgatccactctgagctgccttcttctgatccaccattcagatcttaactcaaactcaccttctcagcggcgccttccttcactgccctggctaattcaactccctctgcactgcgaccacccccacccacctccactcatctctctctcgtgactcttactgtatcttctttgctgtacttaacagtacctgaacagatgtcatttgcatatttgttttggggattgtctgtctcctacctctactagtgtgtaaacttcaagatagcataaccctggctgtcatacacggcgttatccctgtgactccaaacagtgccagacttggcataggcccttggtaactttagtggtcgatgggctggctgctttgccttgtttgcctccttccctgacctgtgcaaaacagtgtcatggaagagcccccacatccctgctcacttcatcttcataaactcaggaaacttccattcatttcagaactgaaaagcattttgacctgatcttgaaaaaagaattggttgcagagaaacgtttaacctaatggccctcaagtctctccgcgtgtctgtttagaaaacacagataaactggtctactgtagacagcactggggaagtgccagtctgaggcgcagctctggtgcatggagcccccaggtcattaaaatgtgcacctgggaatcagggttgggacctgcttatccagcctgataaggagaactgttcataaacacagacctttgaaaatcaagactttatatgcaaatgtcctgctagttattcagtagtaaacagctgggtttagaaacaggctatcagttaggttcaagttaaccgtacgtatttgagagagaaagctaaacttcatgaaaaatattcttgaaagtcttttcttgaattcagactgatcttccccaatcactatggttttagtaagtttttccatattgtagaaaaagatagatgcatttgttaattaatcccttcatttaataaatacgtatggatcaccattgttgctggacagaggggctacagagatgaataggatatgatcccttgaccctgggaagcacaaagagggagataaatggataaacataaatgttataatagtgtcagtcagcaacatttgagtgactgctgtggactcagtcattgccaagtttacaagatgaataacatggactctgttctcatcagtagattcacaagctaatgtagatagtcaacgctggaatttgaaatgacaacacattattatggctgcaaaatagcaatatgcacagtgttttataggaaacaagttctctggtcctgtgtgatgtaagttagagaagtcattaaaatgtactatttcataagtaggaattacccagctgaaggagtggatgagaattttaggcagcctgggcacaggcacagaggcaggaaaagcacaggctatgctgaatgggagcttcttgtggacaggggctgtgtctgttttactcacagatagatccccagcacccacatgcattaggcactagattgaataaatgaaggaactgtcattagttctatatgatgaagcaaacatacatatgtggcagggagataagcctggaaacacgatcatcacctgtctctaggaaattattttagactttaactccataaagtagtaataataataatatcaaacacaagcagaacacctataatgtgccaagcattctgtgaagtgctatctgtaagttaactcttttaatcctcatcacgcccctatgatgtagattttattattatccccattttacaaaggaggaacctgatcacagagggatgaggtgcctctggattcaaaccgaggcaggtggctcctaagtcccttctctaatctaacaatgatggttgttaattccaggaaacccaacaggacacaaattgtatctgaattatgtgggagtgtctggcaatactagaatcagtgcactctgcctgcatcaccaggtagctcatggtttctctgaaaagcaactcagccctgacttggctgggcatgaacagatctcggcttctcttccagacctctctggtggtgatggctgccccggagtagtgagtgcagggccatgtgggaccgtggtagagggaagagagtgggtcaggtcgacgggaggaggtcaaaaggcagaaactgccaagacaagatttgtcttcccacccacaccttggacacatacacccctcttcatcacaaacacacacacacacacacacacacacacacacacacacacacacacatatttcacaatttctttcccgaaactgcagctggaagaatagggagcatagtggggcaaacagagaagaggtggccaggctcctgaagagacagggcaggaatcatagatttgtagagactgagtccacacagaatgggaatcctcccctgtcatagtctgcggagcgttcatgcagcctccctgaaggaacctggtgcctcttctccaccaccttttcccatccatcttcccttctcatcctcctttctctcctcctccactggccttcccattggttgaggaaactgatatagggttagggagccacctggggagggaccagctgattagggctccttctccttccactcttttatttcctttccagccccttccaacttgccattgtggcccatcactgggggagaaatgggacaggttctgcaagtgggagtagagtctacagcagtgaggtagaaaagggaggaaacctgtagcttagatagtaaagaaaagcccagaagtcctgtggcctcaagaaggaatgtccatcagtatgtatgggacatatctcaattagagactttatgacatcatttgtatctaagtggcatcattctttcctcagaaaaagacatgttctagcacatgttgccttagttattagctagatgctccttttactaagtagatgcatcctatcatcctttaaatttggcagtgaattctcattactgttgtccctacacgtgcccctgaagaagttttgtctctattgattcttgtgatgctcatgtacatgctcttgaggtctcatgctgctgtggctgaggaaagttctccagtggccaggagccctgtgtctcaagcagcccctgagggttacagctaaggacaagcagtggcctgaaagaaggtgcatctggtcatgccccatagcatagtgtccaacctctttgttcagggatgcaggggcctcggggctcttctttggctagggttgtaggagcatggactggagttggagtagacaaggctgcctcttagtggcaagcattcttggaaaactcacaggaggaaatatggggaaaggtgcagtggaacagtctgaggcactaaggcccatggaggcaggtggagaatagaacagggatccaaaagccaagaactcataagagaggttaattaatagagggcagggggtgtaggaagatgaaacccagagagatccctctagatgctggaaggcagagggagggaatcttttcagtagggtgacccagcatctgtccctgtttgcctactaatgccctttgtcctggtgtaattatttagagcctctcatgtcactctcaagagagtcccaatttagacaataaattatgcatatcactgtcttgttctaaggtggcatctgagctttctgagttagttctgaccgtactgcttctagagtaatagagaattaaattatcagtgggaagcttcccttccttcccacagcactctgtagactatacaaaattagccataatcatgttttaataagaatatggtttgccttttttctaaggagtcacacaatgcaccttctgtagccatctgggaaatggagcctccaaggccaaatattaatagatggcaactgacccttgcctgtcttctgttaaccttcggctgccatgacaaagtaccgcaggtcaggagaaggtcagcaaaacgctgtccagatctcagagtctgacaagattttaaggggccccaaattcagccttcctgggattgtctccagacctcaaaacaactgttgagtttagcgaattcagttgtatggccacattttttttaaattttttattctgtgacttttacaatatagagattcagctcttactttacctttcttttattttattaacctttttgtttttcatgtttattttacctttattttactttgccctctaaaacttccctttcaatggcacttggcacatattccttccaatacgagttgtaatattctcaaaaatcgtacttattaaggaaaacacaatagggaaacctatgaggtttaacctcattcatgtggactccatcaactgaaatctatgaacatttggccagattggattgagatgtgcctatgtgctatccatcaaaaaaggatttgctaaacaggctgtcagtatgcattacctttaggcaaatatttgaactatatggatgattttatgtagaagcaggcatttgtaacaaaagtatatagttctattattgttttctgtttattaaaacagcatcaaagacctcaacatggagaagatatataggcagttgtttatttgcctacttagggttactgtatgaatttgaatataaagcacatgtagtctttcaaaaactagctatcattctcttggggttttttggttcatttgtttgtttccctagcctgaccttttcctatattcatgaaataagtcacatttgtgcagtgttatcttttctcttccacacaaagttcagcaatttcagagcataattgttttaaattgggaaaattcaattttctctaatgttttaacatttaacttagctttggaatgcttgtgttttcttgcattacccaaaacatttggaaaatgaactcatctcaactcatctccttcccatcctgagcccaccccagagcccccatccagttccttgcctgatttcttcatttgagttaatgctaacacccttctcccagtcgttgagactccaagtcacctggactccttcttattgcttcttttggttcttctcacccctccttgccctctgttcagttgccacttattgaaccttcctccagcatctgtctcaaagcttctctttgctgtttcccctcaaacaaccttgttcagaatccaacattaccgcacatctgggtcattgccagggcttccaaactggttttcccacttcaaagtgttctctagtccaatgcttcctgaaatgtccctagattaaccttcttgaaatacaaatgcttttgtgcccctgactaaatgctgtctgtgggcctccaccaggcaccaggtaaaattccagccatccagcctcaccttcctgtgcctcatgccacactgttctcttcccagccatctcttcatatgtttttgcttctttgcttttattcagtcagtttcctacacttcaaatgactccatctccaccctagagttccacctcctgaaaatctcatggtccagccccaaagccgtttcctctcgaaggctccatccagggagcgatcttccgccatgtcctgcctcctgcattccttgcccttatcacttttactctataggatatttctgattattatggtttccgtgttgtcacatgcctacatcattgtaagccttggagagtcaggtctgcatctcctaaaacacctagactagggtcttgtacttagcagacagctaacctttgttggataggtgcatgccatcatttaaacccagaaagctcaataattagataaactcagagaaatgttttgtcttttcagcaaaacccaaaatcacatatgtagagaaccagactgccatggaattagaggagcaggtcactcttacctgtgaagcctccggagaccccattccctccatcacctggaggacttctacccggaacatcagcagcgaagaaaaggtatcatgctccccaggagtttcagggccttggaatgcagactcaaagcagattgagtctgctcatgcccagttctctttggggagctgggagatgggttatggtcaccagaggccacagccagatcccggggcctccctccccaaccctgcaggacatggcctgctcatcatccccttgtaatggaataggcacaattccttggataggttggtgggggcgtgatgtatgggcatgctcaagttagatgttctggggaggaggcaatggtgattgtcaatcccagagttatggagctgtgagggaacaaagagaaggcaatatcctggtccaccaggtgacattgtcatcatatcaagggcaccctaggaaagatctcccagaaataaccaggctcaaaatgaacctattaattctttttcttgtgtttgtatactcatgctatatatgcacttatgcacaaatgcctggttgccattgtgtctgcctgtattcttggtcacatttggataccattttgttctaaaggcaaaaatatttagcagtttctaaatgaggattacatcctggtttttcaatatattcatggagggtttaagaacattgtagcaaccttcctggcaaattaaaatggcgggaaagattgagctttaaagtccgtggatttgtaggccaccagaaagctatctttattgttgacaatatataaaaactgaggtgaccccacatcatacagcccttgattattgagtgggccaaaagtaggaggaaaaagcttcattttaatgcaacttaaaccgtcttatggtacttctccaatctcatctcgtatatcctgtagtaatgggctttgttttagttagcccaagttttgtcacctagtcaggaataatggccttagccttatggaacatttgtaatggattgcttattgatcagaatgtcaaaaatgatagattttcactcttctgcctgcctaaaggaaatctctagagagagtaaactcaaataaagcccgaaaggatagtgtgaaattccagagttaaatttgggatttgcatttgaggagctgatttctgtcccactaatagaaaacaaaactgcatcaaatggaacagaaattgctcttccaaataacctattattttttgcaacttttacctgcagagttaaattcaccttaacaaaaagtcaactgaggaactgctaaatatttttgaaacccacatatgctgtttgaaactgtgaaaaccagctagattaagagatgtggtgtttacttggatactttctttatcaacattagaattaaacccttagctaagatttcagccccactcatgtgtgttatgtggatttaatgtacatttcagggcttaaaccacaaggctgctgcttggcagatctttctacatcagcttaaaagtagatttttgtccagagtgacccagtgtatatctttgacctacagtgaaggacagaaataatatctatctcagatgaatgatgcttttgaattctatatcttttctaggaatagctcaacagccaagctagaccagaaaggttattaagatttgtgcctactgaggttctttaataggttggcacttctggcttgtagctatgatttcatttttttttttttttttttttgagacggagtctcgctgtcgcccaggctggagtgcagtggcgcgatctcggctcactgcaggctccgccccctggggttcccgccattctcctgcctcagcctcccgagtagctgggactacaggcgcccgccacctcgcccggctaatttttttttgtatttttagtagagacggggtttcaccgtgttagccaggatggtctcgatctcctgacctcgtgatccgcccgcctcggcctcccaaagtgctgggattacaggcgtgagccaccgcgcccggccgatttcatttttatagaatgagaataatagccaggaactaaaacacattcatacttgctaaatatggagacaggtgtccagcagagactgtctcaagcctagtagtgactactttttatataattctgctatcactatagatcatttgtcttaatcttagatcattatttcagcccagctacattggttgtattgtatttcttttacttgccttcaagttcactttattggaacatgagtgaatcggtattaaaacaagtcctccaaatcagctggtgatgtgacaccagactgacatatttgcctaagtgaaaccctatataagaaaatttgccatttctgttaattatatattgacgtcaaagaggcgtattgtccatcttacactgtggatagctaataattaagaaaacaaatataggctgttcatgaactggttggagtacagaaaataaatttcacttttactttggcagcctctcctcatgttctcctccatccgaagttgcttctatataattaggaatcaagattactagcatcactgtaattgtaggagtggaaaacaaccattttctttttaaaatcagggtgatatgctaagcaaacaagaatagatgattgtatctaattggtcaggtaaagaatcctcctgagatttagatcacataaaatgctaaaatcatagatgttcggaaggcaccttttgaggtcatccagtctcacctggcaccctggcctagcatccttgccaggaagccagtccgtccctgtctgaagcatgatggtgtcagtcctctgcaggggagttggccaatgctgaagagcagaaagagctacttccttgccccttcctctactcagtcctcctagcctctgccactcagtcctttgcatgagagacattaaaaactctccgactttcctccagtccactcctcttaccttgaacataccagttattttcactatttctcatatggcatagtttccataccttttatctttctggttgtcttatacgagatagtttcagttcactagtgctcccctaaaattttgctgtgctcagtgtaattaatgcagacttcaggagggctactgcctctttgatctggatgccatcatgcagaaaaaggcacattagctcttagcagtctccttattctgttgcctcatattgagcttgtggtcaactaaaatgctcaggtcttttttacatgatccccatttaagccacatatcccctatcctgttcttatgcaattgattggttaaccgatattgcagaattttatatttatttatgttaaaaattgcattttgtttgttgcagctcagtgcttctcaacagggtcatggtggcaatttgggaagaggcttccttcactgggactgtactatgcattgcaagaaacttatcatctctagtccccttcctgttaaatgccagtagccacctctaattgttactaaaaatatgacacatacaaacaccctgtggcttgagaatgactgtttgagtccatctttctaaccagtcaggactgactttcattagaaattcaccttagaagtctatgtgtccagggcacttcaacccatgtgtatattaaaagtaaagtagtagagtagtcagtggagatcccagcctaagcatagagcccaagagcaggcagtccagtagccttcccaatgcagtcgtcatctaacatttgtattagctgttgcttccaaccttgtatgaacacttatttgcaatatctttgtccaagtcactgatagaaatgttgactagaacaaggtcaagtacaaagcccttagactgccacaatggcttccttctggctcggtggctcagaaggtaggccacttgatgccacggtgccacagtgctctctcatggtttgtatgactttagtggaaggttcaatgattcctttaacaaagttagttacaatattagcaagttaaagcagttttgtgttttgcttcactgctgagtttagtctagtattagtcttcttaagggaagaggtggaaaaaaggcattcaaccatagacatatagttactaactttctaatggaataccaatgttcttgttcattataaaagaaggggggagataagcaaaaacaagtacaatgagcgtgaatgtcacactctacctttgatcatgtctctgtattgagtctagttactcatttgagaatgaccattaccaatctgttaagcttcagctagttgagttggtttagctcgacaactgataatagctagggtacctaattgtttggatcatcgagatcattaaggtagatcagctgtccaaaagttgatgcatttcctagtagttactattacattgaccaaaaaaattgaccatcataatgggtcaatttgatcatctgtatgaaagtcattgtgatacctcagaaagcttctgcttccatgttatttcactactcatcctgcccagattccttttaaatattgccaggtgtttgagtgagtggtgctaaattccaggtttcatttacttactgactgagacccgtggatgatgatttacgtactctatccctggcagaaaaaatccatcatatgcctctttgaacatctctatgcctttgaaatgactgacaaaggcctatgaagccttattaaggaaaggagagcagtgaagaattgagatcagaagagataggaaaaatgaaaagcattctgtgaaccttgaatcttaggctgacagaatatcccacaagtaagagagaacttttgaagttctggattctttggaagctggagtttccttttcacgagaaaaaaattcctcattcagtacaaacccagggcccgcttttaaacactggaaaagatgactgcattaagcaatcagtctggtttatccagcgtgtgggcacatgaataatggaatacctaagaaaactatagaaatgcttcactttattttatatatgtgttcctgcagacttgtgtgtaagacaataaaatatgaatatcaaaacaacctagaacaatttttggaggattactaatcacactctgatttatttcataagtgtgtacatttgcatatcaggttgtcctaatgtgggtcacacattcaccaaattgttagggccgagatatttcctatctttccaccaggcacaaaagtagaaggttatgttactggaagctttgtgttactagcaactacttattctaaaagccacagaaccatagtgatttgggagagacacaaggataatcagatttgaaaaaacatacaactcaatgtgatagagtctctcaaaagaaagatcttgattcctgcagccctggcatgtaaccgacaagcttctaagtgatgtggaattggcaagcacatttgacgtgttggcccaccgttactttggtctctgcatgttcctctgttctcaccttcttcttcattcccacatcatgtgacataactcgatatttccatctcatttctcacaaaagttccttgcatttagtggactcttactaaatgtttgctaacttatttgcattccctgggttgcgttgctatgattctggcatcttttctatcctttttccatctgaacatcagagacaatcgggcagtcttgccaggtaataaaaagaacaatgcagctatcatgtctttgaatcctagtatgaaaaacagataaactgtaaggagaatagattcccaagtgctggagaaataaaaaaatctagatgtgggtggaaaatccctctaacctctgtgtccctgggttggcttgcaaatgccaacttgtgaatggaatgccatgtttgatggagatggtacatgctggagtccacataccatctgtgcattctctgctgttaaggactggagccctccctcaaccacttccatttggtatcctcaaagcttcctgactcctggtctcaaggacttcatacttctcattcctagtgtacctctctgctccttgctttgttcctttttggcaataaaaatttgattttaacagaatgcatgcaaagagttgtaaaatgcatgagcattaaatggcattagtatatctatgataagctgccttataaaatccaaagaaggagacctattctctctctctctctctctttttttttttttttttttttttgagacagagtctcactctgttgcccaggctggagtgcagtggtgcgatctcgctcactgcaagctctgccttccgggttcacgccattctcctgccccagcctcccgaatagctgggactacaggcgcctgccaccacgcccagctaattttgtgtattttttttagtagagatggggtttcaccgtgttggccagcatggtctcaatctcctgacctcgtgatctgcctgcctcggcctcccaaagtgctgggattacaggcatgagcaaccgcacccggccagaggagacctactctcttaagtgtctctagataatgtggttagaactagtcatgtcaccaaatactatgagcaatatttaaggtattttggaacaagagcagtctggtcctactggtattcatatctaggtataccaaagattaggaaaacctgaaccttttgaattatacattttaatgtgcctaagggggaaaaaaagctggacataagctaaatcctaaattaaattgtgtaataaacacaccattgaaagtgggccttggaaaaagttctgaattaaagaaaagctgcatgtgcacggaatgcagtgtgatacattctctaaagcaacatgttgtaaaattttactgctttcttgttgtgttttatatcttgttttctccaggcttcgtggactcgaccagagaagcaagaggtatagcttacctgaccactagccagtctttagttttgaaagcattacagtttaactcaccattgcagtttaataaccagacatgctaaactaattagtaatttagctaaagaataggtcgatagtggtagacattacttagcaatagtatcattttaggatgagcaagcaagctgtgttgggagtggatgaacaaatccatattatttcctaaaactggatcttattctcttgctggtgctggtaaaatcacatccaggtaattacaccaatagaaataaattgcccccaattcccaggccaggcattttgaaatggtgaaagttttttgactcacatggttgatgtggctctggaccataaagtcacagagttagtgatctaaaaacccactcctccctttcctttccagctcaactcatcttgttgctcacttattttataatgatcagtcttggtaaattatcacatcacgtttcatctcaaaagcaatgcaaatgacatctctcgttggttttcccaaattgctaaacgtatctctgttacttttatagagcattaaatttatgagattagaatgatgtggtacaaatggttttatgttttttaaagtcagtagcatttaacctttgaaatttctctgactcattgcttcagtttggataatgtgggacttagtttgaaaactgaagttaagtattaatctttaggctttgattgccacatctcaagaccctacttatgatcatgactataattttttacccgatttatatgaagtaacatatagtgaaaatgaaaccagtggacttcagatgagattcaaggatctaatctctaaggacttttttaaagttgcctttgccttttatccagatggggctttgatcgtgtaatgctataaatgcagaacatcatgatcctatagattctgtattttaatttggtaaatctatcccttagtctttcagaaatgataattattcagaacgtataactcaagtgttcaggtcaaggctatacatatttatatgctgtttaatatttaaaagttgactgcctgtccccaggcactgatcttagtttctgcacatgaacaggctgccattgtcaaattcagttcattataaacttcctgtgtataagactgtcctccctgtcattgggatgactgttaagtgcacagcctcactgagaggcttcccgcctgtggcacaggaatcacttagtgctgtcacaggttgggtgctttattgtccaaaagtcatggacccactgggattggggaagagagagaagggttaattatcagccactcttaagcagctacagatctcattctgcttggcctcatacaactttccttgtcattctcatttagagctggttgaggaggagctgagatttatcagggagcattaaggagatgttaagagaattattattgtaagtggaagtaataggtttactcccatgaaagcagacacctcactctgtttttcagaagtgtccttatcatgagtgtcttactttggacgtaattgactttcaagtgaatgctgcccctagggctcagaagttccattctctcctgtttgtctcatttggagatgaagaccataagtccagatgagtgcaaaagaaggctcaggttatggccagtttcattttgtaagttctaaaagcattagcacttttacctggaaggagggagacaaaaacattttgatgagaagaataattatcattaaccttcatatttttggggaaaaaaggagttttcttgccatcaatatcttttcatacttgcccagagctcatctcctccttctgctgcagcctgggtggtcagcatgactttttgtctggatggctggtaggtggcacaccctgaagttgtgcaggagccatagtaaaagcatttcaggggaagatagtctaatgacactggagtctatctgtgtatcctcaaagggagaactgggcatctggcagataattccatcatcaaatctgtagtgagcctactgcaaaataagaattctctttagaaggctggtctgtggacatcattaaacaggagaaatttccacatggagaaatttcctgaaagaaactagataggaattaaaaaaaaaaagtatggctgttcacgcaactgttttctaagcttcccttcaaccatttctagactattctgagtaaagacttggaatatcccctgctttgttgtcgttaaggtcctgttcttgcgtacattcatttctctgcctcttttgttacaacatctcttccttatggaaatgttctcttgacttccagaagagtattgttcaatttccaagtttgtgtgtggtggccccaggacaagtctggtctgtgtcacaaagaattttagttcagttgctggttgatatcacagagatcaccagaaaggccaggggttgtccttaagttccctctgcctgcagtcctgctttgttttggacaagtaggagtgacaagcaggtcagcacagccctttagagatacctgcagggatggccccatgctcttgaggccactagtctagactcacgggtaaagacttgtgtatgatgtatgaaaatagccctggaggtaggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttctagccaaggaaaggggtgacagacagcatctgaaaaattgggtcattcccaccctaatactacacttttccgatggtcttagcaaacggcacaccaggagattatatcccgcgcatggctcagagggtcctacgcccacggagcctcgctcattgctagcacagcagtctgagatcaaactgcaaggcggcagcaaggctgggggaggggcgcccgccattgctgagacttcagtaggtaaacaaagcagccaggaagctcgaactgggtggagcccaccacagctcaaggaggcctgcctgcctcttgtagactccacctctggcagcagggcatagccaaacaaaaggcagcagaaacctctgcagacttaaatgtccctgtctgacagattggaagacagcagtggttctcccagcatgcagcttgagatccgagaacggacagactgcctcctcaagtgggtccctgacccccgagtagcctaactgggaggcaccccccagtaggggcagactgacacctcacacggccaggtacccctctgagacaaaatttccagaggaacgatcagacagcagcatttgctgttcaccaatattcgctgttctgcagcctccgctgctgatacccaggcaaacagggtctggagttgagctctggcaaactccgacagacctgcagctgagggtcctgactgttagaaggaaaactaacaaacagaaagaacatccacaccaaaaccccatctgcatgtcaccatcatcaaagaccaaaggtagataaaaccacaaagatggggaaaaaacagaacagaaaaactgaaaattctaaaaatcagagaacctcttcttctccaaaggaacgcagctcctcaccagcagcggaacaaagctggatggagaatgactttgatgagttgagagaagaaggcttcagacgatcaaacttctccgagctaaaggaggaagttcgaacccatggcaaagaagtcaaaaaccttgaaaaaagattagacaaatggctaactagaataactaatacacagaagtccttaaaggacctgatggagctgaaaaccacggcacgagaactacatgatgaatgcacaagcctcactaaccaattcgatcaactggaagaaagggtatcttgatggaagatcaaatgaatgaaatgaagtgagaagagaagtttagagaaaaaagaataaaaagaaacaaacaaaccctccaagaaatatgggactatgtgaaaagaccaaatctacatctgattggtgtacctgaaagtgacggggagaatggaaccaagttggaaaacactctgcaggaaattatgcaggagaacttccccaatccagcaaggcaggctaacattcaaattcaggaaatacagagaagtccacaaagatactccttgagaaggacaactccaagacacttaattgtcagattcaccaaagtggaaatgaaggaaaaaatgttaagggcagccagagacaaaggtcgggttacccacaaagggaagcccatcagactaatagctgatcgctcggcagaaattctacaagccagaagagagtgggggccaatattcaacattcttaaagaaaagaattttcaacacagaatttcatatccagccaaactaagcctcataagtgaaggagaaataaaatcctttacagacaagcaaatgctgagagattttgtcaccaccaggcctgccctacaagagctcctgaaggaagcactaaacatggaaaggaacaactggtaccagccactgcaaaaacatgccaaatcgtaaagaccatcaaggttaggaagaaactgcatcaactaacgagcaaaataaccagctaacatctcaatgacaggatcaaattcacacataacaatataaaccttaaatgtaaatgggctaaatactccaattaaaagacacagactggcaagttggataaagagtcaagacccatcagtgtgctgtattcaggaaacccttctcacgtgcagagacacacaggctcaaaataaagggatggaggaagatctaccaagcaaatggaaaacaaaacaaggcaggggttgcaaccctagtctctgataaaacagactttaaaccaacaaagatcaaaagagacaaagaaggccattacataatggtaaagggatcaattcaacaagaagagctaactaacctaaatatatatgcacccagtacaggagcacccggattcataaaggaagtccttagaggcctacgaagaggcttagactcccacacaataataatgggagactttaacacccactgtcaacattagacagatccacaagacagaaagttaacaaagatatctaggaattgaactcagccctgcaccaagtggagctaatagacatctacagaactctccaccccaattcaacaaaatatacattcttctcagcaccacaccgcacttgttccaaaattgaccacatagttggaagtaaagcactcctcagcaaatgtaaaagaacagaaatgataacaaactgtctctcagaccacagtgcgatcaaactagaactcaagattaagaaactcactcaaaaccgctcaactacatggaaactgaacaacctgctcctgaatgactactgggtacataacgaaatgaaggcagaaataaagaagttctttgaaaccaatgagaacaaagatacaacataccagaatctctgggagacatttaaagcagtgtgtagagggaaatttatagcactaaatgcccacaagagaaagcaggaaagatctaaaattgacaccctaacaccacaattaaaagaactagagaagcaagagcaaacacattcaaaagctagcagaaggcaagaaataactaagatcagagcagaactgaaggagacagagacacaaaaaacccttcaaaaaatcaatgaatccaggagctggttttttttaaaagatcaacaacattgacagaccactagcaagactaataaagaagaaaagagagaagaatcaaatagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagacagattcacagccaaattctaccagaggtacaaggaggagctggtaccattccttctgaaactattccaatcaatagaaaaagagggaatcttctctaactcattttatgaggccagcatcatcctgataccaaagcctggcagagacacaacagaaaaagagaattttagaccaatatccctgatgaacatcgatgcaaaaatcatcaataaaatactggcaaaccgaatccagcaaacacatcaaaaagcttatccaccatgatcaagtgggcttcatccctgggatgcaaggctggttcaacatatgcaaatcaataaacataatccagcatataaacagaaccaaagacaaaaaccacatgattatctcaacagatgcagaaaaggcctttgataaaatccaacaacccttcatgctaaaaactctcaataaattggtactgatgggacatatctcaaaataatgggagctatttatgacaaacccacagccaatatcatactgaatgggcaaaaactggaagcattccctttgaaaactggcataagacagggatgccctctctcactactcctattcaacatagtgttggaagttctggccagggcaatcaggcaagagaaggaaataaaggttattcaagtaggaaaagaggaagtcaaattgtccctgtttgcagatgacatgattgtgtatctagaagaccccatcatctcagccccaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctgggaatccaacttacaagggatgtgaaggacctcttcaaggaaaactacaaaccactgctcaaggaaataagaggatacaaacaaatggaagaacattccatgctcatgggtaggaagaatcaatatagtgaaaatggccatactgcccaaggtaatttatagattcaatgccatccccatcaagctaccaatgactttcttcacagaattggaaaaaagctactttaaagttcatatggaaccaaaaaagagcccgcatcaccaagtcaatcctaagccaaaagaacaaagctggaggcatcatgctacctgacttcaaactatactacaagactacagtaaccaaagcagcatggtactggtaccaaaacagagatacagaccaatggaacagaacagagccctcagaaataatgccacacatctacaactatctgatctttgacaaacctgacaaaaacaagcaatggggaaaggattccctatttaataaatggtgctgggaaaactggctagccatatgtagaaagctgaaactggaccccttccttacaccttatacaaaaattaattcaagatggattaaagacttaaatgttagacctaaaaccataaaaaccctagaagaaaacctaggcaataccattcaggacataggcatggacaaggacttcacgtctaaaacaccaaaagcaatggcaacaaaagccaaaattgacaaatgggatataattaaactaaagagcttctgcacagccaaagaaactaccatcagagtgaacaggcaacctacagaatgggagaaaatttttgcaatctactcatctgacaaagggctaatatccagaatctacaatgaactcaaacaaatttacaagaaaaaatcaaacaaccccatcaaaaagtgggcaaaggatatgaacgacacttctcaaaagaagatatttatgcagccaaaagacacatgaaaaaaggctcatcatcactggccatcagagaaatgcaaatcaaaaccacaatgccatactatctcataccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattacaaatcattctgctataaagacacatgcacacgtatgtttattacagcagtgctcacaatagcaaagacttggaaccaacccaaatgtccatcaatgacagactggattaagaaaatgtggcacatatacaccatggaatactatgcagccatataaaaggatgagtttatgtcctttgtagggacatggatgaagctggaaaccatcgttctcagcaaagtatcccaaggacaaaaaaccaaacactgcatgttctcactcataggtgggaattgaacaatgagaacacttggacacagaaacgggaacatcacacactggggcctgttgtggggtggggggagcggggagggatagcattagcagatatacctaatgtaaatgacgagttaatgggtgcagcacaccaacatggcacatgtatacgtatgtaacaaacctgcacgttgtgcacatgtaccctaaaacttaaagtataattaaaaaaaaaaagaaaaagaaaagaaaatagccctggaatgtatcagcactgtcagccctcaaaaatccagtatctccaacaaactgggtgtcacaaggctttctagtgaagtgttccacacctgtttgttgtcatctctcattaatgtgtggcatctcctgggatgcatctttcaaccaaccagcatcccagatttataggtcaaagcagaggatcagagaactcatcccagggaggaatggcacttgcagaaatgggcagccatgactttgcttgactcttctgtcttcttgctagagttgttttttagcttccagacatgaaatgcattggggctcagatgaccggaataggctagatctgtcagtgatggtccaagggacttttcattggtaaatctgctgagactgctgaacaaggctagtgatgccttgcttgtgagcttcctaatctggctgctgtatgacattgcaattctgggcttcagggccccaaaccagcatatccaaagaacctgaagccaattgttctgtcattctttaaagacccaacgcatgggatggcagatgccaggtgcagaatataacctcctgtccatccctacagaacatcatatactggagacaagagggcccagcctacccagaacaagaccctttctccagatcactaactttcttgaggatctgaagttaagccacatgcctagactcttcctgggccagcaaccattttacttagaatgtcaaggggaaatccccttggaaatactccagtacccattgcctaaggactatgtgcttattctctttttgaccaatcattataattccagagatttaggaagcccattgctgtatcaaggactataaaatggtggtggccaaggtgtcaaggatcccagacctgcctaggactctctgtgccattgtccctggagagagaacccagttactctcacttccagtgcagtggctcctgatctttgagttgtttggcttgtttttacatgtgattatttcacttttaaacatccaggaaagaggcatctgcagaaataaggatttctttaataatttcttatgttgggcacttggaatgtcctgccacaggtacatgcaccatggaactggcaagtgggcagacagaaaggacaggctggcagtgcaggtttcccaggatctcatgaggtagggctgctgctgctgctgctgcaatatctgctggccggaggctttgcttccattttagacatcccaaacaaagtcatcttgggggacctagccccaaaccaatcttggtacttagatcaggctgcctgacataactgagtctcattttctgtttcggatactcccaggttctcatgctgcttcccagtgcctcccccattagatggtacctaaagtaagaaagccattgacacagagaggagagaggaagtgagacgggtcacagacaagtgatggcctagtctcccagcccccatcctgccatagcactgttgcccttcaccctgccttgggctctgacatgctcccttcccccccacccccggcagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatgtaaggaataaatggggaaggacctgggggagggaggggcaaggcagggtcaggatgagagaggaaaacatcagcaaggacctatgtgcaccctgtgtgttctgcttacgttccctgcagctgaccctgggctatttcagagctctgttcccaagccaccccctacacaccatctccaggcttcttacaagcctgctgtgcccttgagtcttcttcccatgctgtgcacaggaattctagaatggccctgacctctactataccaggcgctggctctgctttggagcacacctgccttcccagtgccaggagacaggatatgggggcttcataatcatggcagtcatcctgacagtcattgttatttattgcagatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgagtcaggatgggggtgggacagagcagagaaagcacagtttgactctaggtgggctccaaaatgcagctcaagtcctctctcctgcttctctggcacatcctgagcagggaaggcatgggctagagaagacactgagcctcttttcagctccccttcgcccactctaccagtcccctccctgaatgtgcctctcccatgagcccctctgctattcttttctcttgtttaaggctgggctggagctaatgatttatactttactagttctgttttttactaacttaattcagtaaataaagatctgagtctgtgaccatcccataggacacttgtaacccaatagcttcttccttctaaaggtgaccccagactctgagaatgattttgggaactacaactgtactgcagtgaaccgcattgggcaggagtccttggaattcatccttgttcaagcaggtgagtgtcccttactcacctgagagcagctgccacaaccccccacctaaccctgccagcccaatttgtgtacttgagtgattccaggatattgggaagaagaaagggccagggtcagcaaagccagagagttgggaagctgggagccattggatcagcgcatggggcatgttgggggagaagcatctggtgagatgggccaggaggacaggatacagtgacaggattcccaagagtgagcagaaatgacagagatgtgccttgtgactgagagttaatggtcttgggccaaactgggctcacctgagtctccatatgtgtcttccccacagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaaggtgagttgggcgagttggtgtttccattgggatcatgagtgcctcagtactcagatgtccccacctgccatcctgggcatgttcctacagaatcaggaactgcacctccagaattaggtcaaagtcatatctgcctgtagagttgttgcccctattgccaccccaacccatgctctgtgcttcagagcctggttctcatgacccttccagtatggatgaaggcatctgtaccacattccaggcaggaaccttgtgtaggttctgagcgcagccagatgagtccagcccataggttctgagcatggccagatgagtctaatccatcctactctgcacgtttgagttacctgtgctgcaggttctctgccgacacccggccagtcctgcttggatatctgtactcagggactggctgtcttgtaattgtgatagtaaccaaataagcacagccagcaggacaagtctgcccttaaatcagtcctgtgctagctttccaagctaaagattaaaagactgacccttggattactgcagtgtgaagattctgagcccagatcatctgaggataatgtgtgcttatgttggactcccctttttgggtttaattggaataactcagtgaagtatgttttgtttctgtacaaatttttaatcctggtctcgtatgtggtaattcgagtggaattggaagtaggctgggatatcagtatcacagccattcagagacatagtccagtgcagtttcactcagaattagttctgccagaaagtttccatcacttcttcagcttctcgggggagccagggggccgagaggagctgctgggtaatcaggattggagccagaagaaagcaatcactttgccttcctaacttccctctgaaatctcataccaattttgtggcaggttgatctcatgtcactatctgtccacccgacttttttttttttttaaagatcaattctagttatttttattataaaatatacataacatacattttacgttccatcatttttaagtgtaaaattcagtggcattaagttgtaaccatcaccaccatccatctccagaactttttatcatcccaaactgaaactctgtacccattaaacactagctcttcattcactacctcctcccagcccctggcaaccaccatgctttctgtctctatgtagttggctattctaagtacctcacataagtggactcatatggcatttgtccttttgtggctagcttattttatttcacttagcataatatcttcaaggttcatccatgttgtagcatgtgtcagaatttccttcctgtttaaggtggaataacattccattgtatgtctatgccacatttcatgtatccattcatcagtcagtggtcatttgggttgcctttcggctattgtgaatgatgctgctgtgaacatgggtagcccaggtatctgtatctgtttggtctgccatctgtatctgtcatttgggtctgcctttcggctattgtgaatgatactgctgtgaacatggacagccaggtatctgtatctgtttggtcccgactttcaattctatgcatatgcccagaaatagaattgctggaccaaatgataaatctacagttaattttttcaggaccctccctactgtttttcagagcggctgcaccattttaacaatagactcttttgtcatccttcccatattataacagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccgtaagtaaagccagctgccccccttttcccagcccaccttcttctccctgggggcagtggggaaccctgagctggcccatgtcattgttcagaccacagctttttgtctttcagatccctctgctcctggaggccccacctcctagttctctggttctcagtgacagctaacacacagtcccttcattctctctttctccaaggggttggggacactgtcctagtagccggtccagcttgttagaataacagtgaaggggaaggcaccaacacattattaaaggaagtggggagaaaaccaggagtgagttgtcaaaggatctgggaaagttgcttttcgacaggccacagaagccctaagcaccctgtgacttgcaggaagagggtaaagatggtgacagttcacataatgcattgcgggatctttgatgcagcagagatattaagtcagagacaaatggaaactgctatagaatatgtgagcagcagcagaaacccagcaaagccaaggggaagaggtagccctggccttggccttttctgctcctctccctcccatagcaagagcattcctcacggcctctttcaagagaattgcttccccctgattccactcagggatgtatctctaggttttcctcggccattccctctttcttttaactacgcctatcccactttgccctcccttcccaccagcagccaggctgtgggcaagccctgctcctgtcatacccctttgcagacagagatactaccctgggaagctcctgagtccacccagctaaagaagataccgtagaactaaatttctgagtgttcacagagttccctgggctctctgacccctggatttaaaatgcacctgggagaatcctttgcttccttctttttgaagccaggggcctgcaaagggacccactgcccttacctcttcccagaaataggaaagcctgtctcatcttccttctacaggagtggcttctttctctggatttgaagtaatttgataatttgagtttccagctccatgtgctctgcggattctattcatttcttttacatcttattttttttttcttgggtctgtctcttgttttttcttttcgtctgtgttccatccatgggaaatgcagatagccctcctccacgtaagtgcctcttcatacctcattacctgtttccatagcgttaacatctgctagttctagttcgtaatttagttctggtcccttttttgtcccctagaggctgaagtagatgatattgtctgggccctaaccacactgaccttagtctagttgtgctgttgttaacgtctgtaggttactccaagaggctaacactcttcctgttttagagcatgcaacttctgtgtctttggaaattgtgcttatttattaatttttgtgtgtgatgattaccccacggcaaagatggtgtttgctgagccaagcatggtggaagtctgcagatgggccctgaataacacgctatagccccgcctcaccttcagccaggatgccgggaaagtgaccacagccccaccaggccactattcaaaacaccttgaaaggaaaaagaacctgaaaggattttcatatttgcttttaggagataaaggaattgagctcagttgcttccttgcttcttgtctgtcagcttggtagctggaggggaataggaggactggccagggaggctcctgcagcagctgccatagtcaaaacgtagcatgaactttggttccgagccatgggcatgtcccacaggtagctgttgcagagttaaatctctagttccggtcagctctgttctttagcatgtagttacttgcagtgtgcatctcctcgtttggggaagactaaccagctaatgtaggaactcttctgccatgcatgctagggaaggggagattccccactggaaggacacccttcatcatgtaagctgtacatagaggacacagggaacaagggtaacagagagatgaactgtggtttgaccccattagcctgcagaaatgcccctaaacttcccttctcctgagatttggttcttcctaggctgaaccagaatagcggagggaggtgttacccaggcagacacagaaaaaaaggtattcaggaagctgtacagtcttttcataaaaaggctcccagctcctgaaaggtacccaaggaagcttatctttttaacattattcagaaatattgcagcaacagcaaaaactaagtagctacatgtaggtattctgagattttgagcaagtgccaaatgtcctacctcagcagagttggtgccgggatgaaccagctctcgaaggcatcagagttgggggatggagccttcaggccggactgacaggtacctgctctgggcctgcagctatgccctaagcaagttcgagaggagccactctgggcatgagggaaccttccttctggatcttcccctgatctttaacttgtggttcaactgagtctccaggtttcctctggtctggatttgatcagtaaatgaatgctggcttagttacattaaagagaggaaggctgggatgaggcccccctctgagtttctaaccagtaactggagtttgagtactgaatcagagtaactgggtcttggacttcaaaggccgcagtggttttcattcattgccagctcagttcttgcaaaggtgagaccatatatatagatatatagatatatatagatatatagatatatagatatagatatatatagatatataatatagatatatagatatatatatagataatagatagatagatagatatagatatatatctcagaagctatatttttaaagtcaatgttaaaaatgaaatttttaatgaaattttaattttaaattaaaatttagatttttaactacaaaaaagaggtctccagaccttgttgtttattgtctgatagtatcaaaatggataagtaaccacgactccaagaagccctttggaaaaggatggtgtcatctctgcattccaagtaggtcatgaatggtacaacaacaggcattgttagtggtacagaaagtcagtttttctcaatcatttaataaagttaaggtctgaagaatcaaaaggcaaacttcttttagataagtagaaccatggcatattcttagagttgagcacgccttttgcaagaattttagcaggatgaggcggtgaacatatgggaacatcatattatcaccaaagataacttattatggtctttctttgtgccctgataaccttcccagagttgctgaagtgaggacttagcccacggagtatcctgctgcccctagacccatcctgaaaacagatatcattgggaggatgctgccagcagttacaactgctatgacaaacccacccttttgctgctaggaactgaggacgagccttaggaaggaccttctctgaattcttactctcatttcttggaagacacaaagattgtctgaacttaggtagacagaaccaaccaccagtttagctgtgtgcttgcactgagcccaagaaccagtggcattggtttctgatgccagcttacggcaccactgacactgcacccctgtcctgtaatactgttgggatgcagatgcacagcaggatctcctaccactggagttgtgctctggttataccccaagccccaaggaagagaaggcacagagtcagcagaggccagtgtgctgcacaggcaggtgttgctgccggactcctgggctgccaggtgtcaggtgagaccagcgcatttggcactgactcatcgcttgaagttcgttgagatgtctcaataatggggttgctttcttggttctttaatagacctttccatgtttagggacatggatatatcagagcagggatgagcagggggagctagtaaaagccacaaacacttaatggactcttgttttcaagctgccagttagtaagcatggcttacctgtttggaggttcctttgtgtgtagttcatgaatgtgcatgaaggtaatgaggaagctgtgaccccagaccaacaaataaaactctaacctgtgagaatgtgcctatttcatgtattttttaagccaaatgtctgcatgccatcaagacactcaggaggaaagctcaaaacctctgtttgccttgagacgggctgcttgtgtcagactccttacaactagctaggaatcttcccctccatgactgagctacccaccttcataatttcattgcccaaacattacctcttaatttgcttctgtaccatgaagcaaaatagattatttctttttgaatatagagattatgaatgagtctctactttttttttttttttgagacggagtctcgctctgtcgcccaggctggagtgcagtggcgggatctcggctcactgcaagctccgcctcccgggttcacgccatactcctgagtctctactttttaaaagaggcatcttgagatttttgttttcatatgttgtcccccaggtggcacattgcaagtataactatgcaaacaattcaagctaaacaaagaaaagagagggaaggagacctgaattaaccagaccatccaataatgatgagttatgattctttgttgctttgattccagtgacactgtactcatggtttaatgagatgccctcatgtggaaggtaaaggaagacaaaaccatgagtattagatattaaggcagtggcggagatacactgaggtttttccaaattttcatctagctctcgaaggagactttgttttgtgactgctgatgggactacttccaaatatttgccaatgaaaaaccaaagatccattcagtgtcccagtatctcagatgcacaactaaccatcctctacacagaagactggctagaatttcagtcccagtctcttcatcatttctattccctggaggagtgagaataatcctgaacattatttgcatggctcttacgtagcagcctccaaataaccacattctgtaggggagttttggaaggcagcagtggttgcagcatcatctgtatgataaaggatcatgaacttcatacactagtacacattaggtaggagagccatttctgtctcattcattcagatgttgaaatgagtgaggcatataggttttgctataaataaagtcatatgtggaaatatatacctatatagaaacacatatatagatgtgtaacatgaaaagccaatgtctattttctccttcactggttcaccttaaactgaggtccagattccttttcctcctatacctctcgtcctatggagacagctggtcctgctgaactggatatttgttttcagtcaaggtttgaggcttgtgcagctgttcctggcccagactttacctgaactgcagggtttggcaggtgcacagtctcaaggtttgacgttagagagagccctgctcctcgctagtgccctggccagctgttcacacacggtgttgttcttcccactttaactcacttcagctcctcatactgatgccccagggttgttgcttccatttttttttcattcagtatctgtgtgcctcaatgatcttttttccccaccttcatttttctttcttcagcggcatctgctagctcgtctacccctgttccattgtctccaccagatagtgagtatcattttcttcatccatctctctgcaggtcactttccaccagccacagtttgttttgcctaatgttatctccttcaccaggtgataattcaactcagttggtggaaagcagcgtcgggttttagaggagcagttgagaagagaaacaggcatagggcttctcagatccatgaggggcagccttccctgaaggagaggcgagggaaaagcattgttctggatagaaaaccctgcaggcaggatccccaaggctgccgccctggggccagccctgtcctcaggattctgagtgggctggatcaaagctcgtatttggagaagccaaaggaattgaccaagaaaaatgtctcctctgcagggtcatagaaaatgtgttggagtgttttgtttttacccttcattttaattggcacagttggatacagacattgaaattagatagggaggcctgtagctttcgctttatccataaatgcatacttttcttgtaaatatttgtgggaaaataaacagtgtctggcagtgtctggcagatgtgcctggcagtaggcgcttaggcaaatcgtttaacccttcacaagtgagccttgtttatctcctctgtaaaataggatgagtagtcacccacgtcccgccaccctaaagaaaatcacaaacattttcatgtttatcatgctctgctttacccacatgggatcattaccaccaagccagcagtaatgtcagctggtcgctctcagatttcatcatcctggctaagccttgctcatttctgatctaattaatgttgctatcctgtccttttgtgtgcctgaatgtgcaggagtagaaggggctccaggcctgccactgtttggagttttgaacctagctttccagggaggaatagcaaagtaagaccacagctcagtaagacacaggatgtaatgccagcatctgcccagagtggcagacagcagcaaatgggcaggcagggtggtgccgcctggctggctttattctccttgatatatcagaagcccctgtggtttggactcagactcaggaggtgactcaagcctcaagctcagaagccctctgtcaccatctgttgactcagaagcatgcccaccatcccatgcagtgcttttccaggcactgtcctgtagcagacggagttcaggctttggaagtagacagacctgggttcaaatcacagctccgcttcttccgcctgaagctccataacctaggataagtcgctaagcctccccaagtctcagatttcttacctctaaggtgaaggatggattccacttaccttttcagtgtttgtgaaaattaaagattaaatgtgaagaacacaaaacatactgctcagcatttagcagctggaattaatagtaagaataaatgagagttatgttatctcttgctgcatgaaagtcatttgtcagcaaaatctctgatcatctcttttaaatatgtatattaagagtcttttaaatatgtatattaaggcccagcatggtggctcaggcctgtaatcccagcactttgagagggccaggcgggtggattgcttgaggccaggagttcaagaccggtctgggcaaccttgtctctactaaaaatacaaaaattagccaggcgtggtggcatgtgcctgtaatcccagttacttgggaggctgaggcaggagaattgtttgaacccaggagatggaggttgtaatgagacaagatcgcaccattgcactctagcctgagtgacagagcaagactccatctcaaaataataaataatatgtatattaatattgatagagaagagagagaatacctccttcaccatctttataatgatgcctacatatgtataatatatactcacccatgtatgtatacatatatagctatgagtttaatttatctccattctctccttcacctttctttgccttttctgtctgtcatgtttccatagcaacttggcctcttcctgcccttgcaaccacagaaccagctagtgagtacagggctgagttgctctcggccagacctctgatcgcttgttgtagagccgacttctagattacagcgctgcctgttgttttcccttttattaaaagcaacagttgtgaatgcatgaaggctcctagcctggtgtggtttcctaagcatgccgtctgcttggccaagagagcaaaccaagcatcagcaaaagaacggggttgattattggaagaatactccgtgcatgaggaggcttttccaaatcgactctctagttaaaaatagccaaggattaggcaaacgctgaggacacaaaagaacagcatctccttcccggctttcgctttgctgtccctccttctgaaatacacacgctcatgcgcgtgttaatttagcagtagcaaaaagactgagagcgagggaaggaataggagaaaatggctgcttgaggaaagggagagggtgatgccgagaaggaaggagccgctgcttcctgacagcatgcccggctttgtctccgcgtacgcagagcacaggggaaggagagagctccttcctgctgtctcctttcaggctcccgcctcagtgctagaaaaatgatgggcagaaaaagcctaatccaggctccccttgggttgagagtccagatgaaagtgctggaatttatctcttgacaatagagtcaagagccagattgtatcctcttttttcatcgtagaaaacattgcacagaatcactgctgtaacatgttccaagctggtcttcataatgctctaatgaagtaagatgtgtgtggaggacctgaatctcctgaagaatccatatgagtatgcgtgcatgttcatagtgttcaagcatcaaagctgtgtgggagttttagattttataatatttctgcttgcacagaaaaaaaatggcatacatcccatcaagcagaacaagaaggcagaaagcaggtatgcaaagtataactccagctccccgggccaagctttccaatacataattgaacagagaagaaaagagtttcctggttctgtgtgttgcatgaaatggttcttttttttctactgcagaacacagctaagggtctgctttcttggtgttccctccgtgtgtgtgctgcgatgaattttaattcctgatgcttttgaggtttcattttgtcagcagagcagagccggtgacaacaggctgtgctcgcatgggtttaattcagattatgaggggtttttttttacatttggaaaaggaatgcagctgacagccccttttcttattctacagtgtcactcctgtcctttttcaacctggtgcaatgtgtgtccaggcacagtaggagaaagctacataatgtatttgtacaactgtgtcatatttcaggtggctcactgtaggttggtcttctctgttagtgaaacacaatcttggttccagattttgcctgaagaaggaattaggtgtctctcccctgacatgtctttaatttttaaacatcagacatttctgcccacagacaaaatgcttagttgtgacatccaaagggaagaaagtttgagtcattttattttgaaccacttgactactgacccaaattgtaggtcccagtggatactgagataaaggaaagatgctcacaattgggcagcagcctgagtttagcatgaacatatttctcactagtaagatgaaatgtggcacatgtgaattgcagtggaactaatagcagagtagctatcagcatgtgaatatccatcgatcatcaatccatcagtggggttgaaaatacatatctcccagttttgcttctgtgtgtgtgcgtgtgtgtgtgtgtgtgtgtgtgtgtgtggacccatttataattatgagggaataaaggtattctaaataaaaccaaaggagcaattgcttagttgtatataatccctgcaaggcccctttggtaggaaggtgcctgaatctgtgtaatgccagacaataagaaagaagcacacattctgtcagctcacggtggcaagggaagaggtagcctggttaaagcatttctctcaggttatttttaaccagcggtgttctttacacagaaaggtgtcttcatctcccttctttgcccttctccctcagcctcaattggcaatggccaaaactttccctggcctcttaaatttaaggtcagaaacccaaaataccttttaacaagtcgagatcactcagtcacaacataggaccaaaaggaatgcttaagaaaagtgttttttttttttcattgtaaatctcaaatttatgacttatcagtgcaaccacgattctaaagatataactttaaccacaacaggttgggtgccgtggctcaagcctataatcccagcactttgggaggctgaggtggaaggatcacttgagcccagcggggccaacagggcgaaacccccatctctacaaaaaatagaaaaattagctgggtatagtagcagacgcctgcagtcccagccattcaggaggctgaggcagaaagattgcttgagcccgggaggtcaaggctggagtgagctatcttcatgccactgcactgcagcctgggtgatgaaacgagaccgtttcaaaacaaaaaactttaaccacaaatggcccaaacatttgcttaatgtcaaactctcagcacgttgggccaaaggtacagtttctgctgtttagtgtcaacacagccattgtctcaaccatcagaaggaaacccattccctagtctgcactggcctcttcctttatatgggtcttgacttcagggaggctcaccgaggtctcaggaataacatgggtttgtggagaaagaagtgagataagatcctcaaagccaccatctctggcatgcatccacccagcctcattcagcccatactcccctcctccttatgccataggaaacatgaaatgactcttcttaatttaatacaatcttttgttcttctagggcacacagtcttcaccttaagactctcgggacttttccttgatgacccatattctgtttcattgcccttgtttcccaaggatgctgagacatttctggaatctgtggataataacttgcttttttcttttcctttaacagtctcctggattgactttgacatctgggtcctgacagcaacacctccccatttcaaaacaagtttacatgctcctgatgtggtattaatatgtagtgttgcagccgtagctaatgcttattggtgttgttaaccaaatgctctttatgatttattattcttctatttctgggcagtttcactgccctcccaatgtttcctatatatgctgctaatttaatttgatttctccttttatttagtctgtgattttgttgttgatttttctccctgcccattgtttacatcagtttttaatttttttgtattttccatgtgacctcctccactttcctttcaaccaatatcatgtgcgtgcgtatcatgtgactttgtcatgtggcttgcatggtgctgatgatgtcgtccacgctggtgaacagaaggtaaaactctttgttctgattagtgaaataaatctgggaccacagcctggcacatagggcacactcatttcttcctgtctcagatttcctaagcaaagccatttgagagatttcctcttgttctcaattcacatccagaattcatcattccttgcaaacttgacatgacgatttggtatcatgacaacctttggtttggtattttgcttcaagaaatttggtcacacaaactgttctctacagtcaacccacattagccacagcacagtttgcaaacttgaatttttaccagatggttcataaaaattatttcctagaaaggtgtttggcaaattagcttgatagcattgttatttaacttcatccagtagttctaaacaccatagttgttctaaaatgagtcacattcctgtgaaaatgtttacaaccttgaaatgctacagagtgaaatatatcaattgcaaaggttgtatttgttcaaaacccagtgagagtgcttcataaaattcatgcacattgaggactttctgaaataagagatttaagaatttggattagagcagtttggctgtgattactgaggtgtcactttttaagagtggccctcccccagggagggggagaaaatcaaagcaaaagtcacttggcaattaccatgaatggagatctccgtgtaatcaagaaacacatgattgacccttgcagcaaaggaaataaaattatagcctaattaagtgcatagcggtgacaaaataattagttaatattgtgactgtcacaaccttgttaaaacatttctcgcttaccagaaggagagaaggaagcctctgctcacagcttccctcactcaaatcaaacacctattcagaacctgccctttgagtcatatgcattcagttttctcctaactggaatgttttgcttccaatcacagcctgagacattggctacatggatcacgaaagcaaaactaactccaataaccccctggtgtgcccgtgcatgcaaggggtccctgtttgacctcacttctctgagaactgattgggcgacatccacacagacaaaccgtcaacagctggtctcgcatgtcctttgttcccggtctgctcttgtgtttcgttctcctcctgtgtgttagccctgtgtaccttccctctcgttcaccctccacatttcccatctctgagcccctcagctttatagggatgtcagcttggccccaatgtagtcccatttacagccagactcctggacttgcctatgagccatcttcatttccaaaaaggcgatattgggtatgtacattgcatgaaataaagtgggaatgtcccagaagcagaaggacatctgatgcagtccacgccaataaattgggcttacctttaaaaatcatctgaatatgcaggtcttagggcagagaatatagacagcttaagattttctaaactacaagtcccacccaaaatacggtattttcatgatttcccaaaggttgaccatcagcaagactggatatttttcagacttaagatgactgttcagtagctgatgttctggaaaaagatctgggccttcaccatgaaatcttaaatgtgagcagttactggatgttgaatttgaaacctattcatttctttttttaaaacaagcttggtcatttctgtgcaatgctataattcggaacgaaacaaagcacaatgttaataaggtagacactaattcattcctctgaagagagatctcttccagacattttaagctagggcaagaaatgtttaaagatgttttctgcagttgccgtagaaacactccttagcagtcatcttggctgttggtaaaaaatgtggccggtaccaaaaaaaaaaaaaaaaaatcgctgacagccttagagaattacaaagctatgattacgccctcctggaaccatgtcctcatccatgacagaccctctcctgccatctgcaagggggcaagctgaagacttattcaggtgagccccgcacgcagcaggaattgtcctttaacaataaaatttaagagaatgaagaggtcagggccaataaaatccatggaggagagcaacaaagcttagttaaggacagttatcacctcctctccctgggtattagcaaagatttaagctgaattgggcctcaatgagaaaagtgagagtaagctggggggtgaggggggagctttctgctgtcagtgggttgtacacccaacaactggtgacatctgatgttccctgtccaccttgtaccccctcaaaaaaagaaaactgcctgggatatgcataacctaagctggatgctccatctaccctgagttcagtgggacagcgtttacagaatccagcagcactgcgtgaagtgtggcgactcagaaggagaagggaggttataacagggattgagccctatcctttatggttacttggctcctgagcctacagggcttggcctgtagaggattgtgacagataagcttagacacctgtcccagaaaagaagaagtgaggatgcaaactttgattctaaggtcatggcatcatgtcactgcagggcttcctccaatgactccacggagccgtggctttgtccaccagctactgaggactctgtgtaaatgggactccccaccagcagcatgtgtgagatgagaagccccctgcacccctctgtccatgtgctgcatgtctgagcatggcgccctccccagccattcataatgatattttttttctttagctactgacactgactcgtactaggaaacgctgattctgatgagctaagctctttaacacccactcttccttcttagattgaaaacatcactaaccaccccttccactccctcctttattttttcacagctgtgtgtctggattgccacgatctctggcaggtcgacacagacttttcaccagggtttctgctctaattgcctttatctctaaggattccctgcactggaggttcctagggtagagagtcagtgggaaggggctgaagaaaaaggcagtgaggtgtgtcagcccgaatcctgtgggcagggactgtgggcagggactgtgggctgctgctggccttggaaactgccagttcccttagggtcaccagtatgggggctgaaactccccaggagccacattcttcttcataaccaatctaatgtccatgaaatagagttgaagatgggcacgagcccccttgtggccttggaggcaggagccgagttaactgttgatgatagcagttatttctgtcataacttcctcagcctggatcagccccataaccacaagccataccttcctggtcatattttctttttaggatgatgaaacaaagataattgatcaattaatctgttggtgttttcatgacacctgcgagaagggaactggtatttttgtggttcagtctgtcagagctcgttggttgctgtttaatttgtaccttgtgctgccatttgccaccgtaccccaacacatactctcacattcataaattcctcaggaaactggtgctggaaaggatttacagaccagatgccttagtgagtgtggctgcggggagctcagcatccttgctctgcaagctgggaaccggccgtgcccacactcactcattgtgtatcccgaggctccctggagctaggaactaggatggcaaagattctggtcactcaggcacaagcaaggccttaaagctgaagagaaaagggttcagggaaaaacaaacaaaactttaccccaaaagcttgatccagcaggaacaatgcctaagacaaattaatacccactcttacactgcccggctgttcttcgggactgtccgaaagtcactcggcatccctagaatagccaggtaggttaccaaaagaggcgccagggagagacatgaggatccaagaatgtatgcaacatagatcacatccgattcttttgtttgtcgtcgagggctaagcgctttgtttcaggaaagagaatcagtggtctaataacgctaaatcctgattccctcagataatttgctgatcccctaaggaccagccacatttctaacctctggatgtaattgtaatgtttctgacttggaaaaagtaaataggcttcatatttgaatagctaaatcatacattttggacttttcaaaaactaagtgtaaaaaggtatatataacacaagtttcaaattgcttggaagaaataatcaaccaaaggagacaggagttatgataaacaaaatgaacagtatttttaaaactagacagtcttatttgataggaaaagtaaaagattgtaatgcaagccccacatttatcacaggtttacgctcagacacctgaaactttgtgcagatctctatgagggagaaaacaaagtagatgaatagagaacacagatggagggctttttgttttgttttgtttcttttgaggctgagtctcgctgtcacccaggctggagtgcagtggtgcgatctctgctcactgcaacctccacctcccatgctcaagcaattctcctgcctcagcctcctgcgtagctgggattacagacgcatgccaccatgcccagataattttttttatttttttagtagagatggggtttcaccatgtaggccaggctggtcttgaactcctgacctcaggtgatccacccacctcagcctcccaaagtgctgggattacaggcgtgagccattgtgcccagccccagatagaggctttcttgaggatgcctgtttggcaccccagcctttcattcagaagacacagctaactcttggtgctcgggctcctttgagtgagaaatagaatattgttttcctgctaaaattcaccaatgctgtccaagtaccctggatttgctataatttttgttgtggaattcagatatccagtggagttttctaactcctggggcttctgctgatgagaggaagggcatgaagctgattcagatttaagggtacagtagcagagtaattacaaacagagaacctgcaatcggcatggccagaaatatacatttcaattatggtttctaagggagaatttcataggacctgcctatgatatatctgactatatgtggcctctatggtacgttctttctttcttgggttcatgattcacatcctgctagaaaataccagaactgcacaatactttatatttgttattggcaaagtttctttttaatgttccgttggtgtagtctttacataatacattttggggggaacatttgactcatggctaaagcgaaactccaagggtataattaaccccaggggtcttctgggagcaacctgccgattgctgctgaatcgcaaaccaacatttacaaataattacaataatggttttactgaacttactcataatgatttcaatcagggcagccatctcagaacacagtgcacatcaggactctctcaggcatttcttctgctaatgtgctcgataaagcagtcagcctcctgaatggcaaggtcccttttctcccaccacagcccctccctcatcaggctttgtgtagaaagcctaagaaagtttctctaaccccatttctaatctttaagagaatttgctgacagtgaacactggaagataagacacttgatgaaacaattgctctttccatattttcatgtactcacagcaagttacagagccaccaagtcggtcaaaatctctgtgatattagttgaatatgagcttcctgtagaaatactgtcataggctgggtgcaggggctcacacctgtaatcccagtactttgggaggccaaggtgagaggatagcttgagcctagaagttcaagaccagcctcagtaacacagtgagaccccatctctacaaaaaattagccgagtgtggtggcatgtgcctgtggtcctagctactccggaggctgtggtgagtgaatcgcttgagtcatggagattaagactgcagtgagctatgattgtgccactgcacttcagcttgggtgacagagcaagaccctgtctcaaaaaaaaaaaaaaaaaaagtcataggaagcattatgtatccgtccaagaacctcatcatcttttaaaagaattaatcataacttagttttttcatttggcaaacaaaatggtgtcttatttacctttgagacttcagtgcctaatagactacctgggacctagtagatactcagtacacatctgttgaataaatcgtaggtaaagcactctaaataataaacctaaatattatttcattttatttttgagacaaggtctcactctgtcacccaggctggagtgcagtggcatgatcttggctcactgcaacctctgcctccggggttcaagtggttctcgtgcctcagcctcttcagtagctgggattacaggcacatgccactatgcccagcttttttttttttttttttttttttttttttttggtagagacagagtttcactatgttggccaggctggtcacaaaatcctaaccacaagtgatccacctgcctcagcctcccgaagtcctagggttacaggtgtgagccactgtgaccagccaatattattatttaatataaaatgctctaaattctaagagaaaataatacacacatatcagagtactgtgatagactcagataaaatgatacaaattatagtgttctaactatgtcaaatgtgttctaactatggtatagattttgatggcttttctccgattcaaattacattttttctgaaacaaatctaaagataagagagtactttcatcagggaagttggtttctgcaggattccctagagagatttttattcttaggtctttgaagagacttgggggtctcttttcaaagacaaaacttttgagataactttttcaacattttaaagcaaaaagttgacaactttctgccttagagatgtgaaattgttgaccttggagtgcatctccctaaaattggctgaaagtcgtgaattttgtgttctgtttcccacaatgtcatgagaaacagcccaggtgtagttggtagtccgtgctagtgcagtggctgtcactgtttcacatgacaacagagctggaaggagccctaaatagcatccaattcagggcccatattttgtaaatgtggaatgaaacttgatcgaggcaacagaccccccatgatgcggagttcagagacagtgttttgcaggattgattcagccttgaaaactcacacagctcaatttcaagaggaactaattaggaacgtgcagccagggaggccccagtggactgatccctaaaagggggccttgggagaaggacacagtcctcgactagtgggcatgttggaagggccactgatgctgcctataaaaatcccctccaggctagggcaggtagaccattcagcacagagtcagtgtcatgattctaagtgaacaaagttaaaataatttgttcatttgcagtaggtctagggtcatcaaccattccagtttgcctgggactgaagggtttcccaggatgttgaacttgcagtgctaaaacctggaatcttccagactaaccgggatgagttggtcaccccaatttaatcagagaatacaatttgtaaagttctcctgtgtctccttctatttgttcagcatttctgaatctacacagagctcctgccttgatctaaaatctatgccactttgagtcactttttagcactggatatctataatgacatagccataactgatgtattatctaggacttgggacagtccgaaggaatttggaaagcctaaataccttgacgtgtctaaaccaaatttctacctattttccactgaatagttgtggcctggggctagatagtggctttaaaacaggacaggtctttgcctgaagtccattcatctttttattcctgtttttatttgtccttaattattgatctaagaaaacaaataataagcacaacttttcctaaatatcctccagacattgtgcatcctccttgttgcagcttttaatctatgcctgttactgctacttctctaacctaaatgtgcacagagatcactggaaggatcttgttacaggtctaaaaagcgcccaggtgatcagcatgctgctggccctatgatgataagtagtgggctcttccttagccttctctctggttcctcctcgtatcaaaggaaggtggttcccagagtagctgaatgagaagtgaggcgtgactctcgctgtgcctgcagccgtctcataaatggccaatggtgtagttttaggtgcttagatccaatccctggtgacaagccattttgtggctcttctgtcacacgtctgtgattctgttttccagagagcaagccagagtgacccacccagaaggtaactgttttgtagcctctccaagttttctctctgaggttatgaaatagatgcagagatagctcctcacagaagtgcaggattccccagtgtgttaaatcttaattttaactttgtatatgagacgtcctctcaccttattactttcagcatatattaatgcaattgtttcttttaaagtaaatgagtgccttactcactggagaaccatcctagccctagcagtttgtcacatgcaagttcatcttccttctcgaccttggattcacagtgctacaagctgagtgtatactgcaaatcaagaaacaactgtttttctgttgagaaatgctaaagacatttttctctctctcctctcacaaagaaaaagactgcactgattgttactttaacacattaaagtcttgagaattagcactcactcatttgaaccattagtggatacttacaggaaacttgcataagagccataaggatacttacaaaaaacttgcctggggcaagttgtgatttatttaatcacaaccggaaacttcttattttttaaacgaatctaagtaataaaatgtcgttcatgaaaagccagtcccaagaatgcagcattatttactcccactagagatcaggcctcccagtcccaggggtgagtgatgtgtcccggcaagaaactgggctgttttacaaaataattttataggtgggagtttcctactcaaacacttctattttctcctatttcaggctgttcctcaagatgtgtcaggcttataaaaattaaatcttcagttgtaagaccagctaaaaggaaacataagtaccagtgagacaggggaaaaaaaaaaaaaaaaaaaaagcctattcctaaaatggtgaaaggaccctgctcacaggaaggctatttaccagaacattcccaagaggcactctcagtttgggctcagtctgaggcatctacctggaattcagttttatatttattgctttttaaccatttgaatttctgagaaagcaagaaaagtgtccagccccaccctgtcactccatcccattcagatgggttggattttcattctgtggatgagaatttcatgtgaattaactggctgtttcaggggaacccagtgcacctaagctcgaagggcagatgggagaggatggaaactctattaaagtgaacctgatcaagcaggatgacggcggctcccccatcagacactatctggtcaggtaccgagcggtgagtggcctccttctcagacttcaccagaaccctgcaaccctggcacccagcttgctagggaaacaacaggggcagcccacggggcaggggtgggatggggtcttattctgtgtctggcaggtggcccatgggccctggccatggcttaaaatcccaagacagccctacagctattaggtcatgttcacactgggtccatttggaaacctcatagatgactgtggtggtgacaaacccataccatggttgatttttctgtgtcttgaacttttctacaaagttattttgccattatctagtacttcttgtaaatgccatactaatatataagaatccctaccttggataacatgtgtattgtaggccaggcacctgcacctcactgtgatcacatgcattttctctgcacaagaaccctgtacagtaggtcttaccattatcccctctttacagatgaagtaagtgggtgtacagcagtcaataactgctggatctcacgcagctgggtgaggcagtttgaatccaagcctgactgagaggctgggctctccccactgcccaaggctgcctaaggtcctcaaacaatgccagttccctcaccagcccttcacttggccacctgagctgtcctaatcctgctaacagcaagttggctctaagccaccttctcctggtttgctcaccacccacttaagattcccctcattccaccttttatcacaacccccacactgaaaatcaccctttccattttggttttagaatgacacttggtcatcttcaactataaccaatggctgagagatttagaggccacatctgagcactgagaataacctcttgctggggtttcgtagtagagaaaagaatgaaccagggagcagtttcctttcttcacatagccccaaggaagactttttctgggaagctgagttacttcctctctgccttgtgatcagctcctgtggaagtgataggtctttaactagctagtcttctggcaagtcagttcagcacagagccccgcaggcatacttctcagctgcagaggccttgttcccacttaatttgtaagcagatgtgagctgaaatagtaggaaaggcctgtcactgccctgaggcccagtccagagatcccagtgaatgagaggtccccatggcttcctcactgccaagtagggtgcaaggattgggcaggtggcccccaatatacccctggaagcagagatgtggtaggctgggatgcctttccaatggttatcctgatgtggccccatggacagaacataggttttagagccagacagacatggcatccaattctagctttactacttattctggaagaataggtcacctaatctttcagaacttcaatttctccatctgtaaaatggggataaaatagcttattgagttgttataaagatgcattataatatatgcaaagaacctgaaatgcacctgacacttggaaacctttataaatggtcactatggttactgctaagaggcaggctcaggctggaaccatctcccgtatgacatctccaaccatgtcggatgtcagtttgtctgaggagccactgtggctgcagcaggcagctctgcattagaaagacacagctgggcacaacgctgaaatatgttagatttcaacaaccgtaaccaccctctctcacttcaaaacctcattcatgtttgctaaatattataattttatattatgaataagtataatataacattttctctagattctggttgtctcttgtataatgatgtttgccaaggaagacagagaaatgaagaggaaagataccggaattgctttcttttaaatgaaagtggggccacatagtgatatatacacatcctagcttacagcatagccagactggttagactctaaggaaactagaattccccttccagcaccactggcatttgcccatgcagcatgagcactgtcacattcctaaaggcatctctttggctagtgcaaacccttttgcctgggaggactgctttgctgtaagataactcctcatccagccttagccatgggcctacaacagttactagaccactgtccaggtgacagtgctattgtgttctgcccttccaaggagcagcctgtcatgcaataaacatctatcaagacttcttgtgtgcccagcagatatcccagggcacctgccttgtgaaaaggccaaagattgcaaagagatgggctgtgcaatggtgaaaccatctgaagacttctcaggccttcttccacaaactgtttggtgagggaggtggttacctaattattgttctttgtgggccctttgagcagcccactgttggacttgacagcagaacttagtcccgaggtacctccatctatttgctgccgttgtagagaccaggtcacactgcatggaatagaaaaaccttattcagtccaacagatgtttgctgagctccctactatagaagggaaagatcatgagaggaggagaagacaaagagagattgattgatggaaacaaatacagtttgataggagaaatacggccaagtgtttgatagatcagtagggtgactgtagttcacaattacctattgtatatttcaaactagctagaagaaaataactcaaatgtttctagcccagagaaaaatatttaaggtgatggatatttcaattatactgacttgatctttacaaattaagtgaatgtattaaattatcacatgtaccctgaaaatctgtatagctattttgtatcaattaaaactgttattttcaagaacacaattaagaaaaacaaaaaaaaggaaagatcatagttttgggcccaaacgaacttagctccagccttgactgcaggtgtgattttacgttagtcaccttacttctctctcacttccccatcactgggtttagtaagagcctgacaaaaccccacaggcatgttgtaggaatacaacaagaaaatgtgtgtaaagcttttgtagtgcctagctcttagtaagggctcaacaaaaatagttttcatttttttttttttttttttgagacggagtctcgctctgtcgcccaggctggagtgcagtggcgggatctcggctcgctgcaagctctgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccatagttttcatttttaacgaaactggaatctacacagtattcacacatcaggaaggtgagtcagccactttaacttaagcagcatcctgaaatatgacaagaaatgtacttgttttattactcttctaggacatccttatgcatatgtccccagcaccagagtgtagcctgggagacaggagtggtgcttgagtctctgcatgccctgaaggtgatgggaccttgacggtgttggcccaatgccacactggcatctgctgttgcttgtgtttgccagcatgcaaagttgacctcctgacctgtgcaatttttcaggctggtaaagaataaagaccatgtcccatcattgcttttttttttttttttttttggagacagagtcttgctctgtcacccaggctggagtgcagtggcattatctcggctcactgcaacctccacctcctgggttcaagccattctcttgcctcagcctccagagtagctgggactacaggtgtgtggcaccacgcccagctaatttttgtatttttagtacagacgggttttcactatggtggccaggctggtcttgaactcctgacctcaagtgatccacccgcctcggcctcccaaggtggctaggattataggcatgagccaccgcgcccacccccatcattgcttcttattttcatgatttcatgccaaaagttattgagtcccgtaagttttgcctattgtctggtcttaccagtacttttatctaaagcttttttggtctcttgtatccttcttgccggtttctcccagaagctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccaggtatggctgcctctgctttctgtttgtttccgctttgaattaatgcacaagtgctgcacctcctaatgcgcctgaacaaccctgacaacttgcttgcttacagccatcctcatgattggttgcccatgcaaagcttagttttgccttgtacctatctgtgcagtggggtgagatgtactggacccccaggaaggcttggccaagcatcctggagaaaaggtcctgtcccatttggccttgaaggactgatgccaatcagtccattggacccctcagatgggaaatgccccagctccagcctagccttggaagttggttgagtaaggatccttttttgagaccttatctgccatctgccacatcatacttggaccacataactgtttctaagcacttcctatctgatgcttgctttatgagcacagccatggtccaaatctcttctctgtggtgaccctaagagaaggaagagatgatgcccatttacttacaaaccctatctaccaaaggcctctcaatggaaacagattaaattgaaccacttgtaatagaacaagtggagaaaatagatgctggaaagcaccatcaatgaaagcaatccggtctgctagagactgtgatggcagcagttctcctaggagatacagatctgtctccagggatccaagacctaaccttgctggtctcctttttggccaaatccctcagagaagaaggagctcttcaactgatcactctgcttttccagaccagccaaatgccaaccccaggcaggagaggtgggcatagaacatacagctgcagcctgttggggggccccatagaccctgccatgttcaagtgtggtgggaagacggccttgggcagcccccctcatgcctgccctgtcttcagtgcttgcccggctcttggctcggtggtcatgattcctcctcccaggaggagacaggccagagggctgtggcctgcctatgatgcagggatgtatgtgcaaaaatgggctaggagagcagcaacaaaacgggatcagtgtgtggttcccagtggttgtttgtacatggatgtgtgtgtctgggagacgtgtgctggacctccagtgagttggcaggtgagttttacactgtaggtcagaagcatcaattggtccaccctgcattgacaggaaggctccccagtgcttgctggggtgggtgtttctccacagtcgctggtcagatggtcggtgcagaaggcaaggcacgtgggcaaggctgcaggaaatgtcctcattataccttaacaggatgttcaaatggaggttctccttgcttttcctctgccccttctttctctccattctttggtccattcctttacaatcgacagcttggagtgaatgtccagatctgtctggccttcatgggacacttaggaggtgagatcaggtgaggcttgagtaagccctttgcagcaagacagattccttatggcaattgctccctggggtgagactcactgggtaggctgtttggacctgctgtgttcacatgctgggtactcctagcagcactggcttctgtggtttttgtgtcagagaccgaaattctgggtagaccttgtcctccagagttgtgcctgctggagatatcagaatccttcttgtgaatcgcccaggtgcccacttaagccagagagggctgggggattgctcacctcaccggtgacggctctgtggctctcctgcacagatctgagaaggtggtggctgtgttctcggttagactttcctggccattgaattgggatccgagaataaaacctctctgaattacaagttggacatttgtggttgaattctgtggtcagcaagcagggtagaaggtgaagcggggtacagaatgagacttcctttaacagcactgtggtgtgggacttgtgccataggaagaaaagcctgcttcatctctgacaaggccatccccaatccctaagcacagtgtgctgactcatagtgcagcgatccaatgcatctccaccactatgggtaaaacacgctagacactagaagacaatacacttgctggctgtatctaagaggcttcaccttagtgaaaggtaacactctcctaatcaaactcttgtattttagcgtggaggcttctgttctctcactttaatttcatttgctcgctgatccctagcccccaaattaaccctgctgtgctgcttctggcattgctgagcttctgaactggccttatggtattgatactgcactgaaccctctctaacctttgtcaatttaatttactaagttgaattaacctttgattctgtgttttctatagttgacctaattttttttctttttatctatttttttctctgtttctgtctctaccttccctttccttctgtccccctccccttcctgtgtctgtcgtcacacttgtcaccttggacgtcactgggacatccccactgccacatttgtttttaaacaaccacattatctctggggacccattgcttgacacctgcagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtgaactcaccagcgtggcttgattttattcaatagttgtgtctgacaaagcagcaaagaccctttccctccgcctctcatgtacctggatagactattacctagagaaatagtagcctggtgaatgaaatactttttcttcctaacggggagcaatctctttttcccaggcatcctaagagctgttaagaggcattgctgccttggagtccccagcaggcagtgggaggggaaaatgcctttgcagaactggggaggtggtcactatggggatggggccacactctgagccaacagatgcacaactctgtggcaaggtcacctgatgacacagcagcctttatactatccctaacagaggctgcacagagtgagcttgtggagagggaatctgagagaagattctctttgcaaactgtattctattcataatcacacttaactcagacgcatcctgcaagcccctgagaccagccatctgtttagctgattcgaaggagcaagcagacatgtaaagggcttatgagtgaaccagaaccccagctcaacagttccaagagtctgaccatcttctgggagtcttgggggtgaaaagggcatttctgctgcaccagggtctcatggcacaaggactcaggcccatctggatatttataaaatgtgagacccatgttcctatattaaggcatacaaaaataggcatctgtgggtctcattcttggagcaagccagttccctctttagtgccaacccctcccaagccaggaatcacagaagatggacagctccaccttcataatctccctgtcctgggcagctctgacctcgaggttatggggaaactcttccccagaagccttctttgcatccaaggtgcacaggtgagttagtcaagggagggctgagggaagaccatagcaaagacagacccatggaggtttatatttttccttttatgaaatattacacaagaggcaggagatggcctttgttcttctagttatcttggactaaacaattctgtgatagccactgagagggaatgggtgttggctttcgccttcaataccctgctgcccatttcacagcctgtcccttcttcacagcctcttttttgtaaaagccacaaacattctcttcctagcttaaagagcatctcacctgcttgaggagtttagactcagtgttggcatacagtatggtcgcttttcctttggggcatactctttgttttctcttgatccactcaataccttaggtcaagtttgttttcagggtcactgggtgagacagcacagtgcaccctggggtggcaaatcatgggatcacgtgctcctctttgtaatgcaggggagggaagacctaggagcgtggtcctcataagaatcacctgggctgcttgttcaactcctgtttcctgagcctcatacccagtgattcagatcccataaaagtggggagccccagattctgaattgttaacaaacaccctaggaatttgctacaggtggagatatattgagtttaaaggtatttgtcatgcaaaaataaaatcacaaggatcagtgattaaatatgggacctaccgagcattttggtcttccaggaaaaagtctttctcagtccacactctggagactggcattagggaacctgtaccgtgtgccaggcagtgtagaatgtatgacttggaatgacaggctcttgtggttgaagagacactctccacccatgctcctgcccagtgtgggagcctcatccacagccttacagcgtccctgccaaggggtcttctggcctctgctcgagtgccttcagcatcaaggaactcacctctcagagcagcccacactatgttggattcgccctgtttattagtcctttctcagatggagctaaaatctgccaccaccataatttccacacattggtgccatatacagtaagactacttcttccttctggttataacacctttaaatatttggaaatagtattctcgtctccagactaaacactcatccatttgtgcaacaagtattctttgaacattttctgtgaatcaggattgtcctagatgctggggagatacaagagagacaggcagggtacctgctgggatgtcctaggggggatggctagatcataagcatgtaaatgaacagaaagtggcagatagtagttagaagagaataaaacaggctagcagcatggtaggtattggctggaggtgccacactagataagagatcagataaggcttctctgagaaggtgacactgggactgaggcctgcaggacaacagagagccaccctggagggagtgttccaggcacagaatcatcaaggccctaaagcgggttgagctggatgtgttcagcaggcagaagggaggctgccggttcacgccatgaggcccaacagaggagtgggcagagtctgcagcagatggtgggccttttaggccgggagaaagactttgaattttatattcaaatgaaaggggaggccgctgccctacttgtttatgccacagttcagaagccttttccctgcctggccctcccctggatgtgcgcagtgccagtgccgccctccagctgggtctgatgagcacagagcagttgtcccagctgctgtcctctcaagcacatagagcagctttgcaggagtttatttttcctctttagagatatgattagtttcacaaaatcatatttacacataaacctcagaagatataattagtgccattgagtccaaaaatccagacatattccccactgtcatcaaaaaaatactttcagatctttcttcagggagtaggcactttacacctatcgggtactgatgtccggaagctgcagtggcctggagccctgtgtcatggaatggagagaaaacccaaggctaaagtttcttccctgttcagggaaacagctatgggatcctgaagaccaagaaggcctgtgtctcctttgctttttgggtggaatgtgtgaggactctggggaagtggatggttttgttcttatgagactaaccagaaatacctctgcattcatggctgctaagaaaatgacccattctagctgacggctaaggccagtggccagcttcctgctgccaaagcccagagacaggtgtccagagctgggttctccaagcagagttcttcgccatctcaagccttcctgggggaatgcgctaggatcttcagtgcgaggtcagcagggaccagccagagagcctgaggaggaagggctgggaggcaagccaaggtcccaaagggactaaaaacatgtacgagctgcacccaggggtctcaggagtcatttgtgagggatcctctctggcatgctaggctgatggcccattccccaaactgaagtttgaaatatggaccagtggagagggacagccaccagagaagcactagagtgcctggacagagacccctggggcacacagagccatcaataccaccaccctcccgcaaatacaggctgcatgaaaaacaaaaaatgtgtggcccagctctggtgctggttactcagttacatgttccctccactatctatctggcatgttacatggctcgcaagctgctgagcctggcctggtgcttggcaaagcctagcgagctgggttgggagtggggtggctggtggggtgagccccaggtagtgctggctacagttcccatcttcagtctgcagtcctgggtggcttcagttggccctgagagcacaggaagctttagacatagtctactggtggggcagggctgccagttatggaagcaggttgttctggaggaaagatgaattagaagtgcccatatttcagtcgagggtgattgttcccacatcgacttaatggcagagctccacatgggtccttgcttcctgcatcatgaccactgtctcccagacactgatgggaaccaccaagaggtcaattggtccatcccaggcaactagtgtcaatcgtaaccatgggttgatctcccaggggccccagagagctgagtccaggtctctctgtgaaaccatcaatagccaaagaccctggggggattgcagatgggcaccagggaagtaagacacaggctgagtctttcacagtgagtccagccagaaccagggtgccaggtgctagaatgtgagagtgcatgcctgtctgcatgggcatttatcctgcgtgtgagtgtgcctgtgtgtgtgtgcacctctgagtgagtctgcactcacttcaggttttcctgaagtctggtccaagcaggcctgagctcctagatggtgagtattcccagacctttcaccttgcccatggcctggggaggcctccatgtctctggagtcacccaggcttcacttgtcttcctggggtgcagtgaggagggtaaactatgaacccagtgtgctctaatgcagggctcctttggggtcattcctaaagagggaaagaggaagtggagaagtataatggggatgctattgtgatggacaacccaacaagccccaagaaagccccaggaaccctccaccaccccattttgggcccctatccctgagcacttgaggagccacagccccgcctgaaatcagtgatcactgcctgcctgtgctgcaaagccttttgccctggtccaggggaaacacagcagcgccctccaactgcctcattatccggtgttctcagacaggcggggctcagtctgctcccaggactcacgggaggccagctgaccaggctcacccctgttccccaatctgtgagatgatgttgtcatccctccctctggaaggtatagaaagaccctgttttctcaattctggggcatagaaggtccccaggaaggtgtcactctgggcatgaatgccatgactctgtcctctgggccctccccacccgcaggggcttttgctggcagggtctggaggtctcgcatctcagtctgttaaccaccagccatctctctcccactcaagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgtgagtgcagacctgtccaccttgctgaggtttgggctctgctccagcccagggacccagcagctgcaccaccctgcgccatcagctggtgcctttcctttcattgcacgttctccatttggaaccctgatgggggaaaaacattagagaaaagtttctcaaagcatggtctttgggggttacctgtttgaaatgtagactcttgagcccaatcccagatctcttgtattagaatctccccagagtgtgaaaatccctgtgtaggtcaaaatgagggaaattgtcagaactaaacctggggaggagctgccatggggtagggcagcattagagggacacacttaccttgctttcgtacattgtttattcattcattcatccatcactcaacaaatatttatcaagcagctgctgcaggcaaggcactgttcccaggcacataggtacaacagggaacaaacagatagaaattcttgtccttatggagctgatgatccagatactgtccctccaacagcatcttggagaaacagatcctaagccagttagcaagagccttcgaagactgtcactgggtggagcagagctggagcaagccagaaagggactgagcaaggaaataagttgtttagcaccaccacatgccaggcactgtatatgcatatacatgtatgtgcatgtacttagaaatgtatgtataggggtgactcacgcctgtaatcccagcactttgggaggccgagatggatggatcatttgaggtcaggagttggagaccagcctggctaacatggcgaagccccgcctctactaaaaatacaaaaattagccaggcgtggtggcatgctcctgtaatcccagctattcaggaggctgaggctggagaatcgcttgaacccaggaggcggaggttgcaacgaaccaagatcacgccactgcactccagcctgggcgacatagagagactctgtctcaaaaaaaaaaaaaaaaaaaaaaaaaaagaaaaggaaaggaaaagaaatgtatgtatacctgtgtacagagacagatgtatgtatttgagcaatgatctgtgtcaggcactgtgtttagcacttcccatgcatcctttcattgaattctcataactaggcaaagtaacagtgtttttgcctcattttacagatgaagggactgaggcagggtgattaaatctgaagctcaaggtcacacagctagcaagggttgggctgagacttatacatttgaatctgttggctctggatgcccaccgtgccagccttgggttgagtcatagctgctcttccgtgggagcccctccctgcagctgccctagggtctaaccagcagtactgtctccacaggaaagatgagtccaaggagcccatcgtggaggttcgaacggaggaggagaggaccccaaaccatgatggagggaaacacacagagcccaacgagaccacgccactgacggagcccgagtacgtgggctgggaggggctggcacctgctccgtagagacccccacacccacctccccaccctacccccacctcccgtgcccctacccacagctcccggccaaacagttcaggccaggattccaaacccttggccacaagacctgcttggctaagaaatgcctgacctcaggcatttctggttctatttcggtggctgtgggtacccttagaaggctcctgtataagtagggatccctggatccctagcccctgttctcaagttatacacatattctggaaatggcttaaggtggcaaaatctcactgaaaggcttagcagagtctgcttaggatttcttgaaattctagggttttgtgttttccccctgaaaggataagggaagctggggacctggtaaagttctctgcccctcctctgttcagaaacctcggggacccacggagccccagaccagttgtggttgtaatgcctgcctagctgtcaaggatcttatgggcttaaagggaatggagtttcagggaaccacaaaatctgtgactggaagaacccacagctcctatgagccattctgagtactcgtgatctgccttattcgtgacttttcccatcggtgccctggggagccctgcaggacagctgggcccagttcctctgggacctgggaagcctagagcaggtggatgctgaacagaagcctgcccctccttgaatggagatccagggcagggatcaggaagccctaggcaggtctgcaaggacttcagggaaagggagctctatgcagagagctggagagacatcagcagggaagggctagcaggtcccttttgagaccgccacgttctctgtcgtctcctgtgtcctcttctgcccacctgggcgtgtgcttcctctcagcatccttctctctctgtgggcctgtgtccgtgcctgtgcctaactgcatgcccccacccccatggtccctgtcctgggcttcagccctcctcctcgcttctctgtcacgtctcagcttcattgtctattctcttctacttcctgtcctcccacaggctgcctgccgacactacggccactgtcgaggacatgctgccttctgtcaccaccgtcaccactaactctgacactatcaccgaaacctttgccactgctcagaacagccccaccagtgagaccaccaccctgacctccagtattgccccgccggccacggccacgcctgactcaaactctgtaccggctggccaggccaccccttccaaggggcccagcgcctctgccccctccccggccccagcttcagcccccaaggtcgcccccctcgttgacctgagcgacaccccgacctcaacccctgccgctagcaatttgtcttctagtgtcctggctaaccaaggggctgtcctcagcccaagcgcccctgctggtgtcggggaggcctctaaggctcctccggccagcaagcccacccctgcaccagtccccaccccgactggggcagccagtcctctagcagcagcggctgcccctgccacagaagcccctcaggccaagcaggaggctcccagcaccaaaggcccggacccggagcccacccagcccggagccgcgaagagcccggccgaggcagccacagcccttgctagcccgaagagcgaggctgcctccgtcagcaccacaaacccttcccagggcgaggactttaaaatggacgaagggaacttcaagaccccagatattgaccttgcaaaggatgtttttgcagccctgggctctcctgctcccgccgctggggccagtggacaagcccctgagcttgctccttccactgcagacagctctgtttcgcctgcgccagcaaagaccgagtacggcctctctttgtctgctgtcatcgggttgtgtcctgtggtggtgtgcatttgtgctgtgctgtgtcctccttgttagatgtgtcttcagcctcatccagggcttctctgaggcgaccgtcaaccaaggggctgggataaggcagagagagcaggacaggcagctgggccccaggagcagccgcctgctggctaattaggccatgttaattatgttttatccttatcatcctagcagcggcttctgttttccctgggggagcccttgcagtcaggccactgatgagaatagcttgggaagcaggctaagaaggccaaggtgcccttatcagccaccctggggcccccagtcggtgtgttattcagtgccaggctgagtccctaccagaaaggcactgatgtgcaggaagaaaagaggtaggccccaggcccgtggcaggggagggtgcagttcagaggtcccctcacactgtggctcagatgctcaccctcccctcccaaccccggcccccagcccactcttgcttctcctgctcttagagtggctgggaagactcggggctccccagcatcaaatggctgctgggtctcaaagttcaggagaaagtccttaacctttcaggtttgtaagtgtcttgccaaaattcagtggcaccagctgaggctggggtctgtgcctgtccccatgcatcctcagacccgactccctttcctggaactgatggaggcagagtcagacctagatttttatagaggctcctatggctgctccccagataagctgccatgctgccaccatgggctgcaaggggctctcgccaggagccctgaatctcagcatcgggagggaaaaggactctgatagccctgcccactcagctgccctcaactctcgcatagccaccaggcccactctagtaccccaccaggctgccatgaaaagctgcctccatcagtgttttctcaccctacccaggcaggccctagaggcatcatcctgcaacagcacagggtggggtggggaagggacaggcaagagtgggttgcaaaggggcccctgaaatcagtgctgggagcccagcccagcccagcaggctgcatttacatccagctgagctgttgccactgcagctggtcagggtgaggaggagctgcctctgctgcccccttccaccaccccaggtaaaaacacagcctctggcatcaacttagggctggaagaggaaaggactcgttcttctgactcagtgcttctcaactatggctgcacattagagtcacttgggtgcttttaaaagtcactgtgtccggaccaattaaatcaggatttccgcgaacacagctcgggcttgggtgatttttagtgctcccaggtgatttgacgggcagaggttggagccgggtgctgtcactggagaacccctcctcctccctgctgtccccaaggcctggatgcaggggcgagatgtctgcagaccgtggtctcagtggttctgttttcctgattctctgcaggaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttctttcacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaa

SEQ ID NO: 16419 - DNA, 61461 bp, Human
ttggaatgtagatagtgaacaactggcaagcagctttaagtggcggctcctagattgaaactcaggtctaactgtagttaaaatcattgctttctcaagcatatcctactaatgtgaatcttccccaggtgttccatgattgagtgaaattatagactgagaccacaggtcttttggaatagcacttccctataccctctccagggcaagataagactctaagaattagtggtaggccatgtgcagtggctcacacctgcaatcccagcactctgggaggccgaggtggttggatcacttgaggtcaggagtttgagaccagcctggccaatatagtgaaaccccatctttactaaataaaaatacaaaaattagccaggcgtggtggacatgcctgtagtcccagttacttgggaggctgaggcagaataatctcttgaacctgggaggtagaggctgcaatgagccgagatcacaccactgcactccagcctgggagacagagaaagactccatctcaaaaagaaaaaaaaaaagaattaatggtaaacctaaatgcccattaagagacaaatggataagggaaatgtatagatatacatgcaatgaaatattattcagccttataagagaagggaatcctgtcatttgcagtagaacccagagaacattatgctaagtgaaataagccaggcacaaaagggaaattattgcattatttcacttataggtgggattttgttttaaaaaagacttcaaatgcacagagctagagaatgaaacagtgaataccactagtgggaagcagggaagaggaaaaggggtgatataggtcaaaggatacaaaatagtagacacgtaggatacataaatctacaacagggtccctaaccttttcggcaccagggacaagttttgtggaatacaatttttccatgggcagtgggggtaggtggatggttttggaatgaaactgttccacctcagatcatcaggcattagattctcataaggagtggcgcaacctagatccctcgcatgtgcagttcacaataggaggcggagctcagtctgtaaagcttgctcaccggctgctcacctcctgctgtgcagcttggttcctaacaggccacggaccagtaccagtccatgctggggagtttgggacccctggtctagagagcaaacgtgcaaaatgaggactaaagttaataaaattgtatcatattaggaatttttgttaaataagttgattttagctgttcttgtcatacacacaaaaaagtaattacgggtgagatgatacatatattatattggcctccctactgtaaccatttttctgtgtatatgtatctcataatatcatgttgtaaacctcaaatatacagaatgaataaaacaattagctgtcaatttggccttaatgttccatgttaaagccaaatgtctatgtttgtaatcagctaaattttatattgtgcagaagccctgaatttcacggatgccccatatttcatggatgccccgttcagttcataagctcttgtttacatgatttgtgcatgatccaaatgtggaaagaaaatgagtgggcagcctattctgggtatcaagcaaagagcacaggcacagaccatgtgcaataagcagccttaggcaaaactgaaccaagagtggtttcatacaggtattcctctaagtctttaattttttacttattcctttcccctttttaatgtgatagacacctaatcaccttctgctgccttcccaacctcaactttggtgttctttggcagatagtgacttcggtgttctttggcagatagcctacaaatgaaatttcaaaggctaagcatataatgtttgctcacttgatgtaagcaacagagaactaaatctgaactttggcaaaagtctattaataattgacaaataacagaacagtgaggatgtagaaagcaatacattaaaaaaaaaaaaacaacgaactccatctgggatagcaataacctgtgaaaatgctcccccggctaatttgtatcaatgattatgaacaacatgctaaatcagtacttccaaagtctatatatgactattacaggtctggggcaaatgatgaagaaactttggctgataatattgcagcattttccaggtaagaaaatttattttttaaaatcatgttttaaaattacacaaagaccgtaccaaaataagatctcctagttttacgttggtggtgtgtaattatttgttcagatttgtgcttagtagagagggaaaagttcttggggctgtaagaaatcttgggcctttaaattgttaaaaaatattccaagcctgtgaatcttgaggaactgactgcaaaagccaaacctatgttacttcacttggaaatatgacaacaattaatttaactacatgtaaaaatagcgataaattcggatgacttttctttttcttagtatgacagtaaatgcttatgttcatggtgtaggaaacagcattaaatgccagataaccatcttatccggatgaaccagactggattgttggctcaaatgttttcttcctgctggcttttcgtgttatcattcattttgattactgttgtctaaactttcactttagatttcaatttgtctatgcagcattaatctttcaactttgctgtttcatctctccttcaaagcacttcatctctcttcccaaattagttttcctttgactttcatatttcaaagcacaagatggtgggtgacatggtttatgttttctgtttgtaataaaaacaagaaataaaatcatttcaaagggtttttttttatagcagttacaaaaatggtttatttgctggagcaagagaggagtgccttcactacactacactcagtctcatccatctaacattatggctgttagtaaaggcaatcggtattgtgggtactcattgatggtgataaagacaaaaaggcagaaaatatgcagggggagagaattagccttcctccctgatttcttctttagtctacaacaaaatcactcaaaatcagttttccatatttaaattaggagaaataaaattatcctggccaaggtggtctctggtaggcagcactgattcacccacaaatccatgtagaagactgaaaatggcaatggggtgaaggatacggcctctccccaaccctttcaagccttgactttgtctcaggttttgcctggaacccaaatgagctcaacaaatgccagggaagtcatgggaagggaagttgactgagagtagaggggcttaaaattctgcatcattatttactattttggactcatttaaaagtttctgctcttggaagatgccccttcttgggccgatattaactttgtccaccaaaatttgcctatgagtggtctcttgaaaacactttaacccaaataggttattacaaccaaggaaatttcagacccttgacagatttatagagttagtgtctcagcattgctagacctccaatgctcaagtgattatttatttcatttgtatacagctttccttacttcttaattccctttgtcgcatgctagctaattaactagagctaattaggagtctccatgagctacactgtgtactacatgctgaggacaaagcagtgagccagacaaagttcctgtccctaggaacttacattcccctggatgcatatcagcctccataatgctgttgggttgaattgatgcaaaatgggcccaaaatagttggccaagtggaggtctcagagaggatgcaaaggggcgccccaaagcagatggatcacctatgcaaccctttaaaatgtagaaactttgggagacatagaaggcttggtgacttctaagttatgaactggaaaagtgcctcatgccttatgtgaattacatggtattcaagtgagtattcccatcctatgtgtgtaccgagtaacttagggataggacacagataatgaaaatgaatttgcagtgtcaccttttccatgaaccttgatcattctcttttgttcagctttaaattaaaaaaaaaaatcaatcaactttctttggaggacagctgatgctattttattatcaactagttgagtttttattgcaatacattttgcaatgtgtcctcttttgctgtatgactcgctaggtgaaccttgattcctcacactgcatcatgtagctggtcacgtgaaactaagaatagaaattctgccagggttgtggagactttgggttgatggcatgaaggaaatcaacctgaaatttcacattctgattctaatgaaaagtgcaaaacaatcaaacctcagataacccattgtgatacaaagccagagtatttcaaacacatttatgaaatttatacacctccccatctcgcaagtacaacaaaaggtcattcaccgtgacagcttttatttctctgtactcagctctgataatcacattttggagttctggggacatggaccactcatgtgacccagcagttgcttggagatatttttgggtaagacttcagactaatattactgtggcagtagaaaaaaatgtttaaaaggacaagtaaatggaaccacccagaacaaaatttcttacggtggttataacaaaacagggtaaatgtcaacttgctacattttgcatggctggaattgattgggattaattcaacgaagaacagtaatttgtttctcttacacatttattcaaagtagccttctcaactatggtcttcacgttgttgtagcttttttttctgaaattatcaatgatggaagatgattaaacaatttcgacacttagaagccctcatgatttcagaaaaggaaactcttttctgctgcgttacctattgagactgaagatggcatcattttcttttaaataacagatgggtaaaagtgatgtcattctttcactttaatatttgagaagtgatatgaagttaccagtgacattgtgttctcataggcataaatgtcacaaaataatttatctagtatccacaataggtgaataaggtgtttttgctttatatattttaactgtttagagtaaaaaattaatgtggagaaaattggaatgcagtattataggattacacaacttacaaaacatgaatccactatgtccagttagtgtgattcagaaacagcatgcagttataaagctgggtgaggcatgggtgtcttccttcaacagggcagctactttgtgaggagtgtatatatcatttgatttttttataagttaaatttgaggcccttgttagatgtgagggtgggccaaaattcctgtgaacagattctccccgttaccccgcttcctttactctggcatctcattttctatcctttgaaaacggtttattattcaattggttcaactgtttgccagttgaaccaattctttttccaaagtggaggcccaggaaagcacagtccgagaatatagtgaggtgctattttatgtatgattgtgggaaatttacttaaatttggagtggggttgggcaaggcttggaaagctagtgagctatctgacatagttgttactactatttgaaaaatatcaaaacatggaggactctttagataacatgcctgttcccattccattgattttatctaattttacgtagcaattacgttttgtgcattggttgacaagcctctgtattatcctcagaacagaaaatactgtttaagggaaattaagagcccgcagttactaaagtgactgcgccaccaagtggacaagtgtaaagccactgtctggagatggaaggattcagctttgctttataaatgggaatttgacctttaaaaatgtcccttttggcacgcacgcgcgcgcgcgcgcgcgaacacacacacacacacacacacacacacacacacacacacacacggctgctgccctgcagatttgcttgttcttgtcataaagctttcattgtttctctagctctaagtaaatattaatgccttccaaggctggcatgccaatggctgctattaagatcgttttctctcattctaataacacacttagagatgattggtaataaaaactctcttcaaggcttctgcttctcccccttcaaaatggagatcaaagaatcatgctgtgagggtccgtcaagaagaaaagactttcagcaacagagcatgtggtgtggcataaaataatgacaattataatgttcaaaggaatagcatagaaatcacacagtaaaacttctttattatgcttttcagggactggatgtttttactttattatgtgaggaagggttagattacagacccttagctattccacaaagcaatagaaggcagaatttcttcttccgctacaggaagcacgcttcgattaagggctttttctttttcttctttttttttctttaagttactgcattactatatcatacttcactatatttactaaaaagtcatgctgtttctggaagtagagttacatctaggaaatactaggtgaatgctggttagatatgcatgtgtgcctaaacaacacgtttattatactcatgcatactagaaatagggctgtattttcttcaattttaatcagtactaatgagaataataaatcaaaacaaataggagagatatattttgccaggaggaaagagaactagttcttctgtaaattttactggtgaatttttggttgctggtttattggtaattttcattccaacacagaagaatcacagaaacattcatttaaaataattttccggagtcaaaaactttttaacacccaaatttcagtttttgtcaaataacatttttgagaaaagtgttaaattaaactaataaaaaaccttccctcatcattagactttaatgaatatggcatataactaaataattttgaagaaaccaaattataattttaaaagtaattgcctgaagctgctgtttatcacataaaaagaagacaaactagacatagcatatcttcttaaactctaatctaaactctatgcatttgtataccatcttgattttcaagattggggaagtgaaacgaaaactatgttcacacaagaacctgtacgtgaatgtttgtagtggctttatttagaatttccccccaaactgtaagtattcaaaatgtcttttagcttgggaatgactggacaaatgatagtacccctgtatgatggaatattattcatcaaccaaaaggaacaaactattgacacgtacaacaacatgagaaaatctctaatgcgttatgttaagtgaaagaagccaaactcaaaaggctacatactgaatgattttgtttacatgatattcttgcaaagcaaaattatcaggacaaagaaaaaatgcatcagtggttgtcaggggattgaactggggagagtttctctgcaaaagaaaatggggacttttttgggaatgattgaactttttctagatcttgattgtcatggcagttacaccactgtatgcatttgtcaaaattcacaaaactgcagactaaaatgagtgaatactattatgtattagttatactttaataaataattgcttgggaaattcattatcctctaattgttaactttctaaccaaacaaacagtaaaattgcctcttttccattagctttatgaagtcatttgcttgtttggaaaaaatccaattatattttttcttttaactaaaatgtaatgtcaaagttttggttatgattctgaaactctaaagccttttattttattttattttttaattctagatggaagctgtatccaaggatgctccggaatgttgctgaaacagatctgtcgacttctgttttaggacagagggtcagcatgccaatatgtgtgggggctacggccatgcagcgcatggctcatgtggacggcgagcttgccactgtgagaggtaggaggaagattgtcaccacagggacagaaggaggctaacgtttatcgacctccttctctgaatgcaccaagcaaatatgttccttgatgtttttacactcagaaacattaagctcatggactctatcatcaaaatacttgttcttgcatgtcctgctcctcttctttccagctgtgtgactgggcaagatatcctctctctgcattggtttccttggctgtaaaatagggacaaaaattgtacctgcctcattgggttatggtgagaattgaatgagttcaggtatacaaagttcatggcagagagtaggggctcagtaactgttggttatattatgggtattaatagtactgtctcaggaaatggatctctgacaggtagacttgcccaaagtcacagctaggtagttacagaattggaattcagccctgtggctaccttatctcaaaaccctcctgcttcccccaaaccaaagtggttctcacagccaaattgcaaatggagcaacgtggttggttgtgttttcttccgtggttttgggtcatgattcttttttatggatgagttatattcccaatagagcagttccagctgtcttaggagggagtgatgagaaaatcaaatatgatgtaaagaaatctcttattagggctaatttattaactttccagttctctagcaactgtgaacatttgaaaggctgtgcagagtaaaaaatctccccaaattgtgctccagaaactaatataaaagttggaaatgaattattttgatgctaagcagagcagaaaaagaacacgactatataatattttaaaacattttagttttaagaattaaggatcttgtgaattcacttcccttcttgaaatgtctgacataaaattctgtcagggatatcagaatggcacaatgaggttttgctggacagacttagcagcttccttaattctaggaccacatacaaataagtggctttggggcctcagccttttgtctatggtaatcctgaaacataagtagagagaagaaaaaaaaagggaaatactaaatgggtaaatatctatacaaaatcaagataataaaggccctttcaggcttgaaactataggcaacaaccttagaacaaaagaaaacaaatgaacatcaaaaaactaaaactttagtgctcttaaatctcaatgaaaataaaaagtaaatggtaaactgaaagaaatggaaaaaaaatatgagactgtgaagggttaatgtcctttccacgtaaaaagcccttatatttgaagaagaaaataatatattgctcaaagggaaaaagagaaataagtgaacaaaagatataaataggaaatttacaaatggagacataaaagtgaccaataaacatatgaaaaatattcaatttcattaataagcaaagacatggaaattatgaccatctattttattttccgtatatcgaatttttattttaagatcaggcagtatgattaggttagggagaaaatgtgcatttcaaacagtgttgagaaaagtataaagtggaataatcttcctagaaaataatctggcactgtatatcaaagctctaaaaatgtaaattccatgtgatgttaaaaattctcttctaggaattccaaggaaataattatgatttttgaggaaaaaaatcatttctgcaaggattttcatgcttcttatttttagcaggaaaataatttgaaaaaaatacccaaacatcttataattggagatagtttgcaaaaaatatgatgcataaaaatgacatcaaatttaaaaattatactataggaagagtgcaataatgtagaatgatattttaatttaaaattgtgagaaatcagttgcaaacaatagtcaggtcctaaaatacatttagtttcaaagatcacaatttacaaatgtttatttataagtgatgagattactcctgactttatactcttctgatttttggctcaaccttataaactcttctttgaattattttgtaaggaggaaatgataacaattagatttaaaagagtagagataaagggacaagggaccatgaagagaatggaaataaagaaaggaagcagagaaagcaaaaagcagagctcacttggtaaggcaccctggagccagcaaattatttttaccacatgtattagttccttctcacactgatttaaagatactcttcgagactgggtaatttactaaggaaagaggtttaactgactcacagttctacatggctggggaggcctcaggaaacttacaatcatggtggaaggcaaaggggaaggaacgaccttcttcccatggtggcaggagagagaagtgcaagcagggaaatgccagatacttataaaaccatctgatctcatgagaactcacccactatcatgagaacagcatgggggaaaccacccccatgatccaatcacctcccactaggtctttccctcaacacctgggattataattcaagatgagatttggatggagaaacaaagcctaaccataccaacacatattgctttatttgatatttgacaggtgtttctgtccctgttttgtgggcaagtagctaaagttccagagaaaacagtttttcatagctcgtcaatgacagacttattctccaagtcacatttgatggttccaagaccagtctttattcttggtggagttgggctgagaagaaagaggagaagaaagaagaaaagaaagcttccttagaaactatgatttgacagtgtaagtaggactatttcctccagaagtaaccataagaagatattaaatgcctattacagtcttatccccttagatttatttaacacttataaagcaattatcatgttccagacactattttaagtatattacgagtattatagcattgaaggctcagagcggcccaaataaatcgatcatattattaaacctattttacacaggagaaactgaggtacacgccaggtgaataaccttgcctagggatgcacaattcataagtgatagagatgggattcagacagaggtattctgtctccagaatctgggctcctcaccactttgcaagagctttaatttcagaaactcctatgaagtgtcatgaggagaagcccattatgatcccctagaagtaattatagttttaggagcatgcaaagcagacccctcaggaagataagttacacaatagacatttggataaggtggatccagcagaacaaagagagggtggtgacatcgagattgcagaggaattggagaaggcaatggaagtgtacacatgttgccctcaaaaacatagggtcctccattgggttcctatcagggcagcaacatcagagtttctattctgtatttatactagaaacctctctccagggtttctaagttttcacctatgttttaaagactatctataggttattagtctatttaatatttaggtgtatccagaaagctgatggtcatcagctcatagcaggtgttctttggctggtgtgtttatgttgtgggacagtgggttacttgcaaggaaaggatgaatggctggagtagatggtgcttgtgctctgcatgtattcccttcttacttcccatttccatcagacctaccactttttgcctgacattatctgttgcaacatgagcccatggataggtgtgtttgaagtaggggaatgggagagagggttccctagctaatgatgtacagcagtaggtggataaatacctcagctctctttgctcaggtaactgaagcattttctaatatggtcacccagtgttccttggaaggattgagtcccagttgccccctgaggttgcctgcccatgaacacaccctcttttattggcttccttcccattcttttctcacttccccattccttcaattcattgagattgtttccaaataagatgacttgctctcacatctctgtgtcatttttggcttcttgaagtatgcaaaccaggataatagctaactgaaggctatagatagccacaggcaaatttaagtaacagtgtaagaatattcatacttggcagagatttatttataaaaactcagaaaattcacatggaattatgaagttattattgtatttattccatcattcccagaaagaatatggaaatcctctcaagcaagccagtccttgggaatattgggaaatctatgcaatttgttgtggagtatttttttttttgttaccctcctaaatatctggccgctaagcattcctgtctccagggacttagaccctagcaaggaagagaagttggggccaggttcagaaaacgggttagttatcaatctccctggagaagtgtccccctcagcagggtcagtgagagtaagtgaaacccattggtgcccacaggcaatggtctggcctgagtaattagaatgggcctccagaaagttctgggaattgctatggtgccatagtctcattttccccgttgactctccagatttattcagagtccaacttcaagggcctttctgcccttcctctcacaactgtggaataataataatccaccttattaactgggaccgagaactgagctcgactcttatttttttgagacagagtcttgctctgtcaccagactggagtgcagtggcactatctcagctcactgcaacctctgcctcccaggttcaagcgattcccctgcctcagcctcctgggtagctaggactataggcacgcaccgcgacggctggctaattttttgtattttagtatagacagggtttcaccatgttggccaggatggtcttgatctcctgacctcatgatctgcctgccttggcctcccaaagtgctgggattacatgcgtgagccaccgcgccctgtctgaactctacttttttacactgctgcatgtttgtagagtgaccaatgaagctatacttttttcattttcaaaatgatgatgaatacaaggttatcaaataaaacacagagggcccattatgtttgaatttcagataaacaacaaatcataggtgtcctgtatgtttgctcaatctggcaaccctggatgaataagagctctcacctgaggatttcttgtgaggattcatgaaataaatgctagaaatgcttacacactatctttatttgcccctcagagcccaaagtctccgaaatctttatctttcacacacaaaaactcactttcagaaaagtatattccatttacatctagtggaaataaaaattgttctttttctttgtgaaaaatatttttattttaagctttatgcagaaacctcagggaaaaaaaggtacttttaggagccaggcttgtaatgtaaatgtccaaaaaagatgaaattgaaacaaacaaacaaacaaacaaacaaacaaacaaacaaaaaacagtgcaagctcctgtgtggagactgcagtgagtctgagattgcatgttccatcagaagggggcagccacatcttagctcttgatgacccaagggagcagggatgtggggttgccaaatcttccaaaattttaagaagccagaaatcttgatttctatgtacaatctcctggtttttaaatgtgggcaaataaatcaaaattccctaaaacactgtttggggcaacaatgtgtgggccaaagtaaatacttttgtgggctacaagtgtcccctaggctgtacatctgggacatctgatttatgtggaaatttaccgagaactagttttatttctgtggcaggtcattttcactttctaggattatgtttcttcattgataaagtgagctacttgagcaagaccagtggattgaatgccacgtcccaaggaggctggggttgtttccagggatcttacagaacttaggtgtgatactgagcatgagctacttgtgttgcattttggtgttcaaaagaaaagttctttaaatagttctgctggaaagacaaaaaaaaaaaaagaaaaaactttcacaacaaaaatctccaaaaacaaaaacccagaaaactggcatagaagtggatgatctttgcaatttttttcagtatataaataaatgattttgatcccatttaaaattttatcaaatgcaaaaagaaacaattcaaagtatagagctaccttttcttactctactgaaatctacactttatgtcagccctggagggtttagacgcactttatgtcagcccacttctttccactgcactatgtcagccttggagggtttagatgaggcagtgagcatttgaatgcttttaatttccatttttcaaagtacattcttggtctataggagaggaacaagatatgtaactatctctgactattgctaaaaacacaaacgtctttaataaatgttgcataaactcagaaagtgatacttcaaagtcttgtgaaaaatgatgatcaccagcatttatagagcaattagtatgtgccacgcaatttgactttattatttattcatctatctttaccaccatcttaaaatatgtgagtgcaaaaccctgagaaactttctccaactcctgtgggtgtggaaatcgaggcttagagaggttaatgctttgctcagattattaatcacttaggcagtgctacctataatatcctgctctgttactggtatttccaaacgtcattaactgtagcaagaatcctaaggcaagcactatgctatcatcttaaaatatttattgcaaacatcctatgttttattgttttatctttttaactttgagaagataaaataagccacagaagtgaaattaattgggaaatcattcgctttttgcaaaatttgggagcataaacaatgggtcatgaattacaatcaaacaaaagataaaattctaagaagtcttttaaagtggaaaaaaataactgaaaaatactgaatggagggcagtttttcatgcactgtgttacgaataaaaaatttgattcaatggattacttaatcaacattttaatagttgtaaatcttataatatttaagctgttttataagtgcctctacttataatggcacatccgtttgaaactctagcagatcatttttatttatttttttgaatttttttctttatattctttaaagaaggatacaaaattatttctatgaatatttaacatatggaaggaaatagcaataataaacataaatgctaacacatataaaataggtggtatcattaggctaaattttagtcttccaggataagtagaacatctctgacttctcaaatatccaattaataaaatgcttactataccatttggtgctttaagaacattgccatggaaacctctcaggttttatgcacagtagctataataaaattttccttcatctttcatggagctacttgagattttttttctccctttaaacatgagaaatcaaaaagaaagagaaaagaaggattaaatattcatttatccttttgcttctgacttgttatgtgggcaagtgccacatgagggagtgctgggacctcatatcaagaaaaattaaaacctacctaatgcgttccaggaatgttcagcatattagcaaattcttattaaactgtcaaaaaaaaaaaaagttttaaaagaaattccagcccctggatgcaattagaggctaccacactggatttgatgggccataaaaccattaaatctaaacactttctttttgagcctaaaaggccagaacattccaaagtgaagttttgggactcagctatgacttgaccacctattaagatgcaggtggaacagattgcagagtaacacaaagagccacacagaccccagatgactgcattagggtgtaggtgagagttttagctgttgaattttctggattttccaagattaagtgatcaaccttaacaatgagtgaaagaccattcaacaggaagaattgtcatttcctttgctctaaacccaaacgatgtattttttgaaagctttattgatttatatatttatgtgttgtgctaggcgaccgactagatatatgtttcagcatacctactaggaaaatatccccattattctcaattttacctaatccaggcaaagcactggacttgctttaaggaacatttttactctttctgaagtggagtgcctgtcatgtatcaggtgcaatgcttggactttatgttcttgtgattaatccttacaataggcctgtgaagtaattctcattctgtttgacagtagagaagaaggaagcccttgaccaaggtctagtgccagtaatggtggtgatggggtttgaacctaagtctgtttcactctaaagtgtaaccaaattttatgttttagacttgcttttctaacaataaaaagtcagtgacatgctctttctgtgtgtaagcactcacacacacacacacaaacacacatccgtattacatatgcttatatatgtattaaaagattatggacatttgatatatatacatatactaaaatgtataattcattgctaaagtattttcatataaatagtggcttcagtgttaaaatcactttgcaatgaaacaagattgttgattaaaacacctattaaaaaattagaatctagccatattaaagacagtcatcgaatggagtgatttctacgattttgcaccaaaatttaagctattgggtggctttcttgagagcatgagattgcttcttctcagaattattaatgtgcctgatgacattaaaatgtgacagtgaaaaaagtcagaggctcacatgtgtatcccaacactgaagttgttaaacactgggaggttggttgaagttgttgtgtgcaaactcaatactccttaaaaccattatttaaaggcctatcactgtgttatggtctccatatgatctgccatttatgccaggacttgacaattcagtaaaatgacagaataataacacaggaatcactgcagtagagctaatgttttagtctgttgcagagttctgccctagaaatacagtgaaaacaaggaagggagagctaagatgtccctgagactaattgttccttgaaaatattttcataagtaaaaaagaggtctagaggtgtagtggcagtgtgatcactcaagattatatagctccggattcgttcaatgggccatgatgaaagcacggcaacgattaagtctggtttcttggtctttcttggcagtgtttaaattggttcagttccataaattgtaaattaagatctgtttgacaacttttaagtatttcaagcataattgtagttgaaggtttgttcttttagatcactgacttcagaactttatttttctggttaatctcaattgtaattttagacattcataaaacaatgttgactgcgtctatgtgatggtagatcctctgtgaagacctttatgatggtagttcccctgtgaagataggatgacacactcaatggacattatggtgcacagttatacaaacacttcactatgacaggccctgagtttagaaccacacaactgcttggtacttggtcatcgcatattttccccattacgtaatgacttcctgtgcagatgacaaaatgcgttttctcaacaaaattattttcagtgcagctgttttgatgactaagttttgtaggagctttttaatcaaatgcacctaagaaaaccccaacactttaggccctttgaacatattacacttttttgcttcctctttcctctttttccttaaaaccataatttggaaatttgattctgccttcccataaaagagaattattttcaaagaaattatttgggtctaaattaacatgttacttaattgttctgcttgaatctaggtatatgattagtcccatatgaattgatgttccaaataatttactctcattgataactaatattttctatttccctctattgttttgtggtggtggtggtggctgtggatgaacatcattctcaaatatattataattcccttcctcatcaagcccagcatgataaacttcagttttgcctgatggttcatcatcttatttctgtgtgtaagattgttggatttgacattaaacatttggaaactattttataattgataacttgtgctttctcagctttgagtaagcgctctcttcttcatcttataccattttatttttatttattattcacttctgcttctgatctgagatctaggaagctggacaaatcccagataagcaagctaaacaaacaaacaacaacaacaacaacaacaacaacaacaacacaacccaaactaaaccaaaccaaaatcatgggataatggttaagtgtactgaggggccattatgcgaacacagtttaattccttggctttaaaactaataagagaagaatacataaacaaatgtggcaaatgtacctgtgaccctctccagagggtgccaggctagaagaaaggcagatttatcagcaaggcatggcgggccattggcaaaccatgggacaaccactaccaacttcactgccattgctccatatttccctcccgttttcaatgagccccaactttgctcaggacatcacacatattctactaatttggatgagtccttttgaaagaaaatatctacctcatggttctcaaagtatggtccttggaacatcagcgtcagcaggactctggagcttgttagaaatgcagatcttaggtcccactacagacctactgagtcagaatctgaattttgttaacatacccatgtgattcctcaaagattgagaagccctgatcagagcctgggatgaaagttcctgttggttccaagccaaaggcatagttcaggtcttcacacatgacactattagatgtagatggatattgttcccttctgaagaccctcaaggtcttctgagagcctattaagttcagaatgactgcctgaaatgagtgagaagtcacaaggagactctagataattaagagatgtgttcacagtagtctttgataaaaacctgggacaggcaggcttagtatgcaggcccctaaaatttatgtacacaatggatttcctatttttgcttcttcacatccagattacctggatcagaaataaatgttttcattaagacttgatgtgacaaacaaacaaaacaaaactctgccaagctctagaagaacaattgcatttcccagccagagggagaacactgccagtttttgctgttttccaaagctgtttacctgtcctagctcatttaaatcactgtactttggagttcaggattagcatccccagaggtagctgcattcatacttgatgagttcttttaaatctcagccattgattgtaggttccatagtataggaaatttagccaaccctctattgaatggcagtttagaaaggtcgagctacacttaccttatgtcaggttattgcagacccttgtggcatttttccaccctaggacatgtgatttaactctaatagaaatctttattatgggtgggtctgagattaacttttattctataaaacagaaatcatgccactggccgtagcccattttttgagatggagtggggggaatggatgatagtaaacaaggatattaatctcatttatttttatatcattatatttatagttacattgcaaatggaagagtagagaaaccaaaaacttacactgggaactttacaatttttcttccaagtattactgattgatgtttggactatgcaagtgctgccagccccttagactcactctgcagctccccccatggaaatttgtgaacaggttagggtggggatagggaaaagcatgttcttgtttcacttcttggattatttgttccaggctctccaaagtaatgtgtaccttgggaatgcagaaattatctccttagatattctctccctatatatgtcctcacagggagttcttggaattggagaagattccactctcctttaggagctttctccataaaggtattgagcattggacactatatttgcaagggaaaagaggaatgggtctcttgagcatcaaaatcattgtagaagaatctccaaactgtttttcaaaatgtctgtactaacttacattcctgacatcaatgggttcccttttctccacaagggttcccttttctttgcatcttcaccaacacttgttatcattggtgtttttgataataaccattctaacagttggaggtgatacttcattatgattttaatttaaatttccctgataattagtgatactgagcttctttcatatatctattggccatttatatctcttcttttgagaaatgtctgttcagatcctttgccaattttttttcttttttcaacttttattttagaatcagggagccatgtgcaggtttgttacaaaggtatattgcatgatgctgaggtttggagtgcaaatgaatccatcacctaggtagtgaccacaattccaaacaggtagtttttttcagcccttttccccctcccaaccccactgttgtattccccagcatctattgttaccatttttttgaccatgtgtatccaatattcagcttccatttataagtgacaacatgtggtatttggtttttggttactacattaattcacttaggttattgatttccagctgcatccatgttggtgcaaaggacattattttgttattttttatggctacatagtattccatggtggatatgtaccacattttaaaaattcaatccaccattggtgggcacctggattgattccatgtctttgctattgtgaatagtgctgtgatgaacatgcaggtgcacgtgtctctttggtagaatgacttattgtcctttgggaatatacccagttagtgggattgctggatcgaatggtagaaaaactctcaggtctttgagaaatctccaaactgctctctatagtggcttatttaatttacattccctacagcagtgtatcagccttctcttttctccacagactcaccaacatagtattttttgactttttaacaaaagtaattctgactggtatgagatggtatatcattgtggttttgatttgcatttctttgatgattagagatgatgagcatcattttcatatatttatcagcctcttttatgcctttgtttgagaagtatctgcaaatgtcctttgcccactttttaatggggttatctgttttgtcatgttgatttgtttaagtttcttaaagattctggatattagacctttgttggatgcatagtatgcaaatattttctccaattttgtaggttgcctgtttactcctttgattgtttctcttgctgtcctttgcctattttttaattgggttatttgttttctggctattgagttgtttgagttccttattttttttttttggatattagcactcattagatatacactttacaaatattttctcccaatacctgtgttgtctcttgattctgttaattgttttctttgctgtgcagaaacattttagtttcatacaattccttaaaaaactaaaaatagaattgccatatgatccagaaattctacttctggatattaattgagaggaattgaaatcagcatgttgaagagatatctgcacttctatgttcgttatagcattattcataatagtcatgatatgccatcaacctaagtatccattgacagatgaatggataaagaatgaggtgtatgtacacaaaggaatactattcagcctttaaaaagtgggaaattctgtaacaacatggatagacagatactatatgatcttacttatatgtggaatctaaaaaggtaggtctcacagaaacagatcataaaaaggtggctaccagaggctgggagaggaaggaaaagaatgaggaaagtgacatattgatcaaagttgtacaaagtttcagtgcgactggagtaataggttttagtgatctattgtactgcatggtgtccacagttaatagtaatgtattgtatatcttaaaattactaaacgattaggtatttaatgttctccctacaaaaaaatggtaagttggtgtattagtccactttcacactgctataaggaactgcccgagactaagtaatttataaagaaaagaggtttactggctcacagttctgtatggctggggaggcctcaggaagcttacaatcatggtgaaagggaaagcaggtatgtcttacatggtggcaggtaagagatcctgtgtgtgaagtgaagggggaagagtcccttataaaaccatcagatctcgtgtgagctcactcactagcatgaaaacagcatggaggaaatcacccctatgatccaatcacctctttccctcaacacatggggattacagttccctgccttgatgcgtgggattaaaatttgagataagatttgggtggggacacaaagccaaaccttatcagttggtgaggtgatgaatatggtcattagcttgtctaaatttgtctgcaatgtatacatagatcaaaacatcactttgtaccccataaacatgtgcaattactattttccaattaaaaataaatataaataaattaaaaataattgcaaaggaaagctggctgtggagaagattaacaaataatgacattaagaaattcaggtccttggcaaaattagaaatacatacaaagctatccagaacttatttttccaaatgcattaggcatcctctcaccttaccctttacaattgcatggcttcagagattacacagaaaacgttcagaaacattgccccagtagatgatcttgcaatgctatgaagtaggcagaacagctgtggctatagcaattgtgcagatagaacgtacttcatggatggcaagactgggactctaggacaggctttcaatccattctaccctgttgttgttctgaaatgaaagttttatctcccagtttatataggtagccttatctttgatgcttcaatacctgagacctggccagtgtcccttttagtgattgtatgtgtgtgtgtgtgtcatatgcaatttccttatagcaatggcacagtgtatcactgtttaattaaagaagagaaagaaatgccaaacatacgaataaagtctgaatatatctgtaacattaaaagtgtaggtgtctatctttgaagatatgtcttaaggacaatgaaagagtcagtgagtaagagaagagagtcctgggatttcatacaagatcagtgttacttgatggtgtaggctcctaggtatttcatctttaggatataccgtctattacaaaagccaagatttttagatttggatcaacattagggaacttcattctaggcaagagccaggttttgcctttatgttaatatgacctcagctgtgagctccattttgccaggcatcttaaaactgcaacacatatcattggaatcttccgttacagtctaatacatagccacacattgggagcaagaatgaaatccaacccctgtcctttgcaaaatgcaatgagtcagtgtctgctttgggagcagggagtcagaatttcattgtggacaatggataaggtgagtaaaagggcttaaaacatttgtgctttcaagccataggctaggataacgatagtcagaactttttgatgaagtctgaccatgctacgccatttataaaattttgaagcttgtaagtattaccccaaaatgagcagtgtgaactcaaagggtttatcattgtctctcaggcaaaggtaatatttgaattatttagcaaaggactttgagcaattggaagagatactcagctgctggtctctagcgctctaacagggtggatgccccccgctctgccggcactgatgtttaagttgctggattatgaggaagtctggggattccttggggagaaaaggaagtgatgacatattgaagcacaacgacatattgaagagactcgggggctggggtgataaacttcagagccgtggctatttaccaattggagtgtaagtattttaatattttaacaaacataattgccattctggtatgtaccaacttcatctcagatctgtccttaagaaataggcaaattctttattgcctctctgaatggttcatataaattcccaggctcccttagctcattctaacataaaactgtattaaaaataatgaatgtaattcatcaataattttcctttgtcatagcaaatagtcacaagtggattgagatcagagtgatcactcatatttgttctggggagaagggagcctgctgttttgctcctgttttctcctaggactagtattttagcttcaaatgataataccttagcacagactctgatattcctcctacatgcaggagcattctcttggaataattttggggatgccaattcaaaatttcagccatgtatgatttacttattggaaaataatcactgagcagcaataactccagcagttacttgtatcaaggtagaatcaagaaatagatggtatggaccaaacttgcttctctctaaatatgcatacccaagtgatttgggtaaaatgtttgtgaagggcttacatttcctgcaagtcagatggtttaagagaagtagaaattatgtgtgttttgcagcattttggtaatctgtgtggagtgtctgtagatatttctcatgagttcaagggaatccttttgtggattttgatgttcctattggcagagctgctgcttgactacatgatgtctttgtattaactacaaaaacatgccctatcatctgagtgattttctctgccagacccctttgtgcatccacactctgcacctccagtgtacggaggaccttcccactggattctaagattccatgccttcccaatgcatggcagtgtctctcatgcacatggcaaacctactctcttggatgtcactgccctgaaatattgagggagtacatttatctaggcatggtaccagggagtcatttagacatgtagggagtctagaaagatcattgccctgggagagtgctcagccatgctgagttctcctactttgttgctcatttctgtgtgaccttaggtaacatcctcttcaggactttttttttttttttttttttgacagggagtctcattctgtcatccaggctggagtacagtggtgtgatctcagctcactgcaatctccgcctcctgggttcaagcaatcctagtgcttcagtcgcctgagtagctgggattacaggcatgcgccactacgcccagctaatatttgtattttcagtagagatagggttttatcatgttgatcaggctggtcttgaactcctgacctcaagggatctgcctaccttggcctcccaaagtgctgggattacagatgagagccaccaaccctggccaggacataatttatttcaggtgaattgattgttggaggattttgatccaagcaatcaatgtcccttggtgttcctttcaaacagcagtaagtgacctgaatttattttccacatttccaaatcttaatgaaaatcagacaatggtctatatgttcatttgtgttcttacttaataaaatgtgggttttagacaatattttgccagtcatgaattcctatagaaggaactctttgggagaacagactagtgatctatagacatgatgacctccaactcagatcttctgtagctaaccactgaccgggagaacatgtatgaaaaacatcttcaaaggcattgaaaaattaacatttatcaaaaacaaaatacattttattacatttgaacttagacctttactatctaatggctatggtactatttaaatgtcaaagtgtgatctagcatcagcctaatctggttagaaatgcaaactcttgggccacatctcagacttactggaccagaagctctgtgggtgggacccagaaatctgtgtttcattcacatgccctccaggggattgtcctgctaaagtttgagaatcatggaagctttttaacctctcattatagctttataagcagcaactcactggattcctatcaacatcctatgagtgtcatttggacaagtatatttatacccatttgatgcatggtaggcacgcagatgagtcaaatgacttgaaggaatagagttttacataatatacttttatatatttatacttctaatatatttatactttataacagatttgactgttttatatattgcatataaacattatatcagtttctcctccactaaggctgactccaattttactccaattttactaccaatttttggaagaaagcctacctatcactcatgttctctcaagtaccctctaaaactattagttagatgactctatttaattttccatttatttgcccgtttcttgctacctttccccccaaaatgtaactgctaccttgctcaaaaggatgtgtctacttgggatatctagcacacacattttatgagattttaaaagacaacataaatggtaaactatatatttaatacaattttgaaagacaaaattttaaaattaaaaaggaagaaaaaaattaaactaaccccataattctcccacccatcattagcatgtagtttgtttagattcatctaccaataagtagaattgtacaaatttgatatcatgtaatacatgtcattttgtaaacttttttctttccttaatatatctatatatcataaacatttttctatgtctatattattttaaaattgtaatacccagagttctccagagaaacagaattaataggatctcccccttggagatttctcatctttttctctctcgatagatacagatagatacatacataagtctatctctctatctctatctttatctctaaaacacctatccatagatagacatttttaggaattggctcatgtgtttgtggaagcttgcaagttcaaatgtgcagagtaggtgggcaagctaccagggaaatgttgatgttgcagttccagtctgaaggcaggctccttgcagaattcttctttttcttagcagtcttacttccccttcctcttccccttctccttcccctttcccttcttcttctccttccccttcttcttattctccttcacagacttatttttaaggccttgagctgattagataagacccactcacattatgagggataatctgctttacctgtagtctactaattaaaatgttaatctcatctaaaaaacaccttcatagcagcattcagacatgtttcaccaaatatctgggcaccatggtttagcatattgatgcagaaaattgattatcataataatattatttttttttgagatgtagtttcactcttgtcacccaggctagagcgcaatgctgcaatctcagctcacttcaacctcttcctcctaggttcaagcgattctcctgcctcagcctcctgagtagctgggactacaggcgcccatgaccacgcccggttaattttgtgtttttttagtagagatggggtttcaccacgttggtcaggctggtctcgaactcctgacctcaggtgatccacccgcctcagcctcccaaagtgctgggattacaggcgtgagccactgtgcccagcaataatattaattttaatgggtgtgttcatttcattttatatatgacctacaatttaaccaatcccctaaggctggatgttcaggttcttaatattttttgcccgtatttacagacacctttgactattggatttattttgttcttcaggaacaatatacaaagtgtggaaagaaatgtatatttctaatcattggaaaataaacactgagcagaaataactccagtagccatttgtatcagaggaggtagaatcaggaaatagatggtatgggccagactttcttctctctttaagagatttgacttcatattgccaaattgcccttctagatgtctttactcatccaactacaattcaaaggtttgggagggtaagcaatgccaggcccatcttgatcatcccctttctttctcagcctgtcagtccctgggaacgggcatgatgttgagttcctgggccacctcctcaattgaagaagtggcggaagctggtcctgaggcacttcgttggctgcaactgtatatctacaaggaccgagaagtcaccaagaagctagtgcggcaggcagagaagatgggctacaaggccatatttgtgacagtggacacaccttacctgggcaaccgtctggatgatgtgcgtaacagattcaaactgccgccacaactcaggtaaccatgatcatgtgggccccgagctgaggcgaaagggatcttgactgggaatgttagggtctgggttctactgatagcaacgttgctaaacatctagttaatcttcagctaatcacatcccttttgtagacatcactttttttgagatacacaatagaaacagaaatggcctctataaaagtccaataaattttcagaccagagtgcattaagggctttggctttgggaagtatgaattgctatacagatggaagatactgaattttgcccaagcagcagtttattattatcatcctggtgccctatttctttgttaaagtcaaagagccacctttaccttttatttttaatggtacatgggacagctaaggctaagaagattgaagaaagaaaataatgaaggtttaaaaaagccacatctttgatccctcactgtctacttcttctttcagcaatattcctttcactgtggttcatccatgggtcaagattcattgattcattcactcaaatcattcatcttagcaaaaaccatatatcacataatctgatgttgaactataaaggtttcatcaggtcattcattcaccctgtccacaagctgtgaattattatctctttcctggttgtattttgggattacaatcatcttgagtcaaagctggaaactgagtggaagtctctgggaaagactcaaacctccttaagctatacacctcttttccccatcagattttccttcctttagtttccaccaaaatgtgctcttggatttttcatatgaatgtataatgtacctcaggcctataagtattttaaaagggatcaaaatcttagttttaatggaggacatttttatgatggactcctacagaatccatcagaatatgtaagatgatgaggaatgtcttcctgtgttcccagatctcatgccacagaggcccttgcttactctatgtttgaattgtatttggaaaaaaaaaaaaaaacaaaaaactagggctagcaaaattgaaaaaagataaaagacgaaagaagccacatgtaaacatactgtgtttactcttctaaaatattaaaaaatgaaaagatccaaaatcaaattaatattcccctggaatttcatatctatttcagtgactgtggagtgaatctcaccacgaaagctgctgcagtcttgtataagtttcacatagttttactgtgtttgtgcctatgtgagaataaactactgtgcataaaatcttgctgttgagccatgtgtgaattagctgtgtgatgttacctccctgttactaccaggctggtttaggatatcatttctgtatgtggcaccaggattagaccaatgacagaaaaagaaagtgctctccctgccaaactggccaataaaactgttccacatatcccagactcagggttacctaaacaacctgtgtttaaagagaacaaaaacaaaagcctctgacatagtcttactccttgccaaattcgtcagaaagctgatggattcaaattcccccaatatgaatcccgtatttacattatttctctattttgactacttttttttttttttaaagactttctaaatagtttcccactatcgaggcttcttagaggaaacatttctcattatttccccttggctatttgaaaaggaatttgttcttccttttcctccatctcttaacactactactactaacaatagtaacaacaatagtaagtacagtagggttttttgttttgtttttaacttaagacatactttcttgttctggataccaaaatatgtttcacagaggcatctacttagatggggtgcagatgacacagttgttaattctggcaggtacctcttgcttcttcactgctggggctactcagtgagtggcaggaaggttgatttgctttccccccttttcttttgctcctgggctccttcccagatgatgtgacgggccatgaaacaaagactcttttcagctgtcggtgtgcatagaactggctgcggcttcctagcttgtcacatctccggtctgaagatgatcaaataatgagcaacacatccaggttatagggaacacgggaaacaccccgcagctgggtgtaccccagcccctcagagtgcacattggtgttgtttgtcctagtggacttcggagtaggccagtgccttctggtcagttcctcagtggcccacattcagctcttaaaggcagagcatgctaacgggaggtccaggcttccgcctgaggccaaatacaccccaaaagctcatctgttatagcctgatatgaaatcggtttctttctgcaactgacctgactcatagaaagtgaagcctggcttttcataagtgaagtttggcaggcaagggaggcaggaaatccagaggagaatgagcctgtaaagcatggctccttccagcccttgttacttcctctgcccaagtgtgggggagggtcccgtctcttggcatctgggcccagcaagagttcagaggtttggtagtctctgcttggtccatatgcaaaacacatgtatgtgtatacattattaatggcaagggggttcctgaaactgagagggagtaaggagacttctcatctgctcttggaagaagcaaggaatgaagccagttcagtagactgattcctgaggctttggggcaggaactttttctttctccatatccccatggagatggttcatttaccctgaattaagatttggcccttcagtgcagtgccaaggcagtttaaagagaagaaaagtaatttctgatcattgactaagatcaaggtaaatcatgacacttatcctttctatgatttgccagtgacatgttttcttaagcccagaaatgatttattgatcgcagcagccagaatatatcacactaaaacagatcagcctgccactgtcttctcaggtctctcatgattaaagtggcctgctttaaagtagactcaatgtgaataggtctccatgacctctgcctcactgcgtagcactcacatcctcacccactcttgcactctggcttccctgcggttctttcaatatgccaggcatgctggaaccccggagcctttgcactggctgttccctctgtctgtaacagtcattcgcagaatcaacgcatgactaatagcctcacttccattgagtcttgacattaggaatggatatacatgtctatattgggaaaccacaataaaaattgatggtagagatgcaaatatgagcaagataacagggtgggggcaggggagagaggtcagtggaggacttggcacagtagcctcttaaatggcacaatagcctcttaaatttttggttaagaaatcattcacattgataagtatggcaggataaaggtgtccatgagtgaatcccgggaacctgttactttatgtggcaaaagggactttgcagatgtgattaacttaaggggcttgagatgggaagatttttcctgtttttatcagtaggcttgatataattaaaagggtccttataagagggaagcaagagtgtcagagtcagagaaagagatgaaatgacagatgtagaggttggaatgatgtggtcaggaaccagggaaagcagggggtatctagaagctggaaaagacaagggaatagggcttcccctagattctccagaaatacagccctattgatatcttgagtttagtccagtgagacttattttagacttctgacatttggaactgtaatataataccttcatgttatttttattgctgttgtaacaaataaccacaaacacagttctactaatttctttctcaaggtagcttctcaattttgccaacgctggttaccatacatacttaaagtttcattttgagtctctgaaaactcacatctctcttaatctgctctacttttttcttggctttgtatagtgcttatgttctgctacactttgtaatttattgattatgcttaccatgggcagggattcttaactgttttatttatttatatatcttaaacattgaaaacactggcatgtagtagatgcttaataagtaattgttgactcaatcgataaaatatactagaacatacaagattttcccaatgtaacataactagtaagaggctgaaccgggatttgaactcaaaattcattccctgaaccttcttctagcagccacattgaggaagaaattaccagggctgtgttctcaacacaagtgttttccgaaccacagaattaaaggctggtggcccatgtatcagtgtctgtatttatgagcccctctttcaatctctttcttttcatattgtgttgatgctgtagcttctactggtcatgttatttttttgtttcccaagacggaattatgtggctttatctttaatgttgcattatcaatacttataataaataatattatgtattactcaatattcatgattattagtgttactattggttatttaataatgtttaacttacattagcagttgttactatttttatgatgctaaattactaacagctaaaacaacttctatattaaaaagtatatttgagtgtcactcaagagataatgagtaccttacaaagaagaaatcttgtttctcacctttgcgtcattaaacagatcaggatttggagaattaagccctaagtaatagtgttattattttgatctcacccctttttttcttatgaaatggaatactttggttatcagaagccactttaagcatatatatatatatatatatatatacatatatatatatatatatgtcataatccgaataaaaatagcattcatggaggtttcttttggagcctttggtaaaacactccatcgtgggtctctgtcaagatatctgaaaactttttcttggcttctggctttgaacaaagtttcagagtaacaacaaggcttcattgtgcactgaaatttctgtaaggcaacattcattcaagtgttgattcgcatttcaccatccaagaataacaacagttatttatataattttatccacgtttctgttttttcctatccatttcaccctttcaccccacccctgctgaaacactggagcttgtttgggatgggggtggggtgccatgcagactacatacacatacagatgtttttctttttcttttcccggtcttgctatgggatagacagactggactttttcttattaacaatattatttaaaagcttggaatttattatcatttaatcatttgtatgtaatgaaataggtctccatggtaaagatgtgtttattgaccagcggttagctttattcaaattagggtgaccatagaagaccaaggactatgatataatgtacaatcctaagtggtttgatttaaataaaaagaaagaccaggcatttcagctaaaatccccaccaaagcccaatgactagatgggcatccatatgactcaatgaaattttctatgatcttaaatggccatctgagtccgtgaaactataggactaactattcaatccttattgagaaagccttgttaatagcttgaattgagttatatgggataggaatgttcatatctttatgacaatatatgccacctaagctacataaccagctgtgttagctaaaatactctaaagtgtaaaaaatcatagttttctattaaaggaagtcatgattgttaaaaataatttttaaatagtgtgcctagattcttctagtataatatataattttttttttttttttattttgagacagagtcttgctctgtcacccaggctggagtgcagtggctggagttgctcactgcaacctcgcctcccgggttcaagcgattctcgtgcctcagcctcccaagtagctgagattacacgtgcccaccactatgtccggctaatttttttgaatttttagtagagactgggtttcatcatgctggccagactggtcttgaactcctgacctcaggtgatctgcccacctcggcctcccaaagtgctgggattacaggcatgagccattgcgcccagccgatatataaatttttatatggctccatgatcttctctacatttaatgacagaactggtggaggggaagaaagagatgggactaagccagagatcaatatacatacaactatactttgaccaaaaaaagggagattgactggcaggggaattaatagtatgcagaagagcaaggtgagtccagtcactgtcattattcaaaaacagcctttcaggagaagtttgcaactgaatttgggactgtgggcagataagtcacaggaatgattctattgtgtatcctgaagtcatccatccagctaggagtcagaggtgcaggctgaaaagacattgcccctagagtggggaactgccaaaatctagccaggatattaggccaagagaaaagacctcaggcacaggggaagccagcttcagaatcttagaggtgagttagagaaatactgggctaagctgggtcaacaaaaatagtcatacgggaaggaagcaactcagtggtactttgtctcaggttgggttctcctagaagcaggctgtgagcctatgatttcagtgcaagtagttaatagggaaggtgaagggaatactgctagaggagtaggaaagtgaggcaaaggagggaaggcattgaacaaagggcataataccaagacagctacagtcggggcaactgaagcttaaccctgctggaaaattctgggaacttaggcagaatttatctcagagttagtctacctagcggtgagggagctggggtatttacacttcaacatccctaatgcctccagtctgctgtgtgggttgtgactcaggcccaggagcaagaaaaaaccactggcagagaaatgaaggtattgataattgaaaagctcttgtcgttgtcaaacttgtctggaagattagagaagtttgagtcagcagaccgagaagttcagagagaacaactaaaagggggagggaaaggcaagaggtgacaactcatctgctgggaaacagttcccacttctcccatgcccaccaccaccatcactactgcaatagcaggcaagaaggagtctacaggggcaacagacagtcatgttaacacctgttactgcggttccaacctcttctagaattttctacaagggcattggaaggtttcctgaggtcaggtgcaataaccaggaggaaactgagatctgagcaaagagaatagtgttaggaatgaagtcaagggacccagtttggagctcaaatactgctattagctagttctatatttgaggcaattcattttgtacctctgtttttattttctatgggaatcatagagtatcaatgttactttctaagagtcttttaaagaaaaattgtgataattttggcatacaaaaccctttgtaaattataatgcaccataaaaatgctttttaaattgtgattaatttgcattgctggctgaaaatcgtgtcaactctattgtctatatccataaactggcttaaaaatgagatgtttgaatatgaacacatttttttttcttgaaacagatttgtttgtgtaaacacagcctaagatgtaaaataaaatttaggtcactgattaagaccactagagtatcacatttagtctagagtcctacatcaaaatatggaaaatatgtgtgcaattgacttatagataaatgagcagtgaacagccaattgatttgaaaagggtaacatttttcattgaatgaatcattggaaaggtatttctaatttggcaaatttctcattttatgcatttcttattttaggatgaaaaattttgaaaccagtactttatcattttctcctgaggaaaattttggagacgacagtggacttgctgcatatgtggctaaagcaatagacccatctatcagctgggaagatatcaaatggctgagaagactgacatcattgccaattgttgcaaagggcattttgagaggttcgtttatttctctacttgaattcatactgactttgtgatcctttgtggatacgttcataatattcttaaaggaaaataacaaggaaaaattaacatggaaattgagagagacattccaactctcaattctctgttttcatgttagtgagtaaatatttcttcattcttaggtaatattctgaagcagagctaaactctcatgaagcacaaagtgagctttttcaaagaattgggatgctattgccttatttcagagctgttactgaatcatgaagcctggcaagatcttggtagaacgtcatgagttcattgctttacctgaaagctgcaacagttgctctcagaccaaagagaagccccaaggagatattatgacagacagacttgttttaagagcttttactctttttcttgtgctccctccagtacaaatggctaggactagtttttgagtgtggtcaaacccacatcacctctctgaagagaatggctgactagtatggtcaaatgctcaattatcaagccatgggtaataagaaacttaactatttcctccagcatccccatgtattcagatcccacagggagataccaatgactataataattttggagtgtaaatgtgtttacccacaaaggcaagaaaacctttgtagtatataacctttggttatatagataactgccaaaaacttttttttaactgaaatgtttgagtaagtgactttaagatgagagtctgtccattaatgtatgtctattaaatgactttgaatcaaaactttttcatagattttacttgaacatgtctgagtcatgtggtccctatttataaaggtctacctactttgactatttaattttatgtgtgaagaaatgagcttataaaagtaaaagaaattaagcccagtgcagcatttaagtagtggagatatgtttaaatccagatgttcttattctgtgcttaaacaaattaaattagttttttaaatcgatatataatagttgtacatatgcatagagcatatagtgatgtttcaatacctacaatgtgtagtaatcatatgagggtaattagcatatccgtcatctcaaacattattctgtacttctacaaaaattgttcactgtttcctactaatcattgtcctagttcaaaatttttgtggattatacttcaatgaatatgtattggtttggtttacagacacctttaaataatggtttcacttcctttacttgcatccatgttgttatccatgattactagtgctacttactgtggctgcattcaactgtggggactaaataatattaacctgaaggttctgtgccattcatttatttattcattcatccattctcttattcactcactcattcattccataaatatcataactactgtgtgctaaaatatttttatgaaataaaataattttagatccttggataaaatgacagtctattcttgtaggagacagttatataaacaagcattttgggtgcaataaaatgttgcatagaaatctatgggcatggcttaaaaaagaatatgggcaataatgtaagagtgggttagaaaacacttttcagaatgaaagatgatgcttgagttttgccatgatatcaagccaatagactctacttcagactgaagtactggcagaataaagcaattatgcataacaatttataaaacacataagccatttagagaatttagactttaaagtggctgagaaccactgaagtgtcttgatcagagaagcaacctcatcatataagcattttacagaaatcatgctttgcacaacggacctaatggatggaggtggcaaaattgtggtcagggaagacatttaggaaatgttgttgcccagaaaagagataattgtagagatgacctagagtaatggcagggaggggactgagaaggtataattaaattagaaaattaagacagttaatcacagagacggcccaggggatctggctttaaaacactaaggaagaatagaattttagtcttgttccataattgtttcaaataaggaacaaagaaggaggtcattttattttttaaccaccttttcaatctaggatttccagtgtatatcattttctacaactttattccttaagatatgtgcaaatcaattgaattagatttactatcacatgttatgttgaaaaatattttggtttctagatcttcattctgttatcactttagctaggaccactgccaccaccaccaccaccaccaccaccaccaccaccaccaccaccgctaccacaatctccattaccaggacaaccaccagcactgctgccacccaccaccactgctatcaccatcaccactcccatcaccattatcaccactcccattaccaccatgaccaccaccaccaccacaactaccaccatagccacaacctccatcaacaccaccattaccaggaacaaccaccaccactgccaccaccaccactgctatcatcaccaccaccatcaccactcccatcaccactatgaccaccaccaccaccagcgccataaccacaaccaccatcaacaccaccattaccaagacaaccaccaccacctccaccaccaccaccagtatcaccactaccacctccaccactcctatcaccaccatgaccaccatgaccaccactaccaccatcatcaccacctctcttttcttctcatccatatggatttctggtttgtttctaaatatttttgtgacattttacacatagtagatagcccaaatatttatttactgaacttcttgatgaaaactataagtctatctaattagagaaagctcaaaaaaaaaaaaaagataaggagagatgggacatttgacatttaaagggaaataacttatttatacatgtacagtttacatcgtctacttttctgtaactatttggttcttttatttaacaaacaagaatcatctctatgacaacaattgcaccaagtaacacatatgctcaatctggatcggaagggagcagtggcagggccagttctgggaaatccaattttctccatttcacaggtcctcatgcagaaatcacatggattgactgagagtcacccatcctctttcattttcctttttcagaaaagtgcagattatattttcaggaacatgaaatcatgagcaactgtgaagatctagaccaaacatctgactgtctcaccattttaataattgtattttaatgaatgcaaattagaatggaagatgtaatctcttactgtgtgtggttaaactgcccttagagaacttcaacgcaagctcctaacatgtacttaagacagaatttggtctttgtcagaactcacactagcaaacaaatggcttttttcagcaaaggcatggtgccttttagagttcttttctttttcttttaatttatttaaattaggctgtctcacttctactgtggctttgtgtttctgagaaacttttctctagtcagctcttcatatacaggcatacctaagagacattgtggattcagttctggaccaccacaataaagcaagtcacataatttttttgtcttcccagtgcatatgaaagttatgtttttgctatactgtagtctattttgtgcaacagcattatgcctaaaaaacaatgtatataccttaattaaaaaatacgttactcctaaaaaatgctaatgatcacctgagtcttcagcgagttgtagtctttttgctggtggagggtctttcctaggtgttgatggttgctgactgatcagggtagtggttgctgaaggtttaaggtggctgtggtaacttcttaaaataagacaatgaagtttgatgcatcgattaacttttcctttcaggaaagatttctctgtaccatgagaagctatttgatagcattttacccacagtacaactttttcaacattggagtcagtcctctcaaactgccactgctttatctgtgaagtttgtgtaatattctaaatcctttgttgttatttcagcaatgttcacagcatcttcaccaggagttgattccatcccaagaaaccactttctttgctcatcataagaagaaactcttcattcatttaagttttatctcatgattgcagcaatttagtcacagcttcaggctccacatctaattcggttatcttactgtttctgccacagcagcagtgactttctccaccatagtcttgaactcctcaaagtcatccatgagggttggaatcaacatcttccaaattcctgttaatgctgatattttgacctcctcctgtaaatcacaaatgttcttaatggcatctagatggtgaatcctttccagaaagttttcaatttattttgctcttattcatcagagaaatcattaactatagcagctataatgttattaaatatatttcttaactaataagacttgaaagtcaaaattactccttgatccatgggctatggagtggaggttgtgttaacaggcataaaaacattaatctttttgtgttcttccaccagagctcttgagtcactaggtgcactgtcaatgagcagtgatattttgaaagaaatctttttttttctgagcagcaggtctcgacagtgggcttaacatatttagtaaactgtgttgtaaacagatgtgctgccattcggactgttgttttatttatagagcacaggcagagtagatttggtataattcctagggttatatttgcagccatgaatagacttctcctctctagctatgaaagtcctagatggcatcttcttccagtatgaggaaggcttgtttggaagaagatgccatacagcctgtttaatctacattgaaaatatgttgttcagtgtagccacctccatcaattttcttagctagatctcctggataacttgctgcagcttttccatcagccctcagctgcttcatcttgcacttttatgttatagagatggctccttcctttaaacctcaggaatcaacctctgctaacttcaaactttttttctgcagcttcctcacctctctcagcctttatagaattgaagagagttagggtgttgctctagattaggctttggtttaagggagaatggtggctggtttgatcatctatccagaccactcaaactttctccctatcagcaataaggctgctttgctctcttatcatttctgtgttcactagagtagtagctttaatttcctttaagaactttttgtttgcattcacaacttagctgtttggcacaaggagcctagcttttgtcctgtcttggcctttcacatgccttcctcactaagcttaataatttctggtttttaatttaaagtgagaggtatgtgactcttccttgagcgcttagaagccattgtagagttattagttggtctgatttcaatattgttgcttctcagggaatagggaggcctgaggagagggagagagatgggcgaatggccagtgagtggagcagtcagaatacacacacttattaagttcctcattttaaaggcgatggttcatggcaccccaaaacaattacaatagtaacatcaaagatcactaatcacagatcaccgtaacagatgtaacaatgaaaaagtttgaaatagagtgagaatgaccaaactgtgacacagggatacaaattgagcacgtgctgttagaaaaatagtgctgatacacttgcttgatgcggggttgccacaatgccacttgagcattgtacataccttaattaaaaataccttgctgctaaaaaatgctaatgattatctgagtcttcagcgagttgtagtcttcttgctggtggagggtctttcctagatgttgatggctgctaacagatcaaggtggtgatttgcaatttctaaaaaactcagtagctgcaaattgctataaagcaaagtgcaataaaacaaggtatgcctgtatacattgttcaagatactctaaaaaaatatgcgcttaatgttcctggattgtgttttaaaattgctgtcatgtgtccgggatttagttactactctcctctgagtcagaacagattcctaggccaaaagctccaagggcttgagctcaaatcttgagtacttacgttttgagtacttgagtacttatatttcacttttataccttgttttaaattaaatatggaaataaaatattaataagatagcaaacaatgccactgcccattgacgactgtgtctatcaatcaatgtacttaatggcaaattcacaaatatggaatgccacactcttaaactctaagaattaataaaaatatccaagattcatgaacattttgctaagtgggaatattttggccctttcattaaggcaaaattgcttttctctctgtgttaaaataaattgtaaaactgtggacgaggctgcataagcagctaataaaaggggcttatatctggttataaattatccttattgtctttgcttctctagaaattcacaatcctatcctctgagcaaatcattatgtcatttctccctatattcccaatactacctgaagaatataaaaaccacttgaaatgatggcagataacagactgttacttaagaaacatttaattcaaatgggaggcactttatcatagtaatcttgactaggataaaactgttataaacagaacccaaatagagttgccaaacgcatcctgcaaataaatctttctccacctactcatctttttagtttatattccctgcaccatcagaggaaaatggtaataatagttaatatttatctgagtgttcaacatgtatcaggcactttctaaacacacattcaactcatttaatccacaagctaatcatatgtggatctctatcctcattttatggcttaggacaatgatgcaccgagaagttaagaaacttgccacttacacagcaagcgagcagcagatgtgggatttaagtccgggtggactgatgacttaccttaagcagtgaatcacttcttcctcctgtacaggatctgtttattgataatatttaatttctcataatgcaggttgtagctacatggtggcagacacaggaatataaactggagagctatacgtatgctcaattacgaggtttgaaaaaataccattgtctatgtttaagtggttttttgtttttttttttttacatttgacttgaagttcaggatcctgtacataactagataaccaggcaaaccacaccaattcagaatattattttatactgtttaataaggttatttatgactacacctaggtttttaaaataaataccatgctatgtctattaggacaggtaagctcatggaaacattgaaggtgagctgtgcaatatgacagctatataagttaattaaaatgaaatagaggcaaaattccagtttcttagtcacactgccacatatcagttggtcagtggctacatgactagtggtactgtatgatggaagtgcacagatctagaacatttttattatcacagaaagttctatggtagtccattgaggccctatctttagagaaccatttatgaaatacgtttgagatgaaagtgtactgggcttctggtttaaaatgatggactgagtacatatgaattctcttgttaaagtcaagactccactgaaattaaagtacagaaatgcaaatatgtatacaccaatgacagcaaagcaaaggaggatagaggacagaaacagcagagaaattttaagaaacttttgaaagcctgttgacagcaggaaaacatacagaaaactgtaccttgagataggctttcaggaaatcctagaggaggtaggggtagattatgtaatagaatgcttgagaggctgtaggtatatagtctgcaaggatggcagagagggtagtgaagacgaaacgcaaggggactgactgaagatcaatataggaagctgttatgcctgccagcaatcctgctcccaccctacttcttatgcaacagtggacacttggcactgacttctcaataagaaagtagctgatcctttctaaagacattaatgaatggctgggatgaaatatgggtgggtggcatttccaatatgacatgatgctgtcctgattctgacacttgaggagctcacagtctaattgcctcttagttgacatttcctgcattttcttacatggagttccaagaaagaatttccactccagacaaggacttggcaagaatgaaactaatttacaaaacagggcagttcctcaatctttcttccttaaatataaatggaaaatttagcatcactaggcatatcagaaacaccaaaacataacaaatcaagatgaatctatagaaaagcttatcccaggaaaaagagataaaacaagaaaaagaattttaaaaaatccaaatgatactcaaaaaagttgaaaatatacatataaataggaagagtctgccatgaaaagaaaattagagcataaagaagagttcccaatgattagaaaaatgacttctgatttttttaaaaaaggggaagtcgaatataaaaaagagctctcaaagattaaaaacatgattgctgaaatgactgaatggctgagcagtaaagtcaataacatttcccaaagggtaaaacaacaatgagaacaataagataaatagaaagaaaaaattattacatgaatgtacatgaagacaactttaaaatgtccaatatccaactgataggagtttcaggtagaaaagtaaaagaaagaggcctggaggaaattattaaagaccaacaatttccgaatgctgataatgtaagtcattagagtgagaaaacaaatcacaacttatcacgttccttatgaaatttcagaaaagtaatgtgtataaagagataaaataaacataaaactgtttacttataaaataattcaaatcaaactggtgtcagtccttgcatcagcaatgggtactagaagacaatggactgatgtctttaaggttctgaggaaaatggtttttccacttagattattatacccaatccaattgtcattcacacacaagagaagctatttaggtggtctgtaagtttacctcccttggatcctttttaagaaagtaacaaaggaatctactacaaacaaatgagaatataaaccaaatgagggcatactcagactacaagatattcaactcagacagaagaagagcaaactcaaagctgaaggcagacattatgtcttgtgagtagccacaacagaatggaacaggaaggcagagggctccaggggttatcttcaggtggggaataaggtgacctaataggttagatcaaataattgaaaagtttgaagaacttgataatattctgaagtttcacagtaaatggaaaaaagaaaagaaaagaaaggcagttagaaatctaatctaatcctaatcacctcccaaagaccccatctccaaatgccatcacattggggatcagagcttcaaaatacaaattttgagaggatataaatatttagtctatagcatataggtttaacagtttcctatacctataattttaggagaaaaatatcactatcatcatttgaaaaaaataagaatagttgaaaaatagccttgtataaaacaaagtttggaaaatgatagcatataatttataaaataattatcttgtcttttaaaattattcttagtcaagtctgcccattatctccattgcttaattttacagattaccaatgacctatacccatttgcttaaatttccaaggcctgatttttgctacgctcttgaaccagttggttttgcttagtattgcattttgaatgttaaacctgagaaccagtgttgttttcatgattcttttagcaaatggtttgttattaggacatgctaaaaataatagtttagaatataaaatatgtttttaaatgttgcaagtagatttaagagaacagtaatctatttttaaactgaactttcagaaattaatatattttaaaacatgattagagatgtagcatagaattttaatttttttttttttgagacggagtttcactctgtcacccaggctggagtgcagtggtgcaatcttggctcactgcaacttctgcctcccaggttcaaacgattctcctgcctcagcctcctgagtagctgggactacaggcacctgccaataggcctgaggcctggttaattttgtttttgtttttgtttttttgtatttttagtagagatggggtttcaccatgttggtcaggctagtcttgaactcctgacctcgtgatctgcccgccttggcctcccaaagtgctgtgattacaggcatgagccactgcacctggccaattttttatacatttcaatgagcaaacatatatttaattatagaacaatattacttaaaatagttactaaagctattacaacttgttattaaagattgttttttgaaataggtttgtccactgcctgttacatttacagtgcttgacatttttatgttttttttttttttggctatccaaattgttgaggaataattttgctaaatgataaaatggtataatcttattaattgaaaatatttagcaagagtatacccttataaagataaacacgctttatgtcaatgtattatctattgatacttttgtatattttacaattaaattgccgtaagtagtaacatttttttgttgtttttggccaagaaaactaccactaatattctagcgctaaccctagggtatacttttatgctaagattattgacccaggtatgcagatgggagtcagcctccatttgactggaatgtggaggcctctaaacccaagctgcctgttaagttacagtttccctaaggtgcttgttttactctctccaggtgatgatgccagggaggctgttaaacatggcttgaatgggatcttggtgtcgaatcatggggctcgacaactcgatggggtgccagccactgtgagttttggcagacgctaagatttccttttggagttcccatttccatcactgtgttactatctctatgtcttcctcctctctgtgtgtactttgtgtaatcactcaaggtgaaatacgtgcaaatatgtgagatcttggattttaagtttagtggcacataactacccaagttaaaaatttatttatgtttaattagcccagtgcatttatttgtaacctatgaaagtctctgttaaataataagtcatttgtgggcaaggattattctggcattcatagatacaccaataggtatgtaaactggagtatgaaagaaaggattatgccatgaatgtccaaggacatgagctaacagagaattgtgggatttcaaaggctgtggtagaatctgagatcatcagtacaattgagacaagaaatcaggaggagggacataatcagaatttcctgtggggtggcggttgaaaagctgcagagaaatggtggagagttgggaaaaggagaaaaaaggcttaggtccgggcaacgggaagtgagctgcaaataggctactctggctgagttgtgaaccaccttggctgcacattggaatcatctggggaactttaaagaatcctgatctgctccccaggtctatttatcagaatctctggttggggcttaggggtgtataggcactagtatttttttaaagctatcaggagattccaatgtgcatctttggtttttatgcactggagtaggcaaatcagagtccaaaatctagatgtaaaagtgaactaaactgtcctgaaaggtgtgggactgaatacaactgtatcgaagagcaattagaccctgaagatcctaaagccaagaaaaccgacagaggcacttagggcagattttaagatcagagactgggggtccagaaatggatccgaagccatggagagggacacatttcctggggtggattttatggatccatgatccagaatgggggccgggggccgttggtggggtgctatcaagtggttcccttatgtgctgtccacttgtggggatttggccaagcctcttgtagatggagcaatgatgttgcagatattttttgcttctgctctggccccatgtggaccctctttgcagtgtgataagcctaagagtaaaatgggaaagagtgagatgtgctcagggaatactaaataatccatcttgtttgcagtgtctgatgctgtaactgcccaaccgtttctccttgtccactgtatagacagagccaatttatcaagacggggaattgcaatagaggaagagtttaattcacgcagagccagctgtactgggagattggagttttattattactaaaatcagtctctctgaaaaactgggttttagggtttttaaggataatttggtggggaaggggttggaaagtggcgagtgctgattggtcaggtgggagataaaaatcatagagagtcgaattgtcctcttgctctgagtcagttcctggttgaaggccacaataccagatgaaccagtttatcagacagtggtgccaactgatccaggtacagggtctgcaaaacatctcaagcattgcttttcggttttacaatggtgacgttatccccaggagcaatttggggaggttcagaatcttgtagcctacagctgcatgactcctaaaccataatttctaatcttgtgactaatttgttagtcctgcaaaggcagcctagtccccaggcaggaatggggttttgctttggtaaagagctgttatcatctttgtttcaaaattgaagtatgaactaagtttctcccaaagttagtctggcctacactcagcaatgaacaaggaaagcttggccgttagaatcaagatggagtcagttaggcgagatctctttcactgacatatttttctcagttataatttttgcaaaggcggtttcagtgggagtgggagagttttgggaaatgcatctgcctggatagataaggaaggagatccttgactattatgagtcattgggtgtgcaatagaagagccttggcttagcagcaatgagtctcataaagtggattttgtcatgacaagaggcagaaaggccaatgaggtagtctttaaaattaccatagccaagaaaagagagaaggagggcctgaactgcagaaggacagagggaattgctttctgctccctatcttggtttcttcatcttttaaaatttaaacctttcaactgtaatatttcataatgtgatttacacaggcaaagtaactagcatcatataacaaaactttatatatctatgcatatttactaagtaatatatatatttgtcatatatatatatttactatctatctacctatctatctatctactaagtaatgtgggtgaactttccagaccaccacctctctcagaactggattcttatataaatattttcccttttatcggaacccttcagtggtagttattatatagatggttggaattgggatgaccatttgaatttatccacacaactggaaaaagagtagaacaaatactttagccaactagtagtggtctgttgtttcactgaactagcaggttgatttagtgacattcatagaccaattgtgtggctgtgatggcggagtaaatgatggcagggaatactgggtgtgcatattgcgttgagtttttcctaaagcactaatggtaggaaccaagtaagtctttgtatattgtaggattatacagtcaagtggtggctcacgcctgtaatcccagcactttcagaggccaaggcaagtggatcacttgaggccaggatttcgagagcagcctggccgatgtgtgaaaccccgtctctactaaaaatgcaaaaattagctgggcatggtggtgcactcctgtaatcccagctacttgggaggctgaggcaggagaattgcttgaaccagggggttggaggttgcagtgagccgagatccatgcccctgcactcaagtctgggcaacagagtgagactctgtctcaaaaaacaaaacaaacaaacaaaagatgaaaagtaatgaaaactggaagttgtcagctctttgcaactcagttttgctcccagagacacactgttctaggtgatattaaatgttggttgcaggtaaacagacgtggaaagtgaagacctcctctgagtagggtggagaggttggtcacagcacaaagctttttctcagattcatgactcacttgtgtatggagatgtagacttagtgggcgggccaaattgttttctaaaaattaaatataaatctactgaaatcaaatctaactagattttaagggaaaaatagccaaatggtgttgcttatttccctctcgctgagagaatatggacacgtctagaagggcttttgagtttgttccctgagaccgttttttaaaaaacaataaccgaacctaagacttgaagctataaaaattctgtaagataacattgaaaaaacccttttagacattggtttagggaatgatttcatgaccaagaatccaaaagcaaatgcaatagaaacaaagagaaatagctgggagttaattaaactaaagagctttttgcacagcaaaatgaagtcagcagagtaaatagacaatccatggaatgggagaaaatcttcacaatctatacatctgatgaaaaacaaatatccagaatctacaacgaactcatacaaataagaaaaaaaacaaacaatctgatcaaaaagtgtactaaagacatgaatagacaattctcaaaagaagatatacaaatggccaacaaacatatgaaaaaatgctcaacatcactaatgatcagggaaatgcaaatcaaaaccacaatgtgataccaccttactcctgaaagaatggccataatccaagaatcaaaaaacagtagatggtgtggatgcagtgatcagggaacatttctacactgcaggtaggaatgtaaactagtacagccactatggaaaacagtgtggagattccttaaagaactgaaagtagaactaccatttgatccagcagtcccactactggctatctacccagaggaaaataagtcattattcgaaaaagatacttgcacacacatatttatagaagcacagttcacgattacaaagtcgtggaaccaacccaaaagcccatcaatcaatgagtggacaaagaaaccgtggtacatatatatgatggaatattactcagccataaaaaggaatgaattaacagcatttgcagtgacctggatgagattgaacactattattctaagtgaagtaactcaggaatggaaaaccaaacatcgtatgttctcactgatatgtgggagctaagctatgaggttgcaaaggcataagaatgatacaatggacattggggacttgggggaaagaatagggggtggcaagggataaaagacaacaaatatggtgcagtgtatactgcttaggtgatgggtgcaccaaaatctcaaaaattactacttaagaacttactcatataaccaaataccacctgtaccccaataacttatggaaaataaaataaaaatttaaaattaaaaaacaaacaaaagacaataaccagctgggtacagtggctcatgcctataatcccagcactttgggaggccaagacgggcagatcacctgaggtcaggagttcgagaccagtctggtcaacatggtgaaacactgcttctactaaatacacaaaaattagccgggcatggtggttggcatctgtaatcctaggtacttgggaggccgaggcaggagaatcacttgaacccgggagatggaggttgcagtgagccaagattgtgccattgtactccagcctgggcaacaagagcaagactctgtctcaaaaacaaaacaaaacaaaaaaaaacaaaccataaccctcctctttgcatgtcgtatacatgaggggagatacttgcttgagttttgcctcacactttagagcaaatttaaggctcatgatgatgagagaaatgtgagaaagcatttggtgtaccgcaaagtacaaagttccctcagtgtgtgggtttttctgtgagcggtaaaggtcttgggggaggctgtggtgtccaggtctcagtacttgcacagaagaacttgctatactgcagattttgttatgtcataagtcagagccatggaggcagcatgatgtcatgggaagagcaccgaaatgggagtcttgtctcacctttctcaggggataagggctaggtgagtaagccaatgagacttttaagcccaaacatcttcacagtattgtgttgcttacaaaaagaaagtggacaacaatatgaattatacacttctattaggttggtgcacaagtaatttcaccattacttttaatggcaaagactgcaattacttttgcaccaggctaatataaatcacagagtttgcttatgtggagaaatacttactgtcactaggagtcctagaacaataatttaacttcagttcatcttaatatgttgcttctgagaagagttgccagcctctgctacaccccagaaaaactaaaaaataagattgtgttaaaaatacgcttatcacctcatggttataatgtgatccagattggatttgaagtaattagagaataataggatggaatcaaattggtttctaaaatacatagcactagatcttctcaaattaagattctctggagtatttgaatcctatgagcattttttttcaatttttcattttcattttgatgctatctggacacaaactacctcaagcttagaaataatgactttctttcacagtgaaaattatcaatggcaaaacatttttatagaataagcatttgggttgttaagttcttggggatgttctgtgaagtgctaaagggatttaaattttcttctataaaaagagtccatgcaattccatctttgagaaacatttaatgtatcagatggcttttgctgtgtaacaaaccactctgaaacttactggctaaaccacaatcgtcattattacattttacaattttgtgggttggcaatttgggctgagatctgctcagtgtttttctggtcttggctggactcattcacatgtgtctgtggccagctactaggcctactaggaggctgtcataggatgagctcagcagggatggctctgcattgtctcacatcttccagcattctcatgaagtggcaggtctcctagagagtgagtggaagcatgcaaggcctcctgagatctaggcttagaatgggcatcctgtcacttctctcaattccactgatgaaagcaaatcataagttcaattcatatctaaggtggcagaacagaaccctccttcctttccctttctcccataatgttgcaaggaaatgaagataaagaggagatcattgcagccatttttgcagttgcaaacaatcagcaaaatgtatatgaaccagtgattttctaagtgtgcttaggaaaagccccttagggctgcgtggtgaagtgtgatgggtagggtgggtagacagtcaagggaggatttatgggcagtgacttggactctgtctcttttgcgtttaactaagcacctctggttccatctacttttgtttattttaaactattttgatttgaacaaaggtttccatacctaaaatgtcaaaaatcaagagtataacaaccgatgcaataggaagatggaaaggtgagagctccttgctagcagaagttgtgtttgggggaggggttgggggagcaagttgtgcagggagcattctggaagagtgtgacttgaacacaaatgagaaagaggattctctttgcgagtcagatccctgtgggtttctttctacatcccttactctgcctgacattagtgccttaaatataccaggtcctttataaagtgtttgataaaacagtgaatagagggatgaatgagcaacagtatacagggatcttaccatattttcctggagattaactccagtggagttaaacccacaattacttgcccgaagaagcactaaggaaatagctaaaatgaatggtctcacagatgtatagaaagctgaaaagagggaaacataaacagggacataacatagtgagtctgtctactgtatttatttatctaatctgtttgatcagaattattttgtgtaatatacacctagtaaaactgcagctattgaaagaaaaaagggaggattgaaacacctagcaatagatggaacattgttgttcacagacacacgaaacacaaatctgggctctgttttttaactcaggattcacatttttaagtacctttattagtttacttttaggccagggttggcattggaaattacctaaacacacttgatttgactgactttgaaaatgtgtattgaacccaagctagatagtatttttttttggttctggtttcaaatggggaaatatgcttaattatagcttgcatcatggcttggaaattatagcatttatatgttgatgtaacttgcctgaatgcaaaaagagggctatgtataggaaaagggacatatgtaaatagatccaaagcatgtttggcaaggcagaaaagctaaaagggaaagaggaaaatcgccttacctgccaaacatttagggaccacatgccaagtgttaccttcacttccttccaatctgtagccctgtttagtcttcagcctcatacataaaaccctctaaaattttagggtagaagtgggataacctctgagtgatttcagcacaattatttctggaaaaggtggacttgagtgtatggcagcttcctcagcatacattttaaataggaattgtacttaatttagatttttacattttgggatgaatgtgggtgatttctacagattttgacctctagctcaccttgtaaattgttttaattctcaaatgcagattcacatcaaagtagccaattgtattagttagctactgccatatgacattataaaatgaacaatcccaaactcagtgatttaaatcattgaaataaatgatttccatgaaagtttgtattgaccagtgtctactgatctaggcttggtactagctaggtggctggtatccaattgtcagctccagctgggcttggctgtgctagctctgcttcctgaatatttatcctggggccaaagatgagggggaaacaatacctggtggatggtcttctcatggcaaatgacaaggtgcaaaaaagtaagtgggaatacatgaggttgcttaaggcctatgctcagaaatggcattctaccagctctgctcacatgttatcagccaaagtttccaaggctaaggtgcaggcaagtgcactttgatgccaacctatgtccatcatcaccaactgccaatcaagaccaagatctttatgttgcaagtggtcatattccttaaaaacaagaaaaatgttttcacagagtgttctttaatatatggttggatgcaaaatattttggatgagaaaataagagactaagttgttttattattagttgtgtttgcattttacacactgcttgcactattatctgagtatgaattttaacaattgacttgcaatgagtaatgttcagaataatttatgtcaataaaatacttaatttacttttatacattttataatctcagcactttgggaggctgaggcaggcagatcacttgaggtcaggagttcgagaccagtctggccaacatgatgaaaccccgtctctactaaaaatacaaaaattagctaggcatggtggtgggcacctgtaatcctagctacttgggagactgaggcaggagaatcacttgaactctggagatggaggttgcagtgagccgagatcacaaaactgcactccagcctgggggacagagcaagaccctctctcaaaaaaaaacaaaaaagttatgaaagatcaagtgttttatgtttataattttttgatgacaatctttgaatataagaaacagaaaaaaagacaaccttgcactttaaaagaaaaataagctgctcatttccaaatttagttggtgttttagttactagcatttgtacctctcttctttgagaaggaaataattttaccatttaccccaaacctacttggcttctttcactctaagccctagctggatgtgtcagtggtttttggaggtggagttgaataacaattcagtgttaatagagtcacattattgaacttttctttccccagattgatgttctgccagaaattgtggaggctgtggaagggaaggtggaagtcttcctggacgggggtgtgcggaaaggcactgatgttctgaaagctctggctcttggcgccaaggctgtgtttgtggggagaccaatcgtttggggcttagctttccaggtaactggacaaagaaatgaatatataaaatagacaacttgacagtaaaacaaatgaataaaacaagtcagactgatttagttctgaatcactctgtatcttttcacttggttagggggagaaaggtgttcaagatgtcctcgagatactaaaggaagaattccggttggccatggctctgagtggtaagactcattcttgtttacaactttcttttcttttatgatctttaagtcaaggtccttggtggagagaagtgaatttgaaagggaagagtgtgggatcatttgagtacattaaatttgacgttgactccatatttacagctttgaggaactctgcatgtgcagtctctagtaattacttaacctctgtttttcacagctttattaggaatattttggtgagtacgagtacttggaggtggttgtaacatcatattcttcctcatctcataacacatgaacacatacatctacctggatagtcaacagctccctttggacatctaagtggcatcccaaactcttacctgtccaaaactaagctgctaactttccacgttaaacctgctccacctgcagtttctccatcagttcatgttaatcccatagtttcagttgctcagtacaaaaatcttcagtcattcttgactcttcttttctctcacaccttcttactcataggggctcgatcttcaaaatataatcagaatctgacctccctgtcatctccactgccaccgccctggctggagccatcattgtctctcatcccatggacattgtgggtgggcacgtctattctcacctatctcccctctcccagtctgttctgatcatggcggccagaacggttcttttaaacattcattgagatcatgttacttttctgatcagaaaacccccagtggcttttggtttactcagagtaaatgccagagtctttatagtggtttacaaggcctcatatggtttgactcccgtcatctttctgatcccaacttctaccaatgtcacccttacttattctgcccatgtgacattttgcctccatgatgtcccttgactatgtgagatatgtttcagccttggggtatttgcaatggttgttcgctctgcctggatgctcttcctccagacagctacatgaaaaacttctcatctttcatgtgttcacataaattgtactttcttaaaggtgcctatcctgattactgtgtttaaaatagcagtttatcctccacccatctattcgactccagttttcttttccagttttctttcatcctttttccatagtacctattgtctcctatatatcagctatcatagaatttccttttaaaattatatgcattatatattgtctgtttcccctttagaacataagatacatgaggcagggggctttgttgtcttgattgcagtattttcagtgtctacagcagtgcctggcacacaaacaatacatatttgctgaaagaataaataaataaatacacattaaaatactactagtgactatttctaatttgactcagaaagaacctgtagctagaaagaatggctgtgagttgattatcagctaccgcatttttgaaggtaaagagggcttccttttctgtaatccatatcatctggattgttcccatagataaaactccccagataaatggtctactcactactgtactcagtctgcagacagagcctcaacaagaagaatgccattctgtgaatcctcactatgcattttaatttgctacagacatatcctaaaagagagctttcagtcactgactctctattaaatgtggcagaaagaatatactctttgtgttaataaaaatatgtgccagtcattttgtgttaaggactgtttaggtaataaaaaatggtctcatgccacataagatttggcaagcctaccttgaatcataaaccttacatttgtcaaattttacattccttgggaaaacgattacctgcctgattattattgcattcagttcatattaaatgtatgcattattttttcagggtgccagaatgtgaaagtcatcgacaagacattggtgaggaaaaatcctttggccgtttccaagatctgacagtgcacaatattttcccatctgtattattttttttcagcatgtattacttgacaaagagacactgtgcagagggtgaccacagtctgtaattccccacttcaatacaaagggtgtcgttcttttccaacaaaatagcaatcccttttatttcattgcttttgacttttcaatgggtgtcctaggaaccttttagaaagaaatggactttcatcctggaaatatattaactgttaaaaagaaaacattgaaaatgtgtttagacaacgtcatcccctggcaggctaaagtgctgtatcctttagtaaaattggaggtagcaaacactaaggtgaaaagataatgatctcattgtttattaacctgtattctgtttacatgtctttaaaacagtggttcttaaattgtaagctcaggttcaaagtgttggtaatgcctgattcacaactttgagaaggtagcactggagagaattggaatgggtggcggtaattggtgatacttctttgaatgtagatttccaatcacatctttagtgtctgaatatatccaaatgttttaggatgtatgttacttcttagagagaaataaagcatttttgggaagaatatatctagtccttttgtaacaatatgaaattttaattttattttctgaaccttaattacctcctcgtttcctttctgcataccttattggttatcctatacctcctacttctctttctttactcttttgattctttaccattgataaccatgtgcaagggtagctacataatgtgtgaggactatgccaaattaaaatatgggccccttgttcaaaaagcaagacaaaacccttttccttccttccacagtttttctcttaagctgtcatggagacttgctgtttcatgtcatgcttccttgggcatggggatacccacatggcaagcgtagagccttccaggtgcctggggtattgccttacaacttgccttgatcttacctgtgcccatgcccagaaccctgctgggggtgcagggcaaaaatactaagcagaatgcctgagccagcaaccaagaactcacttagcagacatggggaggtggcaggagatggaacaatgtatgatgctaggctctcagtgtccccggcacaagttccattgttgcatcgtgcatcacttataaaacaaattcaatgataacattattaagtatttcaagccaataaccacagagcatcaaaccctaagcccaagtcccctttctgagcatggagccctgtccactgcatgaggagcatgcccatgaagccctgatcacgtgacttttatattcattcccaaaccaagcattttacaaattggaggtgaactaggtagccaaagtaattttgaagttgatttttcgtcatctctctggttgttcaaccactgtgaggtacttaatgaaacaattcagagaatcactacctgaaaatatgattattatattatgttttattattattatgctttattattcccagaactctttctctctccctttctccttctaaatgctaggagattcctaaatattagcatgaacacacaaaaaacttttttctgaaattatataccagtctggtaaaaaataatcacttaactttatgaaaaagaaaagttatcccttaactttttctcaaaatacgcagagtaaatatttctatcatatcatataattgttttatgcttttccaattaatattgatcaatgaataagtatatagtaagcacctctaattccctcaacagattcaaaatgccttctctgttggcacagaatttccattttgactacatcacagtgtgtggttgtgtgggcgcttgcttaaaagttgataacttcccagaaaatagagatctccaagtggtgttttatgtaaggtttatgcaagtaacagtgagaatggggattactggtcttaattcgtgagtttctcataatttttaagattccctgagccacaataactccttgaatgtagattttcatttattttttcagagttggaatatatctgaatgctttttgtttgataattttttcataatcaaagatatacagctgtttgcttttacttttttttaatgagtgatatggacccaattgtaacagtactgaaatcaaaagtgtgtaatggttaaaagaggaatggtgtgtgttagttgtacaatcccttccaagagttttgaaacttaggcttgatagacagatttctttgaggaagccaacaaacgcctctcttcctaagtttcttgaaatatgttggcgggaggggtaacagggcttcattacggccgcctctgccttttgtgtatgttattttgtggatatagtgctctagagcagtttctcaagctttgatagtgcatcagaatcaatggcagggctcgctgaaacagattgctgggccccacaccatggattctgttgcagccatctatgtgagccagctattgggtgtgggctccaggcagagaggccaagcctcaccttaaaaggccagctgttccttagccaattgataccttttccattgaattgtatttcttattgacatatgaaattcatacagcgag

SEQ ID NO: 16420 - DNA, 234884 bp, Human
  misc_feature (1)...(234884): n = A,T,C or G
ccacagggctctctttgccctctcgggaagcctggtttttacccttgaggcagcagggaggctgcagggtgagatgttgaaggagtgtgatgtgggcagagcctctgtgatggggcatggtttctggcacatcccatttccatattctggggtgatcgaatgggatccggttcaaatccctgtcagtctgcacagaaaaggggaggttttgcaggcggctctggagtgtgacagttgaggattgaatcttgagagtaatgcttctacaaaacacttgtgtagtttgcggtccgctgcccgaccctggtccctttaagggacataaatgcacctctctctcctcgttcttggaaagacagatgagagaaccaaagagtggccttagaagcatatgtaagacacagaaaggaaagatcagctggagtgctggtgaagggtttcacaggataggagaccaggcagcaaggtgcccagcggacaagcagggagggggccttcagtgaaggcgcagagatttgggatgcatgtgggattcagacctgcttcattgtgggaacagagcaggaaggtgccagtgagctgcccttccaggggtcagcagacctttctgtagagggttccaggggtccgcaggccttttctgtagagggccagagagtcagtgttctgcgcttgcagggccacactgcctctgtcacaactgctcacctctgccactgtagcacggaagcagcaggagattgtgtgtaaataaatgaacacaattgtgtctcaataaaactttatttacaaagacaggtgcagtgagtgagctttgccccacaggctctaatttgttgcccctgctccagccccttgatgtagggagcctttgctttgttgttctcagtgaactttgagggctgatggttgggttggagtggaaagagcccaggtgtgatgggagccgtgaggatggccttccttgagtagccacgagctgctgtgggtcttcctgagaagctgtggcaatgggaggacagaggtaaaatagcaagacccagtgcctaaggaggctgaagagggaggatcgctagagcccaggagttcaagactgcagtgagctaggattgcaccgctgctctccagcctgggtggcagagcaagacctcgtctctaaaaaaaaagaaagaaatgtacaagtgtaaaggtagcctatagatgtgttcccctgtattccccaggctctattcttcagcctcctgagcagctggaactacaggtgtgtgctatcatacccagctaattttaattcttttggggcagggtcttgctacgttgcccagtctggtttcaactcctgagttcaagtgatcttcctgtctcagccttccaaagtgctgggattacaggcatgagccactgcacccagacttgtacatctctttaaatgtaaattaaatgtgctttccacagcattagtggaacaccccagcattgctcatcctctccgggctggctcctaacacaggtgccgtggcataggtgctgagttgaatctctgtttttgtaagtcattgcatacatgcttcattctaaaatgtactttattccaaatattgaacagtttgtcttcgggatttattgtctgtggtagttgttttattaattgttttagtaaaacaaagttagcttagttgtgggaattatttaaaaggagctcttaccaggtcagcttccttcggtgttgcgttggttaaagataaacgagaagaatcgggatacagtaattttaggaaataaaaggagactgtagtattggttggctgctctaggtaatggtggtaattttctgtcttcagagtaatcatattgtgaaaatgatgcatcgtataattccaaaaatgaggaagagctttggaatatattttgtgtcttaaataaccagtacttctgttgtgtgttttatatacgaccagcctcttacctatacactttgtcttaaaaattatttctgtttaggtacttggaaaaatggacaaggattgtgaaatgaaacgcaccacactggacagccctttggggaagctggagctgtctggttgtgagcagggtctgcacgaaataaagctcctgggcaaggggacgtctgcagctgagtaagtatgagcccacgtgatcctgtataccgcacatgctgaagcaaccgaggagtatatgtgataacggcatgttttccattgatggcagggtaacgcatagccttacccccacaaccgcaaccacgagtccgtctctcaaaacagcgtgctgcgacggctcctgcatttgcagcttccctgtgtgttgcccaggagctctccacctccgatgaacccagggccgttcccttcataccctttcattagtagctctaagatgtttgattaaggtgtacgtttacagaggagttggttggtgatgagcattgaacatttgggttcttcggcatatgtctctggaaatttagagacagggagatgcaggattaatcttgattaaaaaaaaaagcccagatcagcgttccctgttcctccagagtctgccaggtgagtttcatactaggactgcttgatgttctggaatcccttaaccaggagtcccagttgccttttgagagccgtggtcagacccttggcgagggtgtggctgaggatggccctgccagggggaagggcccgaaagccccttttcagcatgactttaagttcttgtcatttctaagagcgtacatgtttctctttttgtgaacagctcccactatatttctctaattgcaaaaacgtaagaaatgtaaagcattccttagtgttttgctttgaaatgtaacatttaatttcctccgttcattctattaaaattgtagctcttgttatttctgaccaaagaagaagaagaaaaaaaaaacacccactcctatgcttggtgtttctcttaactggctaataaacacaatgccaagaacattagataaagaaaatacataagaaacataaaaattgattttaatgggcccctgtccgagacagccataatgagcacaagcgcagtcataaatatcagcactcgcctccgctgtcgagatttttcctgtagagctgcacgttacaatcaatatagtctttttgagaccaaaaaataagcaaacctttgaaccatgtgaatatactcttttcagtttctatgagaaccatctggctgtagtgttcagaaagtcacaggcaccaaataatttgtaggggaaaatgtcattttgtcttttagcatgttcagttgcacaataaatcatagaaattatgtgttggttttttttttcttttgggaaaaaggtacaaagtgaatttggggaagaaaaaggaaaacaaaacaaaacaaacattataagatatgtttagttaaatgcccattgtggattaggcaaataggatgaagacgcttaattttgaatttctactttatgaactttctgaatcaagttaggatcaggttcaggtgtaaaaacagccgtgaaataatgctaaatcctgaataggatctggctgattgctctcatgaaaacacacctgtggacaaaccatgggagctggggctggtgccttcatggcccctgggaacttgggctcctctgagcttggggtctccagatggtggtccctgccctggtgcttcaagacagctcctgggcctctgccacaggtaggggagaaagaaaggagggcgtgtcatatatgggctaaaattaggtgtcttgtgagtaaggaaggagtgggatttggggggcagccagcagtatttgtgtgtagttaattttagtggggggagcatttaaaagtttgagaatagtatataaaagtatatgaatagtcaattaagtttaacattttatcatttttaaaatttaggtaaaaattacatagaagtcagatttcaagtgtacaattcatttgacaaaagtgtacaaccgtataactaccgccgaagatatagaacattcaagatatggaacattccagaaaattcccttgtgccccctaaagttagtcctctttgtgaatttttgtttccatttctccagagtaaattcctgagtgtggaattgctgggctggatggcaaatgtatgtttaacttgacaagaaattgccaaaactttcttcagagcgggatggaatttccactagcagtgtgtgagtttcagttactccacgttcttggcagcacttggtggtgtcagtttttcagattttagccattctggctggtatgaagtatatctcattgtggttctaatttgcactttgctgatgacttatcctgatgaagtcttggccattcctatgttttctttgtgaaatatctactcaagtcttttgcccattttttttttttatttctttgagatggaggcttgctctgtcacctaggctggagtgcagtggtgcaatctcggctcactgcaacctccgcctcctgggttcaagcaattctcctgcctcagcctctggagtagctgggattacaggcacgcaccgccacacctggctaatttttgtatttttagtagagacagggtttcaccatgttggtcaggctggtctctaactcctgaccttgtgatctgcctgcctcggcctcccaaagtactgggattacaggcgtgagccactgcgcctggccaccttttgctcattttaaaattagaggtttcttgtttgtgtttttgttgatgttattgatttgtggttctggatgtaagacttttgtcagatgtctgtattgtgatgattttctcacaagttggaggcctgcttttttgtttttccaatagtgtcttttgatgagtagaggttttaaattttgaacaagtccatatgtctttttttccctttatgtttaacactttttgtgttccctgtaagaaatatttgtctactgtaatgtctgaaataaattctcccgtaatttcttttaaaagctttgtagttttttttatgtttagatatatgtgatccattttgaattacctttttgtgaggtacagagtttattttttccctgtagctatttagttgttttagcatcatttgttggaaaataaaaattgtctcctttcttcattgaattaccatcagttgaccaagggtgtgtgagcctgttcctgttttgctctgtttggttcagcctacctttgcctgttctatgcccgttccatgctggcttggttaggtagctttgtgatacatcttttgttttgttttgttttgttttgagacggagtcttgctctgtcgcccaggctggagtgcagtggtgtgatctcgactcactgcaagctgtgcctcctgggttcacgccattctcctgcctcagcctcccgagtagctgagactacaggcgcctgctgccacgcccggctaaatttttgtatatttagtagagacagggtttcactgtgttagccaggatggtctccatctcctgacctcgtgatccacccacctcggcctcccaaagtgctgggattacaggcgtgagccaccgcgcccggcctgtgatacatcttgatgctaggtaatgtgagtccatgaatcctctaaatttatttatttttgaaaggtttggcttctatgtctcttaagtttgcctattacttttagaattcaggtgtaaatttctgcaatgattcttttttggatttcgactgggagttcattgaacctggttgtcaattttgggagggttgacatcttgatactgaagtgttcagttcttggctttgactggcgtctgcatttgtttgggttctttcattgtcctcggcagcgttgagtggtttttcagcctggaggctttgcttatctggcagactccatttctaaatactttgttcttgatggtattctaaattaggttgaaactttttaaccttttaatttattgctgcttgtgtttaacaactgacttgtatgttgatcttatattctgggatcttgacttaattcatgtattttttccagggttgttttgagattgcttaggattctgtataaaaattcatgatgtctatgaataaagacaataggcttcttcctttctgattgttatgctttaatttcttctattgagctgtccagaaccctccaggatgacttcagtaagtgtggtgacaacagacgtccttccctgtttcctggtttgggggagcttgcaggatttcaccagtgaggacttgctccccatgttgggtttcagaggcgtcttcctcactgtgtggaatttttgtcaaatgatatttcatgtatgtgttgacatagtcatgtgctcttgctcctttattctttaaatttggtagaataaatttttagaattttaaaccaggtgtatacttttctttttttggtactgtctttgtcttgttttggaattagtctcattctgatgacagatcaatttggaagcattccctcttctattttctgaaagagttaagtgttggattgatattactttatctccaaattttgggatgaatgcaccttggatgccatctgggtctggtgtcagaagccttttgtgaagcttcctggtttagtagaattgggtgctgccttccctcatctcggggtgctcccacctggagccatctgtgctctgtgtggctgctgtcctctggttgctgagtgacagtggctgctgggatttggggcagcatcctgctggctctggcccctgccctcacccttctccgagtgcctatgagtcccagggtggtccttgcttcctctgaatgggtgtttctttagtagataaattacaggttgaccactgggccttcttcagtgacattgcatctgtgcttgtgtacaaagtgtgattcccgctccccaggtgaatccacttacctgtgtgtggcttcgcacggggaccaatgacttccttgcatagttacctttccctccctaaaaacgtgtgagaagcacatcagttgggaaagtggtatattttccaaaagggaagcaacataagctgcttttaagttagtttcataactgcctgacagtatcaggtttctgtgaatgccatcacgtccaggagcacttggcctctgcaagagcggagcagctcccccgcgccatcttcccgcagctgcagagctctgacctcgtcagattccctgcagtgcccacagtctaatgagaggggccaggctgtatgtgtttacttttctaatgttattttggggcttgtttagttttccataatgttgattgccgtatttgattacttgaaaaaatggaccgtatcaccctgggtcatacttagattacaaaaatagtagcagtaggacttgtagatcttggaagctggggagctaagggggctcatctttcacttaccaagggcttacccttgtttttcattcttttatttttttcacataagccttttcagaaaaatataggaaaagctgatagagtccaattgaactaaaccactttaaaactttttgtattttggaaaatgtggggactacacacagactgtcttctactgcagaggctctttttctgtcttcatggtagggatctatttacagggtttgtgggtctgcttttggcatctggcccagccagcccttggattgaggctgggtggggcatgcaggttggccctgaccctcttctgagcacctggctggctggacagatagggccttcagtcaccagctaggctggcctgaccctagaccctctggaacgtgagaacgtatcctgccgggcctctgtgttgaacctgggaggagagttgtctgatgtcattggatgccctatgagtttctgccctcgaaacgtgccccatggaaagcgtgaagatgcctttgagcttcccgaagggcagctgcagcaggaggtgacctgcgttttgcctctctcctgctcatctctaaatgtgttcaggaactcagtcgaccctcagccgtgcatggggtcccggctggcttggtatgtgcacctgccgagtctgtgctgccagttatccccacggcctctccgtgcaggtcggtctgaccagtgccagtcggatggttcctcaaggtccacgggccatgagaaccttcctgggaacttcacgaattcgtttttttctgacagattgggaaattaatacagacacttgccgcattcacgttactataattgatctttcaaggaggagaagaaactgttcttaaggacaaacacttagagaagcactgccagtaaaaataacatccaaaaaaacgcgctctgtaggacttttacctgcggcaagttcggctgtctcattgcttttcctcagtgccgtgaaataatgatttgtgttgtatgtgcttaaaaaatgtgattattttactttatagagtgttccttaaggaggtctcttgagtcaaataagcatgtttctgtgaggaaaacttgccaggcgctccttggctttatagaaatcgtctgtttttcaaaaacgaatggctgaatgccctggcgagcctggaaccccttgttcttgcccctgctggctctgcgattccatgtcggtgaggcctgtccacgctgacggatgttgcctcccgtttctgcctgagaggggtaaatgatcagtggtggatagggagttcctcttgtgacttatgttatcaataacacaaattgtgcatatacttcaccccatgctaaacatttatagtgcagtgtcctttagaagccagacaatggcctcgtctttcaggttgatggctaaaaagacaagacaggaagccaaggtgtttcttttcagctccacagatccttgtgatgaattatgttccgtgacgagagggtacgatgggggccgactgctggcccccggacacacagtgctgcacatggggcctgcagaggtgttagcgtagcccgtgatggtggcagctcttggaccttagtaaaataaagggaagcagcataacatatgcttttaagtgagggtatggcgtgaaaaccctgccgttgtgtgataggagacgggctctgcaggctgagccttccaagtcgtgaatgatgaggtttgctgtgctcctctgattggcagctgaaagggcaggtcagagctcctctctacagcactgcggagaatcccaggctgtggagcactggcccatccaccccaggacagagctgcctcgccacagaagagcgaggttctgggattcactgtgaaattgttgtatggtttctgatctagaaaatcaaacctaaacaatgcgcaacctcaccagcttcggtgctcttgatgttttctccctgcagctggttctttgctgacctgggggcagagtagacagtggtggcagccaggtggatagtatttaaacaagtgtcactgagatttagggtccttatgtgctggactcatctaagaaaaaaaaaagcaatgcaaaagttttatttctgtcaattttgtaactgtgttacaaggagacagagatggcaaacgtgtgtgcctgtgtctgtgagtcagaagcaaacttgttcatttcatttaattttaagtctgccaggaacttcttggaaggaagaaaagaatggttgaatgccagctacaaataggtgagttcagaatatgatccaaagtgtcagagcaaaagattttttaagtttccaacatttggagtaaaagagcactttagagtaacaggtaaatgggttaacttcaggcagagagaggtggatgtttctgcctctctggtatgttaaaataaaaccccttaaatcccctgctcttaataagtttccatttaagagtcattgggcttcacctctgttcggctctgtttgtgaagggagggcagcttttctggggagatcatgcccctctctcctttatgtggccacagagatcctttccctgttttcatgaggaggaaacatggaaccttggcacaatccagttctcatctagaattacattgtatgctgtgcaggccaggggaggaaagatcccggaagtggcagccaccggataggcacgttgccgccacagccagcatcggcgtctgttcaggtttcaggaaggtcacttcttggctcaaatccctggtatttccaggttgtcttcagactgcggctttcaccctcaggaagccccagcatggccttgggcccagcttagaggcttgtgggggtttgggtgtagccccgtgcacagtatcctgtctaggattcataatcttgcaacagccatccctgatgggattgggtaagatgacagtgtcctttctcgatggccctggtgccctgtggagttgggtcctggccctcactaccctgttgcgtgggtgggccacgcccctcctgctgatcagcctctgttgcagagagtctggccctgtggacccctgcccccggccccaggccctgtgtctgcgctgggcttgcattgcctgcctctcggtcccctcgcctcattgcagtttggtgcttctaattagttgtggtcttgaaaagctggtgaacaggcttgtccacattgtatgggaaataaggttcaatgaacccctgtgagaaacgccaagtgtgggatttctgacagtatcccacagaaacatctcagagcccatttctgtttcctcctggagtctctgtttctcccagaagaggcggcgtggccaggggtcaggcagatgtcaaggaagtgaggactcggagggactggcacctgtggaatagcccctgcttcgtctgtctggcctggtgggaggaggtgtccttccgtcactgcacttcgtccttgggacccctctgtgaagttgttggcatcaatgtgcgtttaccaataagagaaatggagatggggtgagggatggtgggttacaagtcctggggaagacttcagggaagaagtgggtattccctctacttagctgaacttgcagtagagactgccactctgggagtgacttctgttctcctgtgaaatcctctgtgactcttgcctgcagttgagggagcctctgagaccatcctgattgggatttggtcagtgggaactcaagtcagtattgtcctgggggcctgagtgccagtgtcttaaaaatagagtgtcctccaggtaatgttggatttggaagttcaggctcagcactggatttgtcctcgtgatatcactcgcctactgtacacatgagtcattgtaaagttacgacatgagctcgcatacgtgctggtattagagctccttggacggtgatgtgctgttttagaggagaaaaagctgagatgaaacaaaaatggtggtggcagttacccagggccacgtctgtggatgccatcctcaggatgccattgcatctcgggccagcctccctctgcttttgcaaaagcacaaccgtctggcctctacgaccaccaacacacacctctcatactctggaatttgatttctggaatgcttttttattcttcctatatctgtaagattttctgatatttaaactggctgcaactaatgaatagttttcagttttgttttaaaagtgttcatgtcatttaagctctaaactctcacaatatacttggtttgttaaatgtaaaattttatcagtaattagatcagctccttgatattaatgtacagggtagctcttgcgtgctgatcagttcagaatttaaattgagttaaaggttaaatgagtttaatttttgaattgaactgaagcattgtcttgtggcaaattcatccagaatttttatttccagttgctgtacaagtgacggaagtgggtctttttgcgataaaaacattgtgaatacatttaggattcagtgagcttctgtcatttactcgctcattctctaaacgtgtgagtgccctgctccgtgtcagaccagatggcaggccctgcatggggtggggaggggccagaatgtgcagccccacctgcagcccaagcccagctcaggggcagacaggggcagacggggaagtgggctgttccacaccttgagattggtgaattcctcaagacagcggctggcaggggcccaagcctaggtgactggccacagagctgaatggggctgaccgagttaggacatcactgggtggtgaaccaggaggccctggctgctgacaggatgtaggggcatggaggggtagcagaaggaggcagttaagaggctgcgagccccctcttgggcatctgacggggtggtgcttcctcccagggctaggggagaggtgagcaaagaataacctcaggaaaagaaataaaagacctggaggaacagtttaacaagtgggtggccatgaagagctaccaatggagactgaaggaaaaccaagaaggaccagagagagaatggagccaggaggctggaaggagagaggcgggttttgtgtcaggattgcccagagctccccggagaggagcatctctcctctccatggcagagcacagagggtggaacactgacgtcagatcttcttcaggccctgaacgtaagaattccttggtacctggtctgctttgagactgacatgctgtgtttgattagtttgacttcgggatgccagctaaatgctgtttgctcagcatatgcctgaactggaaatggttccatcacaaaacaaactgaatcaaatagaacgtgggggtggctcagtggggacacagagccagaggtgagtctccttcaccccaaacaccccaagttctagatttgttcttggagctctgtgtcagggttggggtggacaggagggagagaatatcctccgcagaaacacagtttatcacactgcagaattcttagtgttcttctgacaaggacgtttgttcagtttccctctagactgggccatgctctctaaatagaactgaaatcatagttacaactcaaaggcagttgagagaagagttctagctttgttccataacgtcctgtgtcttgatttcactgtatctgtctgttcatcctgctgggggcgttaacccacctcttctcgtacagggtcatctctagtttcactgaggacctctgagaaccctagtccctctgtccatacacatcggcaggagactcacctcccccctttcctcctgtaccccatctgatccacatgcacaaaacacacacatgcaaatatttaaaagtagaaaggcttatggactgtatgacttcagtacacctgcagattcatggagtggttctggagaacattggtccttctgccggcctggcagctactttaatttctggtgtccattggcagaatacaagctcatagtgtgtgctgggggctgggtggggcaggggattaccgttttcttgcagtgattgttcttgatggaatccacattactgctttcaaagctgcttttcctgtgccttcttccagaaagctatcctcccgtccttggttggctggggcaggtgaagcattaggaaatgctctgtctctgcattctcttcgagtaacactggggagtgttcatggcttctggcagaacagcaatgttagccttcagctgctgaagcaagccttctgctcattctagaggcatcttctaaacagatctgcactggtcaggtggggctggagaaggactgggctgagagcacagctatgggaggcaatacttgttcttgttcccaagaagctgatgtgtcgtccggtgaggtctctcgtcagccgaaggttggcacaaggtcgccaggcaagggctttttgtatgtgaagtatgcacattctagccacagagttttctgccagggtgtttagacaagctaaaagtggaatataaactgtattcaatttgctaggttgcaattataaggacaaacatgtttttaagacttaacccattatagtaggaaaatacaaggcttggggtatgctgactctttcccttgttcgtctctcaaatagaaaaatggtgtgtgtaagtaggtgtttgtatatgtacattataagacattctagaaatttctgtcctatttctttaatattcttgccactaaaaatatatgctcctgaaactagggaaaaagaaactgtttatcattcttctgaattattacagataccccaaaagtagcctcctccaaatagtggtttttcttttctaaaaatcacctggaaaaatactgagctttctgatctttattttatccttttcagtggctctgtttggaagagttattgtacaacccagcactgcttttattaaaaagaaaactgggccactcatttccttcaaagtttttggtgtgtttaaatcttctctaggtaaacaaaacttttattgaaaataatattttgagaccgtgacacccttctcacaagaagcggtgctgaaagcccccttgttggctggtcctgcaggcagcctggcgtctgctttgcctgtgggccgtgcagggtgctgggggcagtggggagaggcgtcagtcccacctgcagctttcgggggggtgctggggaggcagatttgacatgaacgcaaataagtgcaaggaccatcagggcaaagagacccaggagaccaggccaggggaggaggcagagagcctggtcaggccaggctggtcctccaggtccaggccctgcaggatcctggaaggcgtgaagatgggctggaggtgtgagcaccaagaatggggcgcggcctgaccttgggtctctagaagttaccctgtggtggcattttctataattgatgtcataaatagctggcttctttgttagaattcatttacttactaagtttggcaaatatgttgaaggaaagaaatgtgagtgtgtggatggatttcagcacgttgacatcagtgcctgtctccttggtgcctgttggagacaccgtgttggaataaggatgaggttcctccctcagaatggttgatccatttccttcagttcttcttcagttttgcagcttttctcccctaactgtagcagaccatctcctggaatctcatattaaaggcataattaatcatgtgatatcctctcgttttttgcatcagagttttcaagagccctccagatttttattgcctgcagatccgtgtgcttagacatagtaccgtcagcagtaaactggcttctggagaagaaattgacaaacaactttatagttgcatttttagccttaatatctgagggcgagaagaatgttcaggatttatgaagttcctgaatttaaaatataagcaataaaatgttcctaatgtggggtccccatctgcatctattattacaaactcttaaagtcactttagcctaacatgtcaataggagttttcttctctttctcttttctttttgacaaattgtgtccaagcaaattagtttgcttgcatgaagcgtcatctgtgtttgcaagctggaacagttttgctggttaagcagtctagagatgataaaattttttgtccgagtatgactttggtggtgaatttaaaagaatcacggccgctgctggaagctcagaggagaggtccattttaaagggcgtctgctgcactcagcccaaagcgttacggggattgtttgaattgacaaaatgaaaatatgtattatattttctctttttaaaatccatttacagtttatttgtctgatatggaggagcagaggtataaattacagagaaattgtcatcatatcctctggatgataagtagggccagggcttctgtttatttcggtggttggttacccactcaggacagtaaaatcacaaagttttagctaaggaaggagaaatcccttctgcctgtataataaatgttgttttgacccaactacactgtttcttgtgataaaaatatgtcacttaaggtttcctgcatctgccatttgtgaacgtacagttgagcgacattagttggtgccatctgtgagtgcacagtgcagcaactttagggggttcacaatgttccgcagccatcaccgccgcccagcactggcatgtttcacagtgttccgcagccatcaccgccacccagcaccggcatgtttcacagtgttccgcagccaccaccgccgcccagcaccggcatgtttcacagtgttccgcagccaccaccgccacccagcaccggaatgtttcacagtgttccgcagccatcaccaccacccagcactggaatgtttctgtgttttgattctttttttttttttttgagacttaatctcgctctgtcacctaggctggagtacagtggtgcgatctcggctcactgcaacctccatctcccaggttcaagtgattctcgcgcctcagccccccaagtagctgggattacaggtgcacgccaccacgcccagctaatttttgtatttttagtagagatggggtttcaccgtgttgccaggatggtctcgatctcctgacctcaggtgatccaccttccttagtctcccaaagtcctgggattacaggcgtgagccaccgtgcctggcttcatctccagaacttttctgtcttgcagaactgaaacccgtacccattaaacactaactccccatttctgccagcccatcccctggcacccaccctactcctttccgtcttgatgctaacacaccttgtgtgggttcctccaagtcaagagaaggagtgtccaaagacccctgagaccagaaccctctgccaacgttggtagtgctgtttcggcctggagggcaggtgggcctctgggcacttcttcgtcaggacatggagccatttcgggtagggccctgggtctaccctgtcccagccccgttccctatcagaaacccgaggcccagaggtgcagggcagctgcagcaccagggtggacagatgttgatgatcagtgggaaggaattcaaagaaatagaacattctacacaaatgtggggaggtatctttagtaaaaacaggacccaagtacatgcaaagtgcactgtgagggagagagatgctctgaagaaaggcactgtttttacattaatgagcatttaaatgatgctgggttaaccatttggctttttgtaccttgtcaccatctcctttatggtgtgattggactttcgagagaaggtggaggaaggttaatagataggtaggagagttgcaggcaggaaagacagaaggccccggggatgataggtggggcagagggagggatggagaggtgacttcaggaagagcatcagctgccgcaggccagggcaccctcaggaagcaggccccccatgcttgcagctgcccccgggagccctcatccccagtctgacaactcgaggtagatctgggttgctctttattttttgatgatttttgcatagtttcaaggatcagtgtcttctacactgatattctatctctgtaagtttctccgaggtattttcacctgtactgacattgtagtctttccttactctcttatttatttatttaccagaccccaccactgggtgcagtgatcaaaaccaaaatatcaaaccagcaccagaaactcttcagcagaccggtggaacatgccttagagaaagccagaggggtcaggcatagcctcctgtgcctggcctgcgctcgcctgggaagggcacccctcgctgtccaagagtgaccccaggccacagaaaccacgctgagtaccaaaggcgagtccccagggtgtgggcaggctccttgctggcatgttcagcccaggcttgccggaagtggggctcaggctctgtctgtgggataatgatcagaagcttggcagtcatgggaccaggataagaagaaccaaaggacagctctcctctcatggttatgggccaaaaaataggtgattgttttaactgtggaaactgacccactaagggggacctgctgagaggaaggccagtggggccgcagacaggaggggaggccacagccgcccacccgctcatggccgagcgccccgtttcctgaacatgtgggaggggcaggctccccacatgggaaccactgggccgtgactgtggcgctccagctgctggcagtgcacacccggtggggccctctgtggcttgagctgcgtcaccatgacgctgcatgcccaggtggtcatccaggaggatgactctgtgcagacctgtgtgcccccgggcctgggcctcctgcaccccagaggtcagtgacagtggaaattgccacagacgtgggtttgtggccttcaaagccttcaatgtcacagaattctgagtctttagctaaattaagtacatgttcacgtgagtgtgtgatttctccatgaggactgagcctcatagtttgtccctgtaccggtgtcagttcatcgctttggtcttggtggagaattctgcatcgcaggcacatcgtctggttagcgggagacatgtttggccagcggtgaaagactgccttgcccgagttcctgagacttcggggctactgatggcagggagaggctggccgagggcagggccacgcggtccccttctgctgatgtccgtgaggactgggcacagctgccagagtcaagggcacggaagtgcaagcagtccgtccttttctgaagcctgctctttttgtttttccccacgtgtgtcaccttttaacgtttttttcctggctttttcattaatgtatgtaaaaatattaaaagcccttgtatattacatgaaaaactatgtcagctgccttgcttttttctatttattaaaacttttcaagcagtaaaaacattttacttgttaatgagggaaagtgggaaaattaatgacatagagcttggatccaccacgatgtctcctcttaaccatgcgcagccagcttcccaccgcatggagtttaatttctgcgatagggttcagtaagcaaatgcaaatagatttaatgatttgcatcagtagatcatttctcagtttaatatcctctgatattttgggtcaaggactctttctttgggagactagtataatttctagaggtagaattattaatattagtgatattacattatgttgaagtgaagtgagatagatgtatcattttcacaaagtcagatttctgcgtgacttttattcattgtggtgcaaaggaaaccctggctgctgaagtagacttaggagcaggcagaattcctggacgcaggtgccttggagtgaggtgaccctctctggcccccagcaccttgcgagcagtggtttttgcatctgttcaccagcgcatgtgaacctgtgggcccgggggacacgtggtccatttttgttgagtacgttcaacaaaggaatgaattaaaatgagaactcttttcagcaaacgctgatggagctttctgtgtctcgtgtgtggcaccatgctgacggaatgacgagaaaccacaacctggcctcaaggagctttgtctactgcgggagacagagatggtggcagatcagtcctggaggcacaaggagagagtggtagaaatacacaaaaggcattgaagaccagtggagcatcagggtcactttcacagggaggaggccaggggtcttgttgcctgcctgccccaaacgtggcctccattccttctttctgtctcccgctggaaaggctgagtgcaggtgccagctctctctgcctcactgagcgggtatgtgtgagaagcgtaggcctactggcaggctcctggggaagacgtttctcccctgatacaaagagcagcatgaggaagactctcccggctccccagtctgcggacacagttgtgtgaatgtgattgcaggagggagctgggcagctgttatgtgaccatgagggcgtgggactggggctgaaaggtggcgtgctgccaatgagaaagatggggagagctgggcacctgctggccctgtggccggccaggccgcctctgaacacctattctgtgacctgatgtgcatcctcatcacacactgcagccgtgagcagcacgcaggtgatgacgggtcatacgccatctggggacttgatgctccttttagcaaatacagaaagtacaaaggaaataagaatcagttccattaatcagtgatagtcttttggtgtaattccttctagctttttttttgttttcatcgacatatttaaaatcagttttgaattctacttaattttatatcttaagcatttttcttgttctgacatctttttaagcatgatttttcaaggtctgtgcttggttctttgttaaggcctgttgcgtggttgtacgtggtggtattttaactgtctatgtcctggtgaacctctatgtttttgtttctgtttactgggctgcagtaaacagtctcgatgaacactatgtagccctgggtgagtgcttcctgagcaagcttgctttttggcctttctccctgtagcttttttgtctgtaacacccctttctgtattgcaggttggcttctgaaatcaaatgtgaccctaagtgactcctcactgtttttaagataagaaagcattagctctgtgttttcctagcccctccgttcttgtacttagacccttcactctgaacagcaggtatgccagcctgtacttcctggcattattacccagtggcccatagctcagaagtgacattgtgtggtgtgaacgctgtctccggagcgagattcctaactcctctactttacagctataaagtggacaaatcacttcactccatgcctcagtttccccaggtatcacacatggggactataatagcatctaaccacatagattgttggacaattaaatgagctgaccagcaggaaactcttagaacaacgccaccccatagtaagcactcaataaatggcaactgctgccgttgatgaggatgacgatggtgctatttctaccacttcctaaggtcgcccctgcgtgctcagcagccacctccaccctgccctacccgctgcccacatatttcataggcctccttagatgtccctgtctttgagccgggagccctcgcactcccaggcttgcttcagatcccttgcctgagcctctccagcactttgagcccgctctgcccgagcgctgttctccttccgtgccgtgctgtctgctgtgagtcctggagaacagggaccatgtctatcttgctggccttagtacccctcacagggcctagcccagggggcactcaagaaattgtaaagatccataggccgggcgtggtggctcacacctgtaatcccagcactttgggaggccaaggcaagagactcacttgaggccaggagtttgagaacagcctgggcaacatagattctgtctctacaaaaaaacttaaaaaaaaaaaattatccaggcctggtggaaggcgtctgcagtgtcagctactcaggaggctgaggcgggaggaccgcttgagcccaggagttcagagctgcagtgagctgtgattatgccactgcactgcagcctgggcaacagagtgagaccctgtctctaaaaaaaaaataaaataaaaaataaagatcctgtaagtgaagggttagaagagtggaatatatgtgctcttaacaaagaatggtgtgattatagagatgggaggtgaaaagtagcacgaattccaagttttattttcggcaactccgtcagagtcctgaatgttctttacccagtttctcactcccactgggactctctagggccagcgggaaccctgcaggcattcggagaactgagcgctggctggacctcctcaaaacggggcaccctccagggagctgtcgaggggctcttctgcctcttcagaaaccatcatcagctgtgaaatgtgggcttccaagtggttttgtgtctcctcagtttacagagtccatgtttttggtgactcttgccttggaccctgatggcgctggggggtttcatcgccatttaaccctccgcgtctcacagagaccaagcagtgctttcgggatcgctctgttggtctctgtgtagcacgtggcccccaaaatttaggtgttgaagtcctcatcctcagaacctctggatgtgacagtatttttgagatagggtctcttagaaaggtgattagggtaactcagggtcattagaggagcccctcacccagtgtgaccggtgtccccatgagatggaggttgtggcacagacacacggagggatggccacgtgaggaccctgggagaaggctgccttctgcaagccaaggagagagcgccttggagaaaaccagctgtgcctacaccttgggttcagacttgcagcacccaggctgcagggcttcgtcagggcagccctggcggaagaacgcagcctcgtcggtgggtttggtgatgctgtgcagttcagctttaccgtcttgctgcagcgggaacgtcctgctgtagaagaggcgccgccatcccagacagtgttcataaacaccgacggcaaagtcaggacgggcaggagcgttctaggcaaatgatgaaaatggtattttacacatatttgaaaagaaaggtttgagaaggcatccattattaaaaccaaattcaacagagaatttaaaaactggctgtggtgagcaatgttagtcccaaatcactttttcacaacttgtttctgttctgtcgtagggctagtgagaccagctttcccttgagttctggggcgggacgtggaatgtttgtgaggctacccttcattgaaggggggcccgtgatgttgagtgttcaccgtctttcagaacgtttgtgcggtggcgtgtcccttctgtaaattgctgtgacctgggctgcatgctccacagtcagactcgcttcgccctcttactggtcttcattaattcgtggtccctggagtggagcgggaaatacagatatccacctcctctcattatccaaatacaataacaaattacgaagcatcttatcctaccaaccattatcctatcagaaagcatgtgctaatttcgaggaagcaagaggaactatgtcagatgtgccatgagatgtaaaatgtactcgccctgtatcttggtcttctcctagcagtatcttgtctgacaatctccttgtttaacttcttgggctttttctttgacatcttcccacctttccctaagggtttaactgtcttagatctccttgtctgcttctgcccgagactctgggtccctgtcaactcgggtagaattttattggtatttttaggctctttaacatactttaatcattgtgttgctgcatatatttcttctaagatagaagtaaattgtaattgtcctcagataataacctaggaccttaaaatacacacaaatgtacacactaatgaattttgtaaatattacataactcggtaattattgtttcaaattagataatgcagaaatctctggatttttatgtcggtgtttataaagcattttaatgataattggggaagttggttgtgggtttttagctagaacaggaacccattataatttttcccaattataataatgggacataagcctctgtaacctgaaattttcctctatgacatgttttcagaagtagaattattagatttgatgagtgtggatgcctaggtttgtagtcaactttttgaactgagctaatcaatgcatatttgggaagagcatataatccaaaatattgggtctacaaatgtaagattgcctttggtgatgagttggtgtcatctgtcttctgtaggaaatgaagggcctcttgcagtgtgctgtgcctcattttaaacctttaactggcaagtggtcctgatcttccctctggacagctgcgggaagaggtttcccggtttaccttggcccccgtaacaccacatcatcccacgtgtgcgtgaagagcccgcacaggccccctgtgcgcccggggtcaggtgtggatggggtcggggtatttccagtacttgcgcttcggagtctttttaaaattgagagctcatctattgttgataaatggccaaatataaatgtataacaccttgattaataggctgctatgaaattgaaggtggtcttttctaggaaatcctcattgaaatactgcccattttgaataagtctaatagtacgatgaaccacacccttagtggaaacgttataggatgcaaataggaagatttgtgggtgtttttccttcatgaatttgttgttatctttgcagaagtgaagaatatcaatattttatggcctttctttgggattcgtgtttattaccagtgatgcagagcgtggccctggtcctcagcgcctctgcctttgtggtggcgggggccagtttgcctggtggggaggtgtgtgtgttttcaccaagttagcaaatttcctgttttctcttttaaaatggaaggctagcttcctctcccattggctttttctggagattggaaatggtattacagtctttgttgtgttattgtggaaatctccggcgtctctcctgatcttgccgccctgcacggccgttggagagtacttgcaggcagccccgctccacaccacttttatcatcttcattttcattcttttgtgaaaatgtagttgctttggagcctttcgaaaagtgtgtcagatcatttttgccatttctctttttccttttactttctgttattttccatttcgatctcagatacccttcttaggaagctgcatccccgacgccgggctggtctgttctgctctgggggcggcgtgtgctctcatttcactcccataatcagctttggcatatgggattcagagacgcagtgcttggtcttctgagatgttttgtgcagcagctaggtgatgtcccagttctcctggaatatttgcatcgaccaggatgctgtttctgcgtcggaacgtggtgtctttgtttacccttaggcattatcttgcttgtttacctaaatctttaactctccttaggtgagtgacttcactgatactaagagtgattaaaataatgtgatgtatggagtcaacttaggcaatacatttacctgtacaccacacgtccaatatttattcagaatgatttttttcaaatatttaataagaatgaataattgaatgtactatagccttcttactttgccctgcgatcccataagacctttaaagctaaaactagtttgggcccttgaggggtttatagaaattaggtatgtctgagtatggaaatggctggcatggtgaaagaattgagtccttaagtaatttgctattcccagtgataattagaagaaacccctgttctagctccattttcccattttttttaatgttttaggggagatttctttaggtattagcggctgatcttttttttcttaccatgtactcccgctgtaaggtgagtggttttggcatattgtgttgccttgatgggttattaaatcgtcacttggaaggatgaatgtgggttatagagtatgttgtgccatatatcatcttagtcatcaggaatgtttcagaaaactgaataagagtaaagttttttaaatttatgattgaaattagcaattttattaggtccttttaaaaaaacctacaaacttttaaagtttttctcaaaatatacatctttgttctcagaagaggtctgcagactgccctaatttgtcttttgaaaggacacagaattttagcagaatacttatgctgcagaaatggacaaatgcaggtgctgttccttggatggtcagcatggaaggttgacgtgctccaagatttactgtgcgtcaccttagccatcagtcccatcgtattcatttaactccactaataagaaacggagcaaaagtggaattatgagttcagtagtattctatgaaaggtcagttgttaaaaaggcagagtctgacattctgtgaaaaaggtgccttcattaatcattctgatgggagagcacggggcgttcttgaccaataccagtgaaccttgcaatgcaaagtttcagggtctgatgtgtaagttcttatataaaaacgaggatcgtttgaatatatgttgagatcattcaaggaattgctttacctttgctgtttaaaagtgtgtatatgatatagaacacgttattaaatgtgcattactgttttgaaaaaggaaaaacacctgttaattttatagataaattatggaaatctgtggtagacacagctccaggcagtaatgcatttccaagcgaatgaatggacatttcctatatggatcatctacagatattggtaaggtttctttaagtctcttttgtactctgcattcgtggctaaacctatgcactttgaccctgttctgcaaaacaaaccatggcctactttcagactctccttcgttcttttgctgttggttacggtggcagagtgcctactgtgtacacagaatctagacatttcacattgaattatctgagtatttatgtgccctgacaattcagcgttaaagttcaatacaaatatataaattattaagcagttaaccagtgacacattcatcagctgaacgtcttttattgtggcctgtagacagattattttcattcagccattaaagcacaatattgtcgggtgaaattctgtttctggattttctttgtctctgttgctgctatggaatttcattgaaagcatcgaaatatgagactaacacagaatactgagtgtttcttttcagaaacgggaactttcagacattttctctccagctgaattcagtaaagagcagtgtgtgtgtgtgtgtgtgtgtgtgtgtgtgtgtgtgtgtgttcctttcccagccagcagtgttatatctgaagggaagggtggggatgagctgtggtgccgcccttcacgccattgagacgggctgggaaggtgccctttcaccctctacctgcagttggtgcctagtgattttaaagattcaggaatgtctttcaccgtgattctcactattaaccaatctcacgtatctaactttccttactatattattagttactactttctatacaagagagaggtggagcctgcctgtgtcacgatggggaaggcccttgggattcgctctgtgggtgcgggcagcgacaggggtgggtcagggtgcaggcggtgagacggcgagcgaggaggtcgggaaggagcctccacaccccagcagggcccattccacacgagaccccagacgaggggagcagaagctgctggtgcctctctgttctttgccggatgctaccgttgtctgtggccacacttgcttcttcaggtgtggaaatagaagctcagagaagttaaacaatgcgccaaatgttacaccttcccattctaacgattttgtcaatttcggtgtcaaggtgatatcttgtctgatggtggaggtcatagttgtctgtgaggacatggtatccaccctcaagcatgtaattatgcatggagagggctcagttcagttttaccgagacacagtttattggagtctacaaatagcataaactgctatgtctgcagtgttaccattctctttccttattgtcataatttttgtttaatggctgtttgtgctacattgaccaggtccatgggttgcttaacataaatgattacatttgcttatgattaaaaacttcctccattagaagcactgcacccaggacttgtaaatgatttgttgttaaagttttctacttcattagccacgtcgttgactccagagtcattgtctaagagttaggaacacttgtaatgagctgtataatatggaccctcgaacgaaatttaaaaagagaccaagccttctaggaacagcttagcatgcagataaaaggctaggaaaatgtgtgaacagcgccaggctgtaggctgaggcacgttccattctgactcagaatggcatgggtgaataaagtcttttatgatggagcaagacttgttgtaaaaaattatataccattcatgaccaaaatccttcaaaacactccgtcaccattcccctctgaaccctatagcttaagttctaagcatcttgtgagtctcttgatagagcgttgaaaactccatgcaatggtctttgggacgccattcgaacctggcctgccccttgctggcaccttgttcgtctttggctccatccggggatttgattgtcagtgacccacctgattacagtgggctgccatggccctggcctcgtggtacaaaaacatggacgattttgtgatttattatcggaggacagctagcaaagagaacttcctggaataactgcattaaatgtgatgggcatttttgtgacagatgtaaaattcttaatcttgaaagcagttgcatgtgtcaggcagactgggtgttaattttctgacagcagtaggaggagctttttttccccattacagatggaattaggtctactttgtacacagtactttgtgacagtgactctggccaggggaggggatatgctggttctggagtctgagaagatggggctgagccagctgtgactcggccacacgtggctgtgggacttcgcactgactacgcagcctctgccaggtttctttgtaaaagtgaagttaacaccgatctcacaatatctggggaggaataaataggaacacacatgctgagttaaagtcctcagttatttcgtcttcagcgacagatgatccccgacttaccgtggttcagcgtttgagttttcgagctttatgatggtgcagaagcagcctacgtgcagtagaaactgtaccacaagtgcccgtgccaccattctgcgtctcagtacagtattgaataaaggacatgacacagtcaccactttattataaaataggctcgtgttcactgatgctgcccaactgtagctaattcaagtgttgtgagcacgtttaaggcaggctgggtggaaccatggcgtttggtgtattgaatgtgttttcagggtcgatgtttttaactttcactgaatgtatcaggatgtagccccatcataagtcgaggcacatctctgtttgagtgcctgttacgtgctggccatggtcccaggcctgcgggatgcagaggcgaggacagtgtttgagtttctagcgtgctcactgtgtgtgggtaggatgaccctgccggtctgtgccctggcttagtgaactagatctcgttggtgtcctgaggccgagtcttctgtggtttctctggagagtgtggctctccctggtcagtattgtgacctcagttaccactttctgtcccctacattcatatactcccattcatgtatttaacaattctttactgctgtaagataaatggttttcaattatgagttttgtcatgaaaatttaattttttaaaaaaaatcaaaagacctggatgtggtgtgagcatgcggagctcccctttctgcccaggcctttaccttcctgctaggaggcaaggtcagcccagggacagtgctgggagagagcggagttccgtcgttcatgggttgctaatttttggagtactgcaatacaattaaatatacttaaccttaaaattacccagaatgtgattgaatctgtgattcacaggccccttctggttctcccgtgcctcggtgtgatcattaggaggatggatcaacctggtgctatcgggaacgcactgcgttaatggcctcagtgcccagcaatggagaactttccactgagtatccgcatgcagcgtgcccggcggaaggtgaaagcttcaccctttgtctcccttgccatcctttggccttgtgtgtttggaagtagccagaggtggtggaacagtggtgggctggtttgggtcttgttggcagtgccaaagggacaaaggctggatgtgggcacgacctcagcctcgtgatgggcaagacaggtgggggtgactttctgttctgaaaatgacctcctccccttcttcctcccctcaagcttcctacctttcctccccctccccctcccttcttcttccactcccccacttcttcctcctctccccctccttcccccttccccctcctcttcccccttccccctcctcttccccttcctcctcctcttccccctctccttcctccccctccttcctccccctctccttcctcccccctctttcctccccctctttcctcttctccccttcctcctcctcctcttccttcctctcccctccccctcctcctccttctcttcctcctctaccccttgctccttctcttccccttcttcttcctctctctccccttcctgtctttccccttcctcctcccttcctcctcccctcctcctccccttcttcctccacttcctcattttcctcctccacttcctcatcttcctcttcttcctcctcattattttcctcctcctccccctcattttcctcctcctccccctcctcctcctcccctgcttcccctcctctgcttcctcaccctcctctccttcctccccctcctctccttcctcctcctcctctccttcctcctcttcctcctcctcctgcccttcttttcctctgtcttcctgttttcttccctttcccctgctgtattccttcctcacacgcccccctcagcctcttttctggggactggctcttctaggaggcctgcctcaaggccctcaggccagttcccggggcagccactgagcagaaccgcccctcccagcgcccacctatggccactgccctcagggtcccttcctccagcatggtgctggcggatggcgccataaacaggctgtcactcatctgcaggctgccttgtctttcccccagcagattaaagccttcatgaaaaaagatggagggcgcttgactttgcgacacgcacattctgccgtcttgggaagggggaaagaggggcatctagctgggcgctgcgtgtagcctgcccggcggggccggggtgtggcaggaccgaagcctgctcctcgtgtggggcccggcgcgaaaacagcttgtgcagccgctgagtgactgaggaccgtgtcccagtgtagtgtcatttcctcgtacatgtggagtttaaagaattataggtaccttgagctactggcaggtaaaagacagtaaaaaaaaaaaaaatagtgaaagacacagtctaccctctgaactgatctacaaggctatgaaagcatcactttgaataatatgcagtagatatgttagaaaaatgtaatattggtgtgtggacccctcagcctctttgacgagtgttgtaatatatcttgttgaatgatgaatatgctaccgtatgtttcaactattcctttcttgtggctgaaagaaaaatatattgaaaatgaatgtaaaatattgacatttagtagttgttatgctccactgtaatttcttgttgctttggatgtggtagacacctcactaattacacggtgtgtacatgcgcacctgtaacaggagccgcgtgaaagtctgattggaactctgacttgatcagcccatgttcttctgccatagccacaggagcatctgaacgtggtgatggaagaagaccctggcgccccgtctccccgtggattagcggccctactgtgagatcctggtgatcttgatgatcgagggttatttgaagcagttcattttgtgctgcagttcattgaaatgccaccacccagaagacccctgagtttccagaggtcctggtgctttttttgctggggcttggaccggagcgtctttagagtgaccactgccagggaagacaccgtggtcggggcctgtgattcctgccggggccccaggcaggctggagccacaggtctgagttctgtccagttcaggttcgtaggccactcttgcagctctgttccttcttcagctcctctggtcattcacacgtggcctggccacttgcctattgtaccagctctccagggctggggacttgctagagcagggttcccagtgcccccaggctctactttgctctgcctggtctcagggtgtaggggatggagagctggacttccagcctgcttcttggctgtctaggtgccaggggctcgggacacagagctcctggaggccgagcacaagccttgggcagaggtgaggcagagctctgactgtttcattcgactacgttgccaaggagatgctcgctcggagtggttgctctggctctgggattccaaaccaagctgccttctctgatgtggccttagtgctctgggcggatgtaccttggctctgcctggaccctctctctcttccaggcctctgtcccaccaggatgatgcctatccagagctcattgtcctctcccacttcctccccgagcttcccattccgtgtctctctggagggcccatcatcatcctggtggaggtgttgcactgaggaccacagcagccctcgcattcctacacatacccctttgcccgtgggatttttgctgtttctcttctcccactgttggtcgttggctggatctcgttgaaggcctgcggagattcaggtgccatagggagggtctgggacttttctctcggaggccccatgaagttggtattcctcagctctgccccagggtccctctgattccacggaggagctgcggaaagtccacatttttgaagagctgcaggctggggagcccccgtggcgaacagaggctctaagagaggggtctttgttttggggcagtgagactgagtggccagtgagcaatccgtcatcaatggagatcaatacccaggaggtgccatctctcttggcgggtgacacgtaacttttacaaatgggtgcctgtccctgtcacgtcaccggagtgtgcgtcttgatgccctggctccctgaggcacctcgtgttttcgagtgtttccattttagagacccggaaaagggatccttagagctgctttgttttcctttttcaccagaaacaaatgcctttgtgcttctcccgcctgcggactcccactgcgttcagcccgtgcgggtggtcatcggccagacccatccagcctgtggcccgtcccctccacctctcacagccacctaggaaagtagttctcagctctaaggggcattgtctgttccaagaagaatgactgctccctgccacctcccacccccatcccatgtccccatcatagacccagcaggacagacccccccagagagccagtggccttcttgcccataactcgttggtgctggagagctgtgggtagcgtagcaagtgccactgagcatcctggaaaccctgggaggggtcccggcgagaaagagccatcaccctaagaagattcaggaatgggatgatcatggggttcagggtgccccaacagtaggttgaaaatcctgtccctggccaggaggcagggaagtagcaaccttattcaaggggaaaaaaaacctcctggagtctagatacagtatcttagtagtaataaaagcacgggtacagatttactggtgtcggagttttaactgtaatactgtggaatggtaggttattttgtgttcaagagctacatttatcacaaaaatgatgatatacaaatcacttccatatcacaaaatgttcttggtcaaaattggcttgaggcaagtgatatcttcgagtaaacagtatatgaagaccatatcttaaaatgatagatcacctaattttgttctgacagaggtttttgccgcaacaaacatctgtcattgaaataccaattcagagatatggaagccaaattgtagaggttttcctggatttgtcactcctaacttaagaatgctactgttcccatcgtagcttttataagatattaggcagtgttgcactttaagagacattaaaacaaaataaacaattcagagaaatacgctttaaatgcaaaccaaccattaaaaagtatagaagtcaggaatgggccgagacagcctggctgtttttatgtgcagacatcacattaagctcgctttacttggagattttgaactgtagaggcctccaggcctcctgccttcacttgaggtttttggtgctttttaaaggactgtgataatgatgttattcccaagatgtgaaggaccattctggtgctgtcctgacaggggagcaggtttacagctcaggacactggggtgccacggggacctgggggtctccttgtgcctgggattcctcctcgtcaggagccctcactcaggaagccctgcacgggggcaaatgtcctgggattggagaggcaagcgtgaatcagacatttccaaagacgacaccgaagaacttctgctgtattccaagttaaaaactaattgatcttggtccaaactatcataggatagttaaaaaaaacacacaatagaatttctgaggtgcttgggagacattttagaaatatgtcattggtgaccactttttataggctgaattaagaggaaaaaaaggtaaaatatcttttaaagtctccagtttctgagacccctctggagatgatttcattgagttcctccctctgacagctcctatggacctggagggctctggtttctggagtagcatgggagctggccctggtcctggctctcctgcccacctctgcccccttttccctgccccctcctgactgcagccaccagtgcccgccatttcttcctgcgctgcaacagctctggccagtcctctccttattctgtaggttgaagtacattcctggaatccaggttttcaaagcattctatgcagtttcttgcatgaaatacaggagcagcctttcctgggctgcctcacacattgggcttctgtattcctttatgacagtgtgaggcaggcctggctaatgtcttccagcccattcatctccccacagggtatgagatgatgggctttagcgtcagacagctgggcccacactccggctcggccacttacgggctctggcaggttacctcagctgttgaactcgtgagctgtgacttcctcctctgctaatgcggcactctcatgcctgcctcgcaggttcagatgtgacgatagacataaaacacctggcccggctccggcgcacagatgctgaagtcagttttctgaggtcgtggtgggggcgggggtgagggtggcaatggaaatagtgacaacagtagttggcgttgtcatcctgtttacggctagcctgcgagtggctcaggcgaatccagcacagccttgtcctcgggttagctgccctctcagagcttcacatcataactagttcatttatcatccacgctagagactggtcttccagaggatattcctacctcagagccccttcctcccgacgtgctgggacggcccctgctgttgcctggctttgcctggtattacaagggacctcaacctcctgtgctcttacccgggcctgacttgggtgatgcccagaatcccagtcatgaggggaccatgactgtgggccagttgctgacaaccttggtgggttgtagactcatgaaagaaacactcctttgcctcctgaccttgtgcatcagggaggatgcaggaggaacggaagattgagcccggggagtgctgtctcggcagtgccacttcagacaagtgagtgtccctttgtgggacgtgttctcaacaggcacaggtgaccttataggtattgggatgatgggggtgtgcctgcaggttgtgaattactttttgccttcagagccaccaacacattcacacaaacatttgttttccttttgattttatcaggagaattttgtttctttgcccgcctgaacattgcttgccctccataattgagtgtagactaactctgcagcctaagccaaagtacatcttttgtctgtgcgaagagaaagttccatttccctttaccaagttatctccatggcccttggccacagcaccctccgcagaccctcacgtgcatggccgcagcagactgcccacacatttgcacactgacattggtcttattctcatcaactaataattaaaccagaatccaagtaagtgcaagaatcaaaggctttgagtaggaacaaaaggctatgttactttgtatccttaactaagaattttgttgttcaagaaatcctgggcttttgttggtgtagctctgcaagtcagcagcacccgggttccacccggtgcttacaggtcacgagtccagtgacgctgattgaggtgtgtcaccaaatatgctgcagatccggggccagcccacctgggcctccggccacggtctgtgcccacgtgtcacgaggcacatcccgggtcatccggagagggacctacaaagtctattttcaaaccaagttattttgtgaaatattgtagtgaacttatcaaaactggtgaagttgatgaagtgaaatgaaaatactgccatgaaaattattttagtgcaacataatgagttctgtttttcatatctggcagatattacctactaaatctaatctgcaatgctgagaattatgccattttttatgatttgtttaattttgactgaaaaaaattgactattcatcgattcttgacctgcgagtattgagggaaaaatttagttaataagaattttcatgaggtgtaaatttaaatgtatgaggattctgcctatcctttaatactatagacattaatttaaaaattctataagggcctgagggcctggggtgtctgaagaacagaacatggaggcagttatggttgttaactggtagacaaggtctgtcaagataatataggaatattttggtgttttccctatatccttggttatatgtggctgagcataattagaagttaaatttgttttagataatctcttcggctgtgaaatggcatcaatacacttaagagtaacaagtcgaatagaaatcagggcctgttgttagtgtatgagcacacaccacacaaagtttcttcttggttccctatttccgcagttcaaagggggttttaaagaagtcataaaaaatgaaggatcctaatattgcagttggagactgagagtgaatgacatattctttacacacctcaactgtcaacatttctaatcaaatcacccagccttcttacttcttaaatgatacaggcgatatttcctgtaataaacacccctaagtctaatgagaggccctaaggcaacttgaaatatatgaattcattataattgaacaacataatctgcagggcaaagatgcctgctacccagctctgaacttcacagagcttgggtgttttatgaaaaatgttatacgttttgtttacaacgtatggctgctgtttgaagtattgtatgttcctgtagtacataagacggggccgcataatggaggaaaaatcaaggaggcaatctttcattttgttctggtatgaaaaattcaaaagactgaaaactcacccagagaaattttgcaagcatattattttccaatgtttcgatcaatttgtctgtcaaccatgctgagaggtggaaggggccagcaaaagcaatttagcttgtgaggtccaaaatagaaatgttttagggaaccttgtcacatgttatttctttatattagaaccgccgtgtgttttatttgctggtcataatatgaagagaaattgatatcaatcatctaagtaagctatgaatatctgatataaatatgacttttatatgcatgcatcagaatacaatataaattaacctcttcatgcatgcaagaatcgttagtgcgacagcgggctccctgttttggatttttccatttgacaattcacggtgcattttaattgattgtacccaagtgacactccgtggaagcatcttgcatgtgaacgtaactgaccctgccagggctttaattaagctataatcttcctttagtcagtgcatctgggattgataaacatatgtaaaccatgctgaccatctaagtgttgctttaaagaaaaaaatggtgcagatatgggagttttaaataaacggctttgatgttacctccagttgaatttttagttgggatttgttaagatcaagttatcttaggagtagttaattctaaggtgaatatacaatcttggtgaaacttgtcctggaaaacctgtaattctgtgattagtctgtgtgtaccccaacactttttcttcaaatcttagattaacactgaatacattaaggttatttttcaaacaggttatagttcagagaaattaatttaaatcagttggcttacagaagacccagtttagttttaatttgccttaacagccagggtcttcctgctctacttacttagacgtcctcagagtgtcttctgagtagttggctaccatttgcatggcatgattccgctctcggagcttgatatctttccagattttcagaatttagaattaagtgtggaagtcaagcatactgaaagttttttatactatggatgctgataaatagaaataaactatgacaaattaattcagaaatctttccactcagtgtagatattaagttgtggtcatacggaagaagtcttgaaacacgatttacagtaaattatgataatttgggatagagactgtgccattaagagttgttaaacagcatgattcagacagctctgttttttccagtgactgcctattcctttattgtatatgtgtacccaagtgatgctctcacatttatcttaagtccctattattaatatacatttaaagtctcccgaggttttgtttggtttgctttggtccttttttggagtgatttgaagcaaagttaattgtggaacctatttatagacatctttctatacttgcacaagtctgtgtataatcaattctgagaagtagaatttaaaatttagtgctttgaaaattgtcctcattttaattttttggattttaattaggtaaggttgaacatttttccttattttcattgatcgtttggggttccttggtaaaatgcttgcttttgtttcctgttgggttattttgtctttttcttattgatatgtgagaactttttgcatattaaagaaagaccatcatttctattttgattttgcccagggaatttttttcagaataagaaattcaactagatttttaaaaaacttttaattgggcaataatttcagatttacagaaaagtcacaaagattgtacagatccttcacccaggatctcccaatgttaacagcttacataaccatagtacatggtttgtcaaaactaggagattaacattggtccattgtggtcagatttttaagtcccttcctatggcttctaaatttatgaggtgcttacacaaaggcctttttaaccttaagattttttttttgttttgcttttgttaatcatatatgtttatttccttctactttttaaatgttgtttttcatattttcatctctatttatttatttgaaatgtgttttaatttaaagagtcttggttggaacctatctttattttcatctaaatgctaactaaccaactttttcagtatcttttgaattactcgactttgtgtttacacacattttacaaggacaacaaaaaagtgcctgctgattgactttgtagtcaatcataacccttgaccatattttttttggtggtacttcatatatgaaagagtataaaatctaggttatttaatgttgttataaaattattctaagatcaccgaatggagaatacttagattctaaataagtgactttgtgagaattgaatttttatatcattaaccaattctaagacattttaaagaaggcagaatgatctaacccaatacttcatatacttagttttactgtggaatcccaagggcaacatgtcccccgacccaacgacaaaataacatatattcctattaagtttagggattgatggagcttgtaattgttaatttgtcacagatgatactgttatttatgcgcagttactgtctccctttggagagtttcatgtgctaaattttcagcaaatagtttgagcctcacctacagcttcttgaccttttggggaaaaaactatcactttaaaagaccttttacgagtgagcaaatatatgcttttctgttttcacagtaactttcagagaaacccactggtctcagcatggcctatgccttggcagccctttccacccgtagcaggttgttctttacctttcgtttttaaggtggcttccagttcataccaagctcacatactgtggcgaagagctttctgagaaacttcataagattttgctaagatattaatgaataatttagtatattgttgcatatatgactgagtatcacatttcagtaatgtttttactatctttaaatataggtacataaatcctagcttggggtaaaaggcattgacattttctcagtaatagttctttgtagacagacctgggttcaatattagctctgccacccctcgagctgtgtcaccagaagtaggttgtcctgtacgtctaacttcagtttgtctattaaaggggattgcaccactgacggcttgatcagggttaaatactccagcattccttggaaaacacttctgtgagcattgtcgcagacttgatgatgtagcaactattttccctaagtttcccactttagaaattattaaaaatattgctgccttcatagctttttcaaaggttttctcttatttctgtcagatctcttacatctaatattctcattcccagcagataattaatctattaagaggcaggctgtgggcccctctgataccagggaaagtgaaaggcaccagggcaggagttctgattctagcaactgcctggccgctgtgtgatctccacacagcatcaaaccttgcagagttctaacagaagtgaatagaagattagtctcccacacaacaataatgggagactttaacaccccaccgttaacattagacagatcaacaagacagaaagttaacaaggatacccaggaattgaactcagctctgcaccaagcggacctaatagacatctacagaactctccaccccaaatcaacagaatatacttttttttcagcaccacaccacacctattccaaaattgaccacatagttggaagtaaagcactcctcagcaaatgtaaaagaacagaaattgtaacaaactgtctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaagcaagaaataactaagatcagagcagaactgaaggaaatagagacacaaaaaacccttcaaaaaatcaatgaatccaggagctgattttttgaaaagatcaacaaaattgatagactgctagcaagactaataaagaagaaaagagagaagaatcaaatagacgcaataaaaaatgacaaaggggatatcaccaccgatcccacagaaatacaaactaccatcagagaatactataaacacctctatgcaaataaactagaaaatctagaagaaatggataaattcctcgacacatacactctcccaagactaaaccaggaagaagttgaatctctgaatagaccaataataggctctgaaattgaggcaataattaatagcttaccaaccaaaaaaagtccaggaccatatggattcgcagccgaattctaccagaggtataaggaagagctggtaccattccttctgaaactattccaatcaatagacaaagagggaatcctccctaactcattttatgaggccagcatcatcctgataccaaagcctggtagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaatcaataaatgtaatccagcatgtaaacagaaccaaagacaaaaaccacatgattatctcaatagatgcagaaaagacctttgacaaaattcaacaacccttcatgctaaaaactctcaataagttaggtattgatgggacgtatctcaaaataataagtgctatctatgacaaacccacagccaatatcatactgaatggacaaaaactggaagcattccctttgaaaactggcacaagacagggatgccctctttcaccactcctattcaacatagtgttggaagttctggccagggcaatcaggcaggagaagggaataaagggcattcatttaggaaaagaggaagtcaaattgtccctgtttgcagatgacgtgattgtatatctagaaaaccccatcgtctcatcccaaaatctccttaagctgataagcaacttcagcaaagtctcaggatacaaaatcaatgtgcaaaaatcacaagcattcttatacaccaataacaggcaaacaagagccaaatcatgagtgaactcccattcacagttgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaagctactttaaagttcgtatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagaccaatggaacagaacagagccctcagaaataatgccacatatctacaactatctgatcattgataaacctgacaaaaagaagaaatggggaaaggattccttatttaataaatggtgctgggaaaactggctagccatatgtagaaagctgaaactggatcccttccttacaccttatacaaaaattaattcaagatggattaaagacttaaatgttagacctaaaaccataaaaagcctagaagaaaacctaggcaataccattcaggacataggcatgggcaaggacttcataaccaaaacaccaaaagcaatggcaacaaaagccaaaattgacaaatgggatctaattaaactaaagagcttctgcacagcaaaagaaaccaccatcagagtgaacaggcaacctacagaataggagaaaattttctcaacctactcctctggcaaagggctaatatccagaatctacaatgaattcaaagaaatttacaagaaaaaaacaaccccatcaaaaagtgggcaaaggatatgaacagacacttctcaaaagaagacatttatgcagccaaaaaacacatgaaaaaatgctcaccatcactggccatcagagaaatgcaactcaaaaccacaatgagatgccatctcacaccagttagaatggcaatcattaaaaagtcaggaaacaacaggtgctggagaggatgtggagaaataggaacactttaatactgttggtgggactgtaaagtagttcaaccattgtggaaatcagtgtggcaattcctcaaggatctagaactagaaataccatttgacccagccatcctattactgagtatatacccaaaggattataaatcatgctgctataaagatacatgtacacgtatgtttattgcagcactattcacaatagcaaaaactcggaaccaacccaaatgtccaacaatgatagactggattaagaaaatgtggcacatatacaccatggaatactatgcagccataaaaaatgatgagttcatgtcatttgtagggacatggatgaagctggaaaccatcattctcagcaaactattgcaaggacaaaaaaccaaacaccgcatgttctcactcataggtgggaattgaacaatgagaacacatggacacaggaaggggaacatcacacactggggactgttgtggggtgggaggagggggaggggtagcattaggagatatacctaatgctaaatgacaagttaatgggtgcagcacaccaacatggcacatgtatatgtatgtaagaaacctgcacgttgtgcacatgtaccctaaaacttaaagtataataataagaaagaaacaagatgagcttgtggactgtctttcacatcctgggaacttatagaaaggtagttaggattattaagcaactaaaacattttcctttatttttccttccttaccgctacctctcccaagttgtaataatttaatagttacaactattagtacaaatagttttaaaagtctctttgagttgccaccctggagtgtgtatctcctaatgggataatacttaaggcattttataaactttaaagtgccatggacatcagtcatttgtgcatttgtgagcactgcctcatttaagcctgccgtcgccttaatgtactgtgtacattagatacgacttcagttcccttatcccaggagggctgaaacttactgggatttctgttatattgacctaacagattaggatgattttaaaattttactcattttctatattgaattaaaacaagaaattagctgagcattttccaagatggaaggaaaaacggccattgttttgatttctagttatgtaacccattccaaaaattcaaacatgagattacacggagtgctgtattaaacagatgagtacctgctcactggcttcctttcacacagtcgcctggcactgcagccacacctgtgctcacctgtacctgcctacctgtggctgggccaggccccaggagtcccgtgggtcaggagcatggcatggagggtgggcagagctttctgctcatccccggatcatggcagcgtcagatggaactcggcctgccccgtttctgtgcagctgtcaggatgtatggggttttcccatgctccgtgcctccatgcctgcggcactttggaaggacgttaaggcaggacatctttaggagaatgtctttattgactttgtctttatttaccttgggcctggcgctgttatctcagctgagtgtccgtgtttaaaggcgacacatggaacgagcatggctcataattttgagtttcttcttctggagccttactattatatgctcagaaaccatctctgtctgcgtggtatctctcctctggcagtgcagtaggtcacacatcgttgaggttatgagctttggagactcttagacatcagctctcatgttaactctgtgattttgggaaagttgacctatatgtttttgttttctttagtgtgaaacaggaatgccttctgcatagcgaggctgtcagaaaagcccttgacactttctggtcccagagagggcaccgcagccacccaggcctgcccgtgagaggtggcagctctgggaggaacactccttaggccggtgtgtggtactgtcaggtgcttatttttgtttcacaaacttggtatttattaggtgttccaggctttgttcgacccgggtgggagggaggatctttgttggaggactctcactttctaattgcgggtttttgttctgaagccatagggtgtgttgccgtctcagcagggaggagtattccccattaacgggcaggtggcatcgtgggagaagcacctgctgtgcccgggggggcgggactgcgcaggatcagggggatgcgcgggagccagtggtgctgacactgcataccatgtgtcaggagccttggaagtcggcttaaatggtttaatctgatttaatcttcacaaaaaccttgagggataggcattacgattaggcaccacagtagaaactgaggcatggagaggtgcaacagtttccctgaggtcacacagctcttcagagggggagacaggacttaaacacgaggaggctggctccagggcccgtgggctttgagcgaggaaggccttctaggtctagacgttcctaggctggggctcagtgataccctaaagcccatgcacacctcctcagacctggctcctgagaggcagtcctccagagtggcctctttgctgagactgtgagcctgggcttctgtctctaaccactagctacaaaaggatgctggacagacatcctgtacctagggacaccccatgatggcttgtcccccgaccacagacaccccatgattggggataccccgtgaccatggatgccccataaccacagacaccccacaactgggcagctcaaggcagcaagtgccttccttgtgtgcttccgttttgttgaggtctttgttgcaaacatcgtttgttgagggctgccttacccttagaagacatagtaccatttctgggaaccatggttgctgttgagaaatgcgtccttacacgcccagatccagccgctgtctggtcccactgacatggcacaggaatcaaagcaggtgcttgggggatgtcaacagttgaatttggattcctcataaagcaatgttagcacatgacactctgtgaggaaataatgatgctactttgtaagataagaaaggggaaacagctgcgttggtggataattgttaacggtgcagctgcagtgtgagttgcacactggaaggtgtttgccgtgacctgtcgcgggctgagctttttggtagcctggcattgtggtggatgcctttcattccatccgctgtggctgagttctgctttcctgcccctggttctgcagtggcgtgactgggctgcttacaggccctgtctttccaagccaccatttaattggggagggctactgacatggcaccattgaacttgagacctgccattcctccggtggcagtccttggagaacagggccccaggtctttctgaccccacatcattggcatggtctcgcagccaagtaggttatgttttctgaggaaatcatcatgtcattcccatctactgttaatttttaaaaagctgtgattcctgatgaaacaaactagagatgatgcaggaactctggatctaaatggtcagtcactatcttctgcaacttgctggagtgcagacacgtctcagaataagatattctcagactagtcagaacattgtttcctttctttaaaaaacaaaacagaaaaccactgagcccagagttcaaggcctcctaaagaggaagagggctttggctacctgcagataagaaaggttttggtggtaatgctcaagtgtgagttaggtgtgggcgtgagcatgcccagtggccgtcccgtcctcctggagacaaaaccatttccggggtatcccctggctaagcatttgaaagcagcaatttattttcaacagtttctatccttaatatttaaaaaataggaaagtgtactcaatcagctttctgttgactttctgctgcctggccggcgtcttgtaggaggcgctctgcctgtctgtgcaggaggctgtccagggtgtgcgagccacgtgggccagcctctgtgggcggactgtcccaggtgggtggtggtgagggggtgaattcctccttcacatttgcttacaagtgctccttttttgagtgttgggagcacatctgtgtatgaaggacatcattcggacgctttccagggtggtgggaagcagcctcccttagcccggctacgtctcatgaatgtgcgtggaccccgcctggccttctgcccgacatgtactccaccccgccttctaccaggagccaaggctgtgaccattgtgatctgaacaagccgttgagagtgtgctctgttgtcagtgaattagttcagagagtccctcctcgtgttatagttctcatgaccactgcgcagtgttgctgtgctctgcctctgacgggtggctgccaggcattgaaaaaataacatcgtaagtccttactgctaacactgacttttaaaaacatttaattgtgtgccttttaaacttttgttctccgtacaacgtcttcccgatatttagattttaacttttaaaagacagttacaaattatttctaaagtataaagtctggttgttgtttttttttttgatggagctgtgaggaggaaaaaaatgagatatagaattttagtgtaggtgatcttgtgctttaggataaaaccatttttctgttactgctttttggtatctaaatccccggcagtttcccccttcggataaagcatcatgtaggttttagcacaccagcgggttcctggctctttagtgaaaaggtggctctgaggattgccctgtgcccgccatgaccatcctggtggcttggcgacttcatattgactgcaggccctgtggacagaaagaattatttcttttttagagaaaagatatttatgaccgaaaacagtgctaaaaacatgagaatattgatcatggttttgagagatgcttgcactgaatcacttgatatacctaaatatcggctttattctatcttccctaaaagacagattgccaacacaaaagatgaaccatcttgagggaaaaaaatcttatatctttctgataggctgtcttgcttccttccataacaatggggagaaaagaagtctgtgtggtttcctgaaataagcaacaaatataataaatggtgtatcggaagcttctgtaaaactgccttgggtgtactttatttaacttgtagtaataagttaaattaacatcaaatggaaattcaaatagctaaacatttaaccaatctaacagtaaacaattattctaaaatcaacataaaaataaagacccattatcatcagaagacctaattcattgtttttagaggtaatctcttggggttctgtggaaatttataaaggaatgagtgaggctaattatttactcatcagatttttgaaggcaaatacttttctgttattcttaaattttagacctattttggatcaagatggtgtgttgcttttgtagtttaaggtagaagatagtgaggctgacttccttccttatcccgggtagaaagcctgactttttctggatagattgcagcctaggggttgtggttttggtcctgttctgcccttttcccaaattcttcttcattgcatctgatacatcccccttgcctgcagggcagggccctgtttctgtggcacacatagcaggaccgtttacatttcctctgctcacaggtgccgcccacaccttgcttcctatttcatgtcctcctcgtctctgtagttgagggaagagtattccattcaacagatggaaacaccattgcatctgactgccatgtctttgaaacctgccagaccaagtcttgactttcgttttgttttttttggtggagctgggaggagacagatgggccatacagtctatgtgtgggtgccttggtgtgggacacaagaaagtgaggcaggacgtggagcaccaggtcatcagagctggcagaggctgctccaccgtgcaccgaagacttggcatgtcagtggagccaggaagtctccgatgcagaagcggaagtcagtgtggccacaggagcgaggtggcaaagtgctggccttggaggaagagagaggtcagagagtagacagagggtgaggcctggatcatcatcagatgagcagacatgaaagccgctctcaacaggattagaaaacacagtttctaggggattcttgcagggaaacagacatggaggggcaccatttggtttgtaaaaggaaggtatagccctgaagttggcaagctcttggcctgctggcctgatgcagcaggcagctgagaattgcttggcctgtccatgggggcctgacaggtatctcaaattttaattgccagcacacacgaatcaggagatttcatatttcaaaaagcatgtatggctgctgtttcttttttgtataaggcttaatttgttttttttttcatgttatagctttcctgagatacattttacatactctaaaatttacccatttaaattgtacagcatgctgggttttcatgcatttatacagttgtgtgtccatcatcacagtgtaattttagaagatttaaatctccctcttccccactgcccctgccaaaaaagggaccccagacctaccagcagtcatttcccatccccctccctctggtaccagcccaccactagtctgtctgtgtctgtggttttccctgttctggatgttttgcatcaacggaatcctgcaccatgtggccttttgtgcctggttcctttcccttcgtgtggtgttttcaaggttgctccacgctccagcatgtgtcagaacttaattccctgcggccaaacaatatcccatcatgtggatgaaccacattttgttgatctatacatcagttaagtcagtttcgccttttggtgttgtgaataaggctgcagtgaacatttgtgtatatatgtgttcatttctcttggggtatatatacacacacacacacgtaggcctaggagtaggattcctgggtccgatggcaattgcatgtttagcattttgaaaaacttatggttttctaatacagctgccccattttacattcctgccagcaatgtatgagggctccaatttcttcatatactcaccaacactttccatgttgtctttttgattttagccatcctaaagggcgagaaagatatcttcttgtgtaaaacgggcaaataatcaagctgggaatggtaagcagggtttttattcacaatagggctggttgatgggattcacaattacagaaggccacagagggaggacacacttggtgtactatttctttttgtcaaacaatagcattattgagatgtaaatgacatacagagtatacatacagtagttcccccttagtcatggggaatatgttacaagaacaccagcagatgctggaaaccgtagaaggcaccaaacccttggtatccctgaggggttggctccaggactcctctcggatactaacatccgcaggtgctcaagcctcttatataaaatggcatactattcttatatagcccagagacaccctcccatattttttaaatcatctctagattacttatgatacctaatgcctagatatcacttcattcttgtgaattcaacgtagtccttaacatatagcaaattcaagttttgcctttttgaactttgtagaatttttttccgaatatttttgatctgtggttggttgagtccgtgagtccgtggctgtggagcccatgcatatggagggccggctgtgcagtatcttttcctacacatacatccccataataaagtttactttgtaaactagcccagtgagattaacagcagcagtctatggaaccattataacaacatgccagcatcactattcttgcacttcagggccattattaagtgaaatgtgggtgacttgaacacaagcactgcaatgaccttgatagtctatctgatagataccaagatagatggctactaagcgacagaagggcgggggtgtgtacagtggggatgcaccggacagagggatgattcgtgtctcaggtgggatggggcgagatttcatcccactactcagaatggtgtgcaatttagaacgtatggattatttatgtctggaattttccagttaatatttttggaccacggttgatctcaagtaattgaaaccatggaaagtaaaactgtggataaagggggccactgtatctcacatatacagtttgataaaatttgcctatggatgaccccaatcaaaataacaaatattctcatcacccccaaagtttcctcttgcacctctgtgattcctctcctcacctcaacccgctttcctttctcatccccaggcaatcactgatctgctgtcactgtgcattagtttgattttctagaattttgtgatgcacatatatacatatatattgtattttacacaaaattttctcgttttatgaatggaattataacgtatagtctcttcgtgtctgagttcttccagtgtattgagtttgatattcatgcatgttgttgcatgtgtcagcggttgattactctttttgctgagtggtattccattgtgtggggataccacagtttatcattcgtttgttattgtacattgaatattgttctttctgctttcggctgttgcagacactgctatgaatatttatatgaaagacttggtaaggacgtatgcttctaattctcttaggtaaacacctaggagtggatcctatgggcaatgggtgtttagcattttaaaaagttgccaaactgttttccagagtggctgcatccctctgccgtttttatgaacagtgggtgggaatgcaattcttgcatatagtctctgatttcatatcattttccttttgcctggaagacttagcatttcttctgtggggtctgatggtgatactgtcttttagtgtttttaatgtctgaaaaagtattttcatatttaaaagatatttttgctgtgcaaagaattttgagttttctcttttccttttcttaaagatcttgttccactgtctctgacttgcattgtttcggaccagaaatctgctgtcatccttattttccttcatgtatgtggagcattttcccccctccaggggtttttgagttatgttctttatcgctggctttgaccatctggctcattttttgggttggtgtgcttgtcttcatgtgtctagtgcttgggcttcattgagtttcttggtgccatcaattacatctatatttgtctgttttaagttatcccacagttctctaatattgtgatttttttgttttttttgcagtgttttattttggtagtttctattatgtttttgagttcactaatcttttcttctgcaatgcctaatatgctttgaatgtcatctagtatgtttttcttctcaggcatggtgattttaatccataaaaatttgtgtcatttttatatcttaatttttctttttctttttttttgagatggagtcttgttctgtcaccaggctggagggcagtggtgtgatcttggctcactgcaacctcctcctcctgggttcaagtgattccctgtctcagcctcccaagtagctgagactacaggcacaacccaccatgcccagctaatttttatatttttatcatgatccacccgcctcggcttcccaaagtgctgggattacaggtgtgagccaccgtacccgacctatatttttctactcacctttttgacatgtgaaatacagttataacgactattttaatatccttgtctgttaattctaacatctttgtcagttttgggttggttttgatttttttctcctcctagcagttgtatttttattcttttatgcttttcttgtaatttttgaatggatgctttatatgcaaatgttacctggctgggtgctaggttatttatttaataaatatcctttagctttgttctgggaggcaggtaagttacgtggaaatagtttgaatcttttggatcatgctttgaagattcactagttgcaactacagtggtatttagtttcaggctaattattcccacaaccaaggcaggattgtaagaggagagatcatggccggggactcatggctagacaaaaaacaggacctcagtcctatcagtgcaaggaaatgaattctgtcaatacatagtgagcttgaaagagactcgcagcctcagccctgggagtctcagttgcagctgacattttggtttcacccggagaaacccttagcagaggactgagtccacccgtgcctggactcctgacccatggggcggatgagacagtagatgtgtggtggttaaaccactgaatctgtggtaatttgtggtgatttgttatgcagcagtaagaggtaataccgtatgcatcttcttgcatcatttaccagctttttattatatgtggaagtcttacgtctttcctcccttttttattgccctctgagtaccttgttgtccctttctgtgtcacattcttcccactcgcacgcatgcatccaggaataagagcactgtggctcggtgtggccaagacccactgtgtaccttccatgaaagatgtttgtgagtagcatgggcccccgaaccctgggtccagtcctgcctgtactgcgagccagcactgtcatcatggatagtgccctcagcccatactctcctctgtgaagtgtgtgtgccagcacactgacatcacagggtgcctgcagcatttggaaaacacgcagcatcatgcaaactgcctaggagtgctcaacaatttggagctggtatctttacacttaccacgttgaatattgcatgcagactacatatttgcagagcttaatgaacagagaggcattttaggacaactaggagaaactcgcgcagattcccctcagggggagggaagctgttttgtaggtgtctctggcagtagcctaatgcagttgctttagaccctggtggtctggatactgcttcactgtaggctttaattgcattgctccaggtctgtggaaggctggaagaggccggtgtttttgtgtcacttttgctaccccctactctctctagttgacaggccatttggagcaccagggagtacaatctggctgaagaagcggtatccaaggaggacgtcatggtgtctgttctcgcagtcatggagcctagtgccaacaggccttaattctgtgttctggtgtctcatgagtggctctgcagtgggacgtcagagcagccaggcctcaagccgcctggctggggtggggacaaagtgtgtgttgtcccttcatcacgggagtgtggggcctggcacacgccctgccagggcctcacttgggccatgcctcagagcatgggtgctactcacctctgacctcttgagttttgcaggcaaactcaggtcgaatttggattctcagtcgcattgtggctcacatgacatgaaataaaatgttgacatttatttgcttcttgtggcctctactaaatatataaaataatcaaaactgaaactttccattattctcagcaggagtgaaacatcttgactttggaaatttttcctagtgatttaactcaagtcggatatcggcagcaccacctgcaatagtgaccccctatggcctgcggcggggctgcttaacgctcacatgggtggtcaccaaggaagggctgctggacaggcagactcccagagcagttgctacttacaaatccagcttccagcagggagaccattaaagggctgcttccacctccagggcgggcagtgaagcctccagctgggagccgcgtgaaaatcagagccaatgggagctggcagcccatccaccaggagggtccagaagacagaggcagaggacgtgggatctggagcccaagggaggggtcccaggtgggttgaggctggagatggcccaggaagccctggtttggggtgagggtgggcgagactgagaggctgctcagacaggatgggtggttgaatggagtgcggatcatgagatcatcacagggccacagcatatcaggccatgggttccctgttaattcctctcccacctcgaggaccggagcttctgttaggcaggcgggggctctgccgcaggcccacattctctgctaattcccttctctcctaaaggtttcagatctgtctgtggtcttttgttttacttggaaacacatgtttaatatatcttataaaatacgtttaatataaaaatatagttcactttatagttcagttgctttgagcacatttagtaaaccaagatgtgcttatatgaacttttccctgaaaagtacctggatcccagagttctacatggattgaatacttatgtttcgattttaattccttagatggctaactcagcattatttaaattttaataaagagactggatacaatgtgagcgaatttctctctatattttgtgaatctctatcagagcaaaataaaactgtttctgttttgcaatgaatagtttctagccatggaattgctggtcgaggcaagaaagtatgaatcttatttttgtggatctagccaagaaaaagaacgtaaactttgaaaagtatgtcatttgccattcacagtctaatgagaaactcagagaggctagaaactctcaataaaaattctgatatcagcatttaagatccagcaagatagggtatacgggcatttaagggattcacaatccacagtttactggcactttaaatgctgtgaatcttgtactggcaatcacaatcttgattttattaccgagggggacccctcgtgaggaatatgtcggtgcagtgtgcaggttaaactgtgagctgctccagcctctctcccgccggctgacggaaaggtggtcaaattaccttcgcaaatctgaagggtgcttggctccagcaaattggccatttagtcaaaaagtgtctgaaaatgacgtagtcgttggaagtgtttgggaataagcgatgagttggccaaacgcagtgtgttttctgtaggcaagcacctgtggcagctggcagggatgggcaggcctgcagagatggcttcctgggggcgcagcgtggtcaggcttgagggtggtgacagtgcccccaggagaaggcgagactggccagaactgggacgggcatgatgagtggccgtgtttcaaatattgtccatttttaacttttgaaaatgccaaaagcaagtatgctgccttgtggaatctgtgcaagcagttctttccaggctgaccttgaatagcctgacagcagagcgaggagtgaaatgagcacgcctcaggctgtggtccactcgtgcgggaagacatggacctgctactgctccctgccctctgtctccccaggaaaggagcattctggctcagagattctcaaactgggtcttccaagaccgcacaggtgctgtgtcaggtcagagatgcctctgtaacaacgccaagacctcgcgtgtccaagagtgatgctgggggaggctgctctagctggacctagatccaggccaggccccagacctctgcagctgtccacctactcctcaccaccacgcgtttgcaggtggtggacggtgttttatttaagaatgtccttgttggccggacgcggtggctcacgcctgtaatcccagcactttgggaggccgaggtgggtggatcacaaggtcaggagttcgagaccagcctggccaacatagtgaaaccctatctcttctaaaaatacaaaaaattagccaggcatggtggtaggcacctgtaatctcagctacttgggaggctgaggcaggagaatggcttgaacccgggaggcagagatcacagtgagccgagatggcgccactgcactccagcctgggtgacagagcgagactccgtctcaaaaaataaataaataaataaaaaagaatgtccttgttgaagcaataaacgctaattgtactacaaactgaccctggagcacctctctttttagtagacacggggatgaagtgaagtgtgcgtaaagcacttctgccatggaccaaagcagggatgttttccggaggaagggtttgcgtgtgactcagggtgacgggagtggccacttttttcctggaataccattttcaccattgaaagtatcactgaccagccaaccatatttacccacacttgggtttttggcagaaattttcaaggaaaatagctgacagtatttgttgctagtactgaatgatgaaatctgagtttcaagtgaaaatcataattttgagaaacttgcacctactgccgtgagcttaacagcatttcaatgtttaaacaacgttttgctgataccagtgtggcattaactagtgtgaatttcggtagtgtgctgtggctgaaatgcctaacgtagatttgcatacctcagtgaaccagtattttctaaatgatggataatgttataaaattatgcctgggtaaaaatccaaaatgcaggctaggtgaatggattttaatggaaccgtgcagacagttgattcggaaggcttcagggtccacatggaaactgtggtttgggagctgccccttgttgagagttctgttcaggtatcaaaggagagtatccacagtggcccaaggtagattttcttcctgcacgtcagccagagccctgtatggaaacagactgaaggcagaagcagctgcgagagtccacctgccttctgttaagccagctgtggaagacagtctcaaaaatgtaaaccagtgcaactttaattaatcctttttttttttggaaaaatggttatttttcatgaaaatgttatatgtgataacatgaaatcagttcataactattttgaaatgaaatatttttaaatgttctcagctttcatttcaaacacagtatcaatagaaataacttgcatgaggaaaaaaatagctctttagagtcctcatgatgcttaagggtgagactgaaaagtcagacacccaccgccccagacaaacaccatggtggcctcggggatgctgcgaggtcagagaacctgcactctgcttccttcttgtgtagggtgagggagaagccccaagccgtttcttctcagggctcaggtgtctctcatcagtgtagggagggtcttcgggcatcctatgccctgctcattccctcgatgttatccggacaggagatttcagctcctgcgcagtgggcgctgttgggattcccaggcctccaagtcatgacggtgggtgaaatggagctggtatttgagaaggctcggaagcctccccttagaaaggtgggtcctgatcagcagtttgggatgcccctgtgtttcctgcatttgggatgggcggtcctccctcctgcctccccagctctcttgagcacagtgtggccggcatctggtcaggacttcagagtggccagccccgtgttgccgacgaatctgagagggagcccctggcttcttatttttctttgaactacgtcaacggaattgcttcggatccttagccattttaaaaaacacagtcatatcacgtccccttctgacattctcttaagctttagcaaataacagaaatttcagtctcactgtgccttgttcagaggtgacaacaacaatgggtggctgaggcgtaagtctcaatcatccaggctccttaaagcagctttcgggcatgtgtggggaaagtacgccacagacacccagggctgtgcttccaaagaggttttcaagaggttgagtattgacacctttccttacaaggtagtggggaggcctggaggccaggcagtgaggcgaacagtgctcagtgaatccacgctccaggtgaggggaggcaaatgtcggcagagaaggtgggagcagaggaggagttccttatgcagaggtctctgggcaggcagaggaaatgagcctcgactttgctctgccctgggaagggaagcttgtgatccacattatatcagtgtggggttttatgagctggactgagatggttgatctaaagtcacagttggcaagtccctgtttatgcgaggccggcaaagaattcacctctgagtgatctgtgggggcagccctgtgttggtgcctgaggcctctgcctttctgtggaggtctggctgatgcatgaggctagaaacagccattcatttggaagagggcgttgcaatgactcagcctctgggcttaagctttccttttgcataagaagtctgaggggtcctcagatgttttatcttcctttacaaagttgtgttgtcaacaccaaggaaacagtcttgattctgaacaaggaggtagcctgggtactgaaggtgaaaagagctcagatcagaagtttcttggaaagagatttaaagatttttaaaaaatcagattactaaggcatattaaaatatgttcagtcttacactgtgttctttgaaaccttgaattactctagcaaaaggctcagagggtactgctatgagaagctggatcttggacatctctttcaaatgcctcggtacctttcaaagggctttggatggaatgaagggacaccattgggtctcacagctttctcctgcctaacataccacagcagtgtatgaaattgttcccatcagctccagcgcgtgaaagacaatacgaacagtaacacccccaaagaaacagtggggctggagacagcagaatccttggagggttctctggctgaagaaatctctctcctaccacagatactgtccccagagaaggtgcacctctaccaccaatgccctccatcctcagttgacaaggattcaaaaagtttgttggtgacgctgacatgtaatattcccctgcgagttacacacatccaggtgaccttcggaccagcattgccggcacacccgtcacgccatcaacctgccaggctggagaagaccgctcagagcttttccttgactggggagaggggagccggagcagcgccccacgtctcacggttcacccctgccgtctctcggggccttccttcaggctttccctgtatcctcagatcttcgccagggtcctgtgatccagtgttagttcattccatgtgtcatatatgaatgatgtcatttgaatcatttcaagtccttttgtaggaaaactaaggcagaaaggccagcaccacaaagaggcatccagaattctcctcggcacaggagggtgcagccatggtgcctttgaggagacggacacgcttagttccccctgccatcagtgggcatctcgatgttaaccagatcttagaaattgctctgctcaggttggactcataagtgtactcttagatgcattcttccatgtttttggaatttcctagagaaaacgtcttctttgttcatgcccgtgacacacgttcctccctgtggtgacctggcgtccatcctgagctttcgtggtgtccacccatgaaaacaaaggtgtctgatcccccgtgccacagacatactcttaaccagaatctcccaacctggggtccgtggtggtcttcgggggggtctgacactacccagggtcagatgaaaagtgttgactggatgcgtttatgtgggcgctgcgatactcttcttggggcggggcccagagggttcctgaaattctcaaaagtgtctgtgtccctccttgtgagtaggagtcactgtttcagatgctcagctttccaggtgatttttcaaatccctggcacaggctttcaaggtgacttaagattgtctaatcctcctgcaggtagaaatgagagtcatctggctgatggtcacgagccgtcggggagttcctcctgtcttgcactcaagcagaggagtaaggagacccctttagaatgtacttctaattgttgaaaagcacctaacaagttttctatgggggagattatacagggactgggtagggacaatcacgtaagacatacctgtttatagaaagagctggatatagaattataggtgggttcagctgcacaaagaagagtcagactacggaggcttgaaggagctgtgaatacactgggcatctgacatcattgcttacttccccctgccccgccctgcccctccctgccccagggtatcggtagcatgtgtcctaattaaattttgacattatgtgagttttagcatggtattttctgcattgggctatctgtataatgtcatggagtggtgacataaataatgctagacttttccaatttatctaccatcccagccccctccccaactcagtcatatgtggaaagtcagtttctttttccatttattatagttgttaactaaagattaaaattttacatttcattgcactgttcataaattgtttataaatacagtgaaatctaagcaaaccaagatgatcttggaaagaagtgttctgtatggaatttatctgttcagacccaacatgcacacccttccttcgggatgtatcaccaagatgaaggcgggcagatctcatgggcatgagcttgtgtgcaccgaggaagttcctgcaagcagtcctgctgcacctgggcgggggacaccctgtggagaaccacggtgcttgagtggaaggagtctgtgtctgtttttcagaatgccttcttgccttcacaactaatatgcaacaaaaataataggattgcacctgcttttgatgcctcaagatatgcagaaatacatttccctcacttgagcatgtctctggatatactaggacagctaggtcgtgcttgcgtttcaggccacggccctgctcaggagtcaggttcagcttcttgcattgagtcttatccgccacagcccaactttaacagtggatgatagccaggaaagagagggaagcatttttggagctggttgtggttttaatgaggcatatacagacactgctttagtggatgtaggagtgaggggggtggggtgtagtggttgaggaaggggcttagtgggctggggtgaaggtctctgctggagatctaggagttttccctaaatcctcatctgatcttcctctcctgtagattgttaggataaatgagcaagaagattctgcgcaacaaactgataccttgctttcttttgtgagcagcagagctggggcgtggagagggtacgtccagtgttggatgtcaggaagttcacgtcccagggtatctagtacatctgagctctaagcctgcaaaggaaccttctttacaaattgcaccattgttatggttggcattctggttaaaagttcatctggatctcaacctcgcgtgaaattgcagagctacgactggaaaactcggcatcagttgagaacctttggggacttctcagacattacagttagaattgagcaaaacatgctgagttccattcactcacattttggtgagtgggttaaaataacagtttagtttcgtcatttttattacctacttttcagacagatccagaaaaataaaaaaacaaaaaaaaagacaagcatcattaccatgtttaggaaatctttgagaagaaatatgtatgaaatttggcatactggctagccattcccttacccccttatttttgattatccaaaagctcaaggtgactttgctcttcccctctgtgactggggttagcaaacaacagccatgggctagatcttgtccaccagctgtttttgcatgatcaggacgctgagtgtggttttttcattttttaaagggttgtaggaaataaagagactattgagtagagacctcacaggccttggaaagtgtgacatacttcctatctccttctctacagaagtggctgctgactcctgctctttggggtcgaaacacaaagactgaataatgatgtggtatttttgtatttaaaaaatggcatagggcatttttagggaggttgtggcattgacgtattctgtgttgcttcagagagatgtcgttcggtgggtagaggctgcgcagtggcccactgtgattggcatggtggtggctctcggcccctgggcctgctctgcagtcaggtccaccatgtggaagtgctctgagactcggtgcacgtattcaatgtttagtgtgtgccagccacgttctaggcaccgtggatgcggccagcaaggaagatgaggaccctgttctcatgcccagcctcagggtgggtgcatggagcatccctggtcgagtgtgtgctcaggattcctttagtatgtcatgaatctgtcgtgtttctcagagcagacttaggagccaggctccctgagattgaaccctgcgtgggccacttctttgctgtggaaccgtgggcaagtctcttgttctttctggcggcttccatctgtataaggggatgatagtgccaatctcttagcgtaggtgacagattccgaagtaaagggcttgtcaagtaggcctggggtgggcctggcacatcctgggtgctgcctgagggtcagatgtcatcttggtggcccacactcccctgcagtggtgctgctggttcaggaagttaaagtggaaaactgtgctccggaataaacacaattgggagaacccaaaaccacacgcaagaaagcaaaatgtgctgcccgattactaagcatggagttaaactctatttggtgtttttgttctgaattgttagggagtaagaatatttatggttggaatccttggccaatcctaaattttcttctaactagtagataattaagtgtctgcttctagaggatgtagatgtgcttgtcttgtatattacaaagtagagacgacttgcccacaccccctcctgggctcacactccatgcggatggcgtcagtagcttctgagcctcttcaggtgctgaacacatgccctgagctgcttgttttgacagggacatcatttttaaagagtcctttattaccccagtttactcacctcttgttgtctccagcccttcccttttttatgttcttctctcccttttcccttagcaattgctaataccctagttggtactgataaaagaaaaacttaagctgaattgaatttaaaggagtttaattgagcaacgaacaattcgcaaatcgagcagcctcccaaagccagagtaggctcagatggacagaaaaaggaaagtgacagagacgaggcacagaaacagccagattggttacagcgtttgccttatttgaacatggtttgaacagtcagctatattggattggccaaaactcagtgattggcacaagagtaggctacggtctgtttatacctccacttgttatagttcatgaggtacagaaaaaccttgaggccacattcaaaacatggaaggaggcagctttaggctaagcttgattcaacaggttgctctcgtcactaggaagtagtcatgtacaaatgcaaatgtgcttgaagtttcaacctagtttttagaatgtgggatcctgatgggtattcctctcatcttgctgcttcttgtcttgcgcatttatcatcccttcgaggcagtggtttcagatcttaatcctttttcctagtcacctaatattctaagatgtggctatacaaagcatttccaaccattgtccttcccccctcaaaaattatggtaataagcgtccttcccaccccacagataatactgcagtcagtgcagacatatgcttgtacatgctttcacacacgattcactgaggccggcaagtctgtgggagggagttctataactgaatgtttacacggggtgtgcatatctttctctttgaataggttgtttctatactgtttgtcatgaaaactcagaccattcccattttaccatcctttcttcaccagggagatagagtgacagagcgacttaattgttgcccatctgatgcagatcaagtgtcatattaactgtgcatatccctgcaacgtttgcacactaatgtacattggtctttctagatgcctgttgttacctataggtaagtaggtaggtaggtaggtaggtaggtaggtagatgtctgctagcaatttgacgggtcatttctttttgaaggataatgaacaaatttgaaacctgtggcacagcctgggacctaagtctgtgtggtgcagggagtctaacttctgtctaagtcagtagtatctccagggatacagccttacatccactgctggctgcggcttctctgagcgacccatctctgcgtccgcccatccatggctgccatctcgcacaaaattattttcctgggatggtcccttgagttagttcgtggttaggggtagctctcaccttagtccctacaaacccacctgaatttcctttgtctccgagccacatgggaaggagactgtggaaaataaaccaagagattctctagtaggtagagctagaggcaacaggttaaaatcacatctttataggagaatgtttggggaatgcattcagcagtcacccattctcattaatagacccagcaaacaattaaaaaatacacattgtgatttggactgggcagacatgccgactgtggagccatttcttaagagagggaggttggcaggtagctggtgagcctatttctttgctcattgagctagcaagagcaacacccattactttcattggattacttgtttgaaaattaaattaatcaagtgaggtaaacatccgtattgcctcttagcacccccataggctgcccgcaaaatggcctgcgtgggtatcctaagagcaggaattggctatgacctgccgaggtggccaactcagatgtggccagttttccatacaagtatgaagttcctgaattaatgggaaacctggctgcattgtctgatggcttactggcaagcagtaattagaaaacatttttcatagtggaacctcaggtttagctatccagagaaattggatatttcaaaatactcctagttggttagtgaaacattagtattaatgacaaattaatattaatatcaatatcagagttgagtatgtagcctttgggaagagaagggaaagattttaaggaccagatttaagtagcctccatatgcctttccttcttggtggcatttttcatctgaaagcattttttttttttttagctcaaaaacttagatgtgaaaaattcaacgcattgggaagaggcgtcaacatttgaaccgcaaatgattaaacctttatgactaaagtaataggtttggcttcagtcttcccagtggagtagcaagcagaggtccttttcagtttgcaaacagtagtatacaaacttggtccatatcaaatactgtttctcttccagggcttgtgtgtgcactgggaacagcaacaaaagttgaacagcaactgggtggggtttctttatgtcttctgtttaatcagagtttcctgatggtttggccacttcattctcctttggcttaaggggttctaagccatggggcagaccttgggtggctcactgctcttggaaggagggtgtccagccttcctggcagtgtggagatgagtaagggaaacactgcaggggcttctggcttcctggatcctgcccctcacctggggactttgtctaagtcctcatcctagcaccacctcgagatcgattcaggcctccccagcagtggcagaaatccaaccatgggagctagtgggttccattactgtggagtagggaagaagacatatgtcccttctaagtcactttaatttggtccaaaataaataaccaaagtccttggggagaccgtcagggaagtatcttcccacatcacacttggtctttgcaagaagtgctggtgggcgtgcagggcttcttgacacttcgcagcaacgtaaggatgtggtagtagagtgcttggtgttccagtggccactgcaatacaaatagagtgagttttgtcgccgtggtacattacagccatggaaattccccgtagttcattggtccgtgaccaacaaaaatccccctagactaacaattaatcaggctctgctgagcctttgactggcgacagttgcagatgtcacatcatgcgaaaagttaaatctcagctttccccaagaaggaaaaaaagtttatttttacagtttatggaactagttttccttttgatcaaatgacctggtctttaggggagaaatattttcatttttatgttagcaagtgtgatacagaatcatatacatttaaaatcttcatttttattgctttttttttaaagtacaaaattttaatagtaatagtgatttcaagaaaatgttgtgagtgtcactttactagtcaggcatgttgaaaaggaacgcgcttcctgaaatctccaagcgaggttggcatttgagacctctgggtacgtgagcttaaaattaatataagtacctgagcctagagcccaggaggtttagaaagactcagagatgcgcttaaagataattggtgtgctcctcttgtgagagcggattcaccaaaatgaagttaaaatttgtttgggaagttgcttgtactgtgccttgtgaacttacaaatctgtgtcacaatccaaagggttgagagccacacaaagcaaaacagatgggccgtgtgtcgtaggatttcctgctgtcctttcggcttcaggtaactaggacttgtgaagcacaagatacatgggaggcaaatctgaaaaggaatggtgagtgcgccccacgtgcctgggtaatacctgagtgctcccggcattacctgggggctgccaccctccctccccctccttcctttccagctcaacattgaggtgaactttttaccatgatcgatgtagctttctggtgtctacacagatttctggatggcctcagaaatgtcacatactgcttcgggaatgtctgcaagtatatttcatacattttacctggcaattaaaaaaaagtcatctttaagatattagcatgtggataccgaggttccacacaaagcaaacaaagaggtcattcttagcagctaattttaaatcttcaggcaactatacgaacctatgtcacagtctctcccaaaatttattataatgcccttgttataaatttagaatatttttgcaaactcatataaacaagtaattgatgcgactaaaattcttgtcacatatttattgcactatcagctaaaatttttaagtgacaagaaccaaaataatcgttaatttttatagggcaaggatctggctttttgtctgacacaaagctgtataaaaaactgcttctgattttatgcacattgtttttagttaatgattttcagctgtttgttgtttctctgatagcatgaaaatgtaccatatgctcagcccaaagacagatgattagcaagtgagattccgggcagctgtctgactgagcgcgttgggttgatagcattctgctatcataattagcttaagctttgggttaattaactttctacctggatatgcataataatagcaaactgcaaaaagcaagaagctttcagtacatcaacaacattgctgtcttttttatttggtatttcaagagcatattagaatttcaagagtgattaatcctgggaatattgtcatctactgtagattttatttgcaagccagataatactgaaacaattggaatctattatagagcagaaatagcattttaaaattgtaattaaagtttctaaaagcaattgctaatttcaaatgcctttgttggcaagaatattaggcacactgcttcttgtatgggcagcttgtcgggcacaaaaaataccagcacttacactgtgaagaataaaactttcttttatttaagggctgtattgaaaataatcagttatttttatgtaatttgaaagtaagattactctgtagtttgcagaggtgctgttcagactcctagattgaagatattaaccctgtgccctcttgcaggttctcacctttgttacctcctgagcagtggagggctggaggcctgggtaggagtgcctggtgccctcttagaagatttgatgtgtgcgtgtgtctgcgggtgccagaggtcagatttttcaaaagtcagtgctatacatttgtagcttgatatttgttttctaccccaagcagtttctaaatcaatttactgatggtatgaaatggggagagggagggctttgtctccatcctcctccttgtttgcatgatttaccaaagcactctctacgacgctcatcatctgaaggggctgccggggcctttggagagcacaagctagtgaagtggatggtggatttggagtaaaaattgtagtttacatttcccaaagcaccagagagcctagcacttaattctgaaataagtcatgcctgttgttacactcagaaaaatattttatcttctgaaaaaaaaattctttacatatgcagtggatggtgaagatttggtggcggtgaatttgccctggctccagaggactttacttacagaatcagcagtcgtgaaaacgtgctttctcagatgtgtgacttgtggtcagtctgtgggctcaggagcacccatttggtcaatccatgcaagttttatggggctgtcagaagccatttttcaaaattggcttcatctgaggacacgtggaggagccactctcttggtgtgggtagtgaaaggagtggctccctgtggctctgtcttgggagttgggggctgcagtggttcactgggaggagggggtgcccctgcaggccccacctgcaccccacctcgccgccccaccccctccccccggctttcaggctgtgacctcaaggccttttatcattttcacaatgatgtctccaacagacctttaccccagtctcaaaaaagatactgccagagcctgcctttgctttttgtttagtctgcttcgggctgcgtcaataaagatagcagaggggtcaagagaaaagaagtgaacggaatcacagttttggtgttgaacccttaaatgggggccccactgtctctgctgtgtagcaggcacaggattatctgtctgccttctgagatttcttttaatgttttaccaaattaaacatgaacaatttcaggatgcaaaaacttgactgcatcttgttgtttcttaaataagagcactttaagaaggcaatatatggagattcttttgtgggaaagatgtttcaaatgggttattactggccattgaaagaaagaaaaagaggaaatgcatcgaggcctcattttttggcctgcacatttgattattttattttaaatgccatttcaaacatagtgtaaactaatgatattattttttaaaaaacttactctactatttgcggtccttgatctttaatttcttttaatgtcaaaattatttatttggccagttccattccagatgtgactgttgagggcacattaatttctattctgttttcatgggcccctgtccccatctgtacatcatttctgacttccgtgtgctccctagggagttcacttattcatattgtaggtttcatttgctgtgtaaacagaataaacagacaatgcaaaaatccccacaataccagaaaataattcttttcaacaacatagtggatcatatttaaaaaaaaacatggaaaatgcaatacatgtgaagcccattttttccactttattgtcctcccgaggaaaggcttgtgttaccagtgcatttcccttgaatttgataagttcatttttattaaaaatccatcccaaacagcattttacgataattctcaaacacgtgttgtggacatttctttgttttgcgtattagcttggtcttgcgggttaattcggaatgtgttactcaactggtatgtgcttgcgtggccaaaaacacccgttgtgctgtgtgtgtgtgaaaagcaacattcaagaacggtgattttttttttttgacatttacaaataaagagggacatgagttatttatgctccaatgttgctgcaaagtccttatctccatttggcactaaacaaggatttgttgtgggatttgtgagggctgcgcagtgcctctgtgctaagcacccaaaactctaggggactggcactaatttcctctctctcgtaaaacaacgtagtattcataacaactcaagaggcttgacataagtaatgatggcatgtgcaggcgaagattaccacccaacagtgtaatcaaggtgctaggtactaatgcaagttaaattgagacaataatgccgaaacttgcattgtgggattaggagggcacttgaaatgctgacgtgagcacatcctgcctgcctgcctgtctggcgctccgttcctgtttatacttaatgacctcaaaatttgtatgtcgttaacaccgtgtactgaagtgggagagaacacggtttgggagggagaagactccctgtcttcgttgacttttgtctcttttggtaattggtggcttttcctgccgtattagggagcaaagcgtgcagcggggaggcccctgaggtctctgtaaacatgctgtgggcaccgagggcctccgcacccggcgctaggcagtaatttacatactttgaatgaaaagtcatttgtgcctgcaaaattgttattgctggaagaaatttaaatactagtcatatggaaatttgaaataaagtcatattaaattttgatgctcagatcaatattgtggagccccggtaattaaagtgggtttgtttatttggctccttataaataaaaagggcttaatacagactaattacacagaatctttcgtctacggtaggataataatggcagcaatttaaagtgatattaaatgagaattaataaaggaatattgagtcactttgactgtattaagctgtgaaatgattcctcatctcaatttaactttctgtcttgagcataatgtttgataagcaatgaatttttgtaggaataatctataacagtatttgactgcaatatttaataacaactagacttgtgactttatgttgtttttaaatgggctgggaaagcccgttttttctctgcaaatttataggacaacttagagggttcttgccctatggtagcttcacaagagttctgagttggcaccctccggtttgggaggtaggtagagatggctttgacttttgttcaacttacaagggagtaacttcttggaagtgcagtccgggccagcagaaatggtcatagtaggccatggtggaaggagaatcagaaccacgcgtaaatcctcagaaggaagagggcagtcatttttttttttttctcttggaggaatatcccgggaagaattacctggaagaaatcagagtggttttggaagatggattgtcggataacattttaacttaagggctgaagttcctttctacctaagtaccattgaagaagtatgttcctgatcttaaacatttttaatagcagtctaggccaattgactctgtgaccattaagtaattttcaagtggactggctgctgccagggtgtttgtgttttgctttgttttgtttgcagagtaacttgtgtgtaatttctttccactgtgccgcacagcatgtcatgtccacgttagcatttctgcccttttaaagggtcctgctgaaggtcaggacctcacactgaacaccctttttatatatattacaaattgctggaattgttcattaatttctgtctttgaaatgccatgtcaaccctctaaaggaattcgcagtgccagtttcccttggacagctgctcaccatggtccagtgcgaatttctgatgaaattacaggtgcagggaaatgcagaattagaaatatatctgatgttgcaatacttgtgaagctatagctttgttgatgacaggacaattccatttttgacagtttaatttactgttgccagtggacaagagcaagaggaggacgtggggttagccacctgccccctcgtaccgtgtttcacatgcgaggttgcaaaatcatgactccctcaacctgtcgggctcaaatgagaaggttttcagctgggaaaatggaatatatcagtgcatgtaatattgcctgacctcataaaacaaaagggaaaattgcagattctgacagccattatgaatcttgtatcagcatccaaaacgacttggagccagggtatagtacatgtttataatagaaaaaaaacggggttgccacgttgacttgcaatatggagcaaaaaatgacttgtcataattcgttctcagatgttaaagaggctattgaatttactagtatatacacagaagaatgcgtagcccggagcagagtgtggaaatagtccctacacagaggggtctgctgaagttagtcatcgagttagattagaatggaaggcaggaggggaggaactccgggtttgcgccgcagctgcgtcggtggggccagatttctcattacaagatgtactgaacctttccactttcacccactgtaaatctataagtaatcaggcttctaaaataaagcaaacaaccttgttttgagattatgagaatcatttgaattgaatgtattctgttggaaaactggtgtattgaggcatggctttttatcttacgcttaaaaagttttatttatattaaaataaggcataatctctctgcgtataattatacgctcttcgatttagtttttctatttaatagtctattccttcaccttcttgcccatttctttatgttattccttaaaaaataatttctaagtacaataattgtctcagctgcttttggtgatttctttgggaggggagatgtggagtgacagtccaggaactttctgcccaggggcaggaggcccagcgcgtgctccccagctgaggccccgtccgccttggccactccctttcatctcccgggctgaatgcggagtgtggtgacttttattttttcctttgctattggtttagaatgagatgtagcagttgatttaagtgaagtaaagcatgcttacgcagtacactgtgtccctgtcggggcctgctctctcatgtcacctgccggcggtggcatggagacaaagccttctctcctctcttactgctgctgggcctctcctgggcaggtccgggctcagtggcttgaacaggtgatgcagggaggggcagtgcctgtggccacagtgatggcacaggtggacatgatcctgagagtccagtgggggctgtagcacaggaaaggaggttgtctacagcctttctcaccacacctttccctcctcagtggaatctctggccccatctggagtccctggaggctggatggtagaactggaatcgttggcccgatctggagcccctggaggctgggtggtagaagtggagtctctggccccatccggatgatggaggtggaatctctggccccatccggatgatagaggtggaatctctggccccatctggagcccctggaggctggatggtagaagtgaaatctctggccccatctggagtccctggaggctggatggtggaggtttgctggggtaaccctaggcggtaggtgttgccacccaaggtgaagaggaactcacagcagcgctggcttagcagctctgtggggcataacccacttctttgcaaactctggtgctgggagatgatgaaatgagcacctggtacattaggtttgggacttaaagctgatacttccattcgggagcaggatgagtaagacctggtgcttctttgctcagagctctctgaggtgggaggctggaagcgcttccctgaacactgtaggaagtgttgcaggagagcggaagagcaggaggaggaatggtgcagaggaggaggagcagtgcggagatttcacctggggggacaccaccacgggaggcaggcggcaatggtggaggcgttggctgagcagggcctttagaaaaaggcccgggagcttggcagcagaaaggagggtggaagtgcagaagcatcgagatgcccagtgacgtctgtgcagtttggattttgctgttgaaaagcaaaggagatgaatagaaagctttaggcagacactgagagtttttgctttggaggtattttgatatatggtaaactattgtttggattattttggagtatgctttggtctattattaaatatcccagtcaaagatagcagatattcaatatttgagttaggatttttcaaatacttagaatatttgaaaatatttttatcattagaatttattgattttttgagacactatcatattctaacaattgcaccttattctttggcggtatcactgtcattgtattaatggcaaaggcttcaaaatagcctgtcaggcccatgtcatctgcaagtcaaccctcaaccctttctctctaaactcctctcctccagtttgccaaaccactgtgctccagccatgctgccctccttgctgttctggaacttgccaagtatgccccaccccagggccttggcatgtgcctggaacacttgagcccccaccctgcacatggctggccccttgttttcttcagctctccgtccatatgcaatagcgattcctcatgcccctcatagcacttctggactttttccttgctctattttttaccaactaaaacaggggttggccaaccatggctctcaggctggccacctgttttgcaaatacaattttattggaacacacttataaagacttgatttcttatggctgttttccctatgatggcagagttgaatagttgcaataaagtctgacctgcaaatctaaaatgtgtgtaatatctggctcattaggcaaaagtttgcaaagccctcatctaggatatagtgcattcatttgcctctgtccctgactggaatgcaccctcccttaagacagagcctatctctgtttggcccactgctgtatccctagagcctacaacagtgtctagcacaaagtatgttctcgtgagatacttgaatgaataaatgaacaaaagtgaaagttccagccaacaggatgatgggcagtagttaactatgcctctaattctggcttaaactttggtatttcagcctttatgtatgttctattttgcagtttttatggtgcacaggatgaaagaacacatcaactcctagggagtagaggaggcctggaaatagactcagaagcagaattgtgtgcaggtggctgttggggagtgtattcattcattctcacactgctattagcatctgagactgggtaatttatgaaagaaagaggtttaattaactcagagttatctgggctggacagacttctgcttctggagaggcctcaggaaacttacaatcatggccgaaagcaaagggggaagcaaacacatcctcatggatggagcaggaagaagagagagagtgaagggggaggtgccacacactttcaaacaaccagatctcttgagaactcactcactatcatgagaatagcaagggggaaatctgcccctgtgatccagtcacctcctaccaggacccttctccaagactgaagatcacaagtcaacatgcagtttgggtgtggacacagagccaaaccatatcagggagtattcccaggatacactctgtaaggaagtgcatactgcaggatcgggcaagggagaagcaggggcttgcattatgacctagttgcagttgaggtctcatcctgtcctgcagggaactctggagagagaatgacctgtagagtcatcccaaattgaggccgggggcctaagtcttggctcccgggtgcgctctgggggggccataaccttggatgagatgctcctccctcgagagcagcggtgaagtatgcacctgcctctgagctcctagagctggggtgtgatgcactggtcctgaaacaaggcctgggcaagtacccagaatttcagttgtcaatggaaagagtcaaactctgtaaaatacttatagggatttattctgagccaaatatgagtgaccatggccagtgacacagccctcaggagatcctgagaacatgtgcctaaggtggtcggggtgcagcttggttttatacatttagggagacatgagacatcaatcaaatacattaagaaatacattggtttggtccagaaaggcgggacaccttgaagtccaggggacttccagcttataggtagatttaaaaatctcctggttgataattggttgagtttctctaaagacctgagatcaatagaaaggaatgtctgggttaagataaaggattgtggagatgcaagttcttatttgtggaggaagccttcaggtagcaggcttcagagagaataacttgtaaaatgtttcttatcagacttcaagtctgtgtggatgttagtgccggagaggtatagcgaagcatatccaacccccacttcccgtcatgcctgaaacagtctctcaggttacattttgaaagagccctggctgcggaggaagtccatttgatggttggggttagaattttatatttggtttacaaagtcttgaattaaaatattttatcattacctagttttatacccgggaatgttagttgttgcacgtgaggacatgaagtgagttaatgcagggcttgggccgtccagtgtcttctttccccacagccttgctggcagtgaccccatataaataggaacaattaccggaagaaactgtgctcctcctaaagcctagctagtgacttccacctttgaaccataggcgaggcagcacttaaccagggcactgtttgataggatgttacaggtggttccagagaaaaacgaaacatgtcatcttgttaagggaggtcttcgtttcggcatctctgtaaaatatttaaagaggtatttttatttctttaaacaggctctgcctcttccgtccccctcgcccaatgtggactctgcccgtccttcctgagcagtgagactctgtccccatgtgcttctggtcacagctgcggtgacatcctgtaacattgtttggtccttgcttaaatcagttactcaccatgttatagccgagttcagacccactacacagacctcctaaggtgctggcctgtctaaaacattatttccattattcattcctgttcactctgggatagggaagccatgctccaagctgtattggaatatcaggtccagggtaattagccagggcctaaagggtctgttttggaaaattcaagtacaagtagaatcttctttagtatcttggatccaccagggaagagatggtctctgaggcctgctatgcagaataaaaccaagagagtcactgtgaaggaatccaagagatgcaagtgctctttgctgtccagtgattaaaatgaaagcaaagacgggaagcgtccttgatccacattttgcctgtgatttgaatatcacatgcttggtccgggcacttaggtgggcttcagtgatttgggccggaaggaaatggtgcccctttcctcgagtttctagattgttttgtcacagacaggggaagccctcatctgacttgccctgtaggaccctagtctgtcgggaggtctctgtccccacccctccctggagtctggggtgtagttgggctgaccctcaaaatatgctgtgtcatcaaaggttcatcatctatctggtctgttttttaacgcaacttgataaaataccagtgttttaataaaaaggtctaaaacatttaccatttaaatgagcctcccttcctgggatgcacacaggagtcttggcgggaggctggtggcgcaggctgatgggtcctgtccctctgtgccttgggcgcctctgcccagcgtcacgcagtgtcatgagacccctcagtgcaagcgcaggtctgcctgaggtcccccctcccacctgcaacctggatgccttttgtgcctatggaacacaactgaaagggccggtcagtgccatggcttggctaattcatggtggacatgcattttggtttttaaaattatggtaaaatatacataaaatttcccaccttcaccatttttaagagtccagctcagcagctgtcagtgcattcacaccgtcgtgcagccatcaccaccacccatcctcagagcccctcatcttcccacagggaaactccatccccattgagcacagactcccccttccccagccctggcacccacccttctactgtctctatgagtctgactacatcacataagtggtacagccattgtcttttgtgactggcttatttcatggagtatcatgtcctcaaggtccatccgtgttgtagcacgtgtcaaaaggtccttccttcctcaggctggatatgggctctttaaaagcctattttcttagagcaaaacccgtttcccccacacctgatcgtcacatgccgtctaagacacgtggtctagggtttgctagtgatcgtctgtgggctttccgagcctgcgctggttttgctgccacaacctgaggtccgcggacgtccctgtgctcgctatgacttctttgtgtgagactgtcagagtgtgttcctggccctgacacgtgctcggcggctggtttttctccttcagatcagcggccttggacagctttcgcttctttggcagccgtttcaagctgctccgtcttgtcattttagagttcaatatctgctgctctgaaggaagaaacggggatgggctggaccattgcacttggtctcttgacctcgatgttgcccatgagcagtgaaggatgacttttgacgagccatgtcagatgtgacaggcaatctagttggcttgagtggaaatgtgctgtacaagtttgaagccttggttgggggcatttttctggtgttcaatgcatttaaattgacaccagacttcagtatgttgttcatttcaggcccagcactgtaggctcccatctttaaaatgtgtgggtgccgagcgctccctcgtcagcttttgcaaagcattttgcatattcccagtactgtatttacattcctggctcacattggtttttgttttttgtttttcctatcttaaagcttatttttgaagtgaatttttaatgctttcagttgagtagggatttgtggaattttgaggggtggggaggtgcagtggagaaaagggggaaaatggttgtttcttggctctcagcataagctacattttccatcatatggagtgagatgcctatattgggcagctgtgattttaagtgaaagtcatttccagttgtttctaatgtctagaaattaggtttgttttgattttaattgtcaaaggaagggactgtgggtgaggaagagcccttgccgccgcctcccctgacgtgcccctgcttgggcagacgcctccctggtgaggtgtgggctgcgctggacagcacccaggaccacggcctcgttcttttccttctcactgtgttttcctcttgggtaggggtgagggtggttattttactcagatctctgagccttaaagtggatcttctgcagatcatctccagagtcatctgacggcgccgggcagaagtctgtatgttgggagctgtccccagctcctctccttaggacttctgaatctgcttcaaccaagcatattcctgcctcatccggaacattcctcaccctctgccccagtgcaggcggtgtccacatctcagggatgcagcgtggtggaatttttaaggttttggttggcgtggatgagagcatctctgctgaggctgccgtgcgggtgtgggctgggtgcatctgtgtctctgggcaccatataccaagtggcactcatccctgtgagaacatggcctgggcattagaggataggatccttagtgtgagggaggcctcaaccataaagggactgaggggagagacaggaagggtccaggtataagaagagctgcccacggcagggggtgtggcagtgggaccaggatgaatgggtctcagtaatgtggctccttccccaagctggggagcaagggaggcttctgctgttgggtgttgaagaggaatctttggtttgcagatgggggtggggtgggtctttgcccatcctctgatcgtatgtgtagaagtttgcaacatgaagggcagactgtggtggagttctttggcagttaggaaagcaagccagggcacagacgtgttctctgaaaggcagggtgtgggcaccacagggtcagccctgcaaacaagagcactgagcagagggagcggcgattggattggagaacggaggctcccacctggctcacatactcctacatacatgccacacgcatgccacggtgcttaggaatcttgaaagctgcaggctcaggggagctgcgatgctcatcgtgaagatgcagagccggagaggccgcccaggcaggaaggccagtgctggtcgcctccaggtggtctcaggatcccagagcaggaggcagccatgtggtgctgaaggggaagcgagggcatagaagctgtgccctggagctggaatggtagacagggctttcttagtgccagggcctgcaaattcccaacaagggctcactggaatcctcctcccgccatcctcccaggccccccattggccggccaggcccctggattacctctctggtgccctgtcctcctccatgctctcctctaagggccctcactggcacctttgccctccttaaccaggtaacactaaaccaggagacatctagaatcctgtttgagacatcttcgagagtcaccttgttaactagacagaagtggatctctacaggttagagcctggggaacctctgttttctttgtgatattctctagtgagtgttccaggaaagaacatgccccactgtctcctttctacttgcagatagcggtgaggtgggagaggggcctgggagtgtgctcttcattctccacctcctcccccgaggaggtggtcatggtcactcgcttgacgagcccagactctgagcttctgcccctttattgagcaaattcataaagtcaaccatgctcttttattatgtaacttgttttttagattcaggggtacatgtgcatgtttgttgtataggtaacttgcctatcacaggggttttgtgtgtggattatttcttcatccacatgataagcacatgataagcatagtacccaataggtaggtcttcaatcctcaccctcctcccaccctcaagtaggcaccgttgtctgctgttcccttctttgtggccatgtgtactcagtggttagcacccacctctaagtgagaacacatccatgttgctgcaaaggacaacatggatgcaaatgatctcattcttttattatggctgcatagtattctgtggtgtatatttaccacatgttctttatccagtctcctattgatgggcctttaggtttagtccatgtctttactattatgaatagtgctgcagtgaatatacgcgtgcatgtatctttatggtagaaccgtttatattcctttgggtgtgtgcccaataataggattgtggattgaacagtaattgtgttttaagttctttgagaagtcaccaaactgctttccacagtggctgaactaatttacattcccaccaagagcgtataagcattccgttttctctacagcctcaccggcatctgttattttttgactttttaataaaaaccattctgactagtgtgagatggtgtctcactgtggttttgatttgcatttctctaatgattagtgatgttgagcatttttttcatatgcttgttggccatatgtatgtcttcttttgaaaagtgtttgttcatgtcctttgcccactttttttttacagagttgattgttttttgcttgttaatttgtttaagttctttatggtttctgggtattagacctttgggggatgcatagtctgcaaagtgtgcttcttatgcaagcacccagccttccggcactgggacgggccacatgggaggagccaaaggatgggagagtttaccccctccagcccatgaacttgctgtgaggacccctcctgccatataccctcctgggtgtgaagaggcctcctgtgtgggctgcaccactgtctccgggattcttggcctggaggcatctctgaaatttctcagaatgcccaatttgcaccagagatagagccaggccccttgggatggaaaaggaaaagaaactagatttactttttaaagtttctagaacttctttggtatccctagaaaactttttttaaaaaggattttctttttaagttggatttctatccattatttacctgagacataatttcagctgatcaaagtttagagtgctggcaagtgccaagccttacgatagatgttgtaccttttgacaaatgaccatgtatgcacagctctgtttctggactctgttctatccatttttctgcttgtcctcatgccaacatggccccgacttcattgctgtggctctgtagtaagtcttggtgtcttgtagaagttctccaaatttcgttgttttttccacaattgttttggctcttcttagtcctttgcatttccatgtagaataagtggattaattagtatagaaaaacctgtgattttcattcaactgcattcaatctatagatctatttgcagagatatttcacagttttgagtcttgatctttgattgtggcgtatagctccatatttgttttctttgatacatctcaacatggttttgtaattttttggtatacaaatcttttaaatatattccacataaatttatccataagtttttcatgtgtttttgttttgtcctttaaaaatgctatatttttagtttcaattcccagtatttctttgctaatgatgagaattacaggagctttctgtaaatttgtctagtatgctgtgagtttgctgaacaaatttattctagttctagttgcccaaggattctttagtatcttccatgtacgtgaatatcttgtttgagaatgaagacagttttgtttcttcctttatactatgtatgctgttagtttctttttcttactttattgtactggctagggtctccatactgcattcaacaggagttggggaagtaaacatcctctgttcctaatcttaggggtgaagcactcagtattttaatgttaaatataaatacacattcttgtaaattcccattgaagttctattcttgtaggctgagagttttattacagaagggtgtgtcattttgtcaggtgcctttttgcatctgttgtaatgtttatgtggtttctgtcttttattctgatcatatggagaaatgcagtaattgattttctaatgctcaacaaaccttgcttgtctttgataagtgccacttgctttgagaaacgcatgcatacatctctctgtatatatatgtgtataattccagcattatttctatatacatagaaataataaatatacaaataatgctggttatatttgctaatattttacgaattacgggatactggtctgcagttttcacattttgtcttttttaggctttattatcggggtaatgctggcttcataaaatgaactgatgtattctctcttgtactgctttttaaaattgtttaggattggtattttttttatttaagtgtttaaaaacatctgggcctggaattttctttgtgggaaggttattacttaatttaaaaaatatatgcaatactattaagattttgaatttcttcatgactcagttttggttatctgtctttcaaagagtttgttttatctaagtggttgagtttattggcattaattgttcgtaatcttctcttatccagttatccctctcaggtctctagggcacgccatgatgatgctattccactgcccttttttccattcctggaatggtacttcccaccttctaaatcagtcttgttacaggtttattcattttctcagttctgtattttattgatttttatttttttgttattttgtgtattttactctctttctactttctaagatagaagcagtgggtcccactgaagaaaagcagatagcaggcactaaatttccctgtagggttaactatgtcagcctgacagaccccaggctgtgtgtctttggaggacagagacattggaggccgttcatgatcctttctaagattggtcattgataggaaactttgtttgttaagtaatataagtattcaaaactagacattaacttctaagcagtgcttaagcagcattctacatgttttgatagggattgttttttaatatcactctgttaaatatttatgtactgtaattattgtaaatggtgattacactgttccatgtgcatttgcgagaatataccctgccattgtgtgcagtcttctataaatgtacgttgggtcaggttgttttggcgtgttgtgcaggtcttccctatcttctgactttgtctccctgttcaatcagtcgagaaaggagtgtcgaagtctgcaactcgaattatggatttgtctcttttcccctttggttctgtcaactcttgccttgtgccttctgtacatttgctagtaggtgcctaatcacatgagatcatgacgtcctcctgatgtgctggctccttaacagtatgaaatgtactctttatctccagccatttttcttactctgaagttactttgatattaatattgctagctttcttgtgatttgcctatgcatgtgttatactcttttccatccttttgcttttgatctatttctttatatttatagtgtgtttcttggaaccgggatatagtgatccagtatgcaagtctgtactttttatttgaaatgttttagttaatgtactcatcaataggtatgggtttagtctgccgttttgctgattttttcatttgtactttttattcttcattcctgttttcctaattccctgccttcttttggattgaatccttttttgatttcattttataattactattgcgttattagtgctacctttttttaagtagtttgtttagtacagtactttttgttagaaattccagaaatgatggaatgcgctgtatccacactgtccagtatggcaggcactggccacctgtagctgttgagcacttgacatgtgactcgggcaactgaaggaactgggtatgcaattacgtttaattttaaataatttaaatataaatagccacttggggatacctgctaccacactgggcagggtgactgtagggtttctaatattattgttaacttctcatgatctacattgaaaatggtgttctgtgacgtcacatgcaatgcaagaccttcaccacagtgaacttccatttgccccttgaagtcccatgtacacggccattgatcttacttctacatgttatagactctcaaatacatggttgtgactttttcctttaaacagtcatttgtcgagaaataatcatttagaattgaaattgaaagtgagaaagtactcttttcacgtacgcattttgatgttctaaatatgttgaaagggcgcaggggggtttaatgcccttcatcagatctatgctaccttgtggacagtaattggaaaggatggggaacagggacgcacgagtgggtagatgaatgcgaggctgttgaaatggttccatggtgagcagtgcatggttgcttggaacaggaaggagcggaggtgttaagaagtggttgaatttgggatctctttggaagtatgatgctccagctgttatcagcagagctgtaagtgaaatgtactttgattgtttgttgaacatccttgccgcctttcctatcgaatttgcttttcaaaaatagtgtggacattaaaaagccatccccatgtgcctaatttcaattagaaaatgttgaatcactgtgaatttggtgagtcatcctgcatgtaagtagagctatccatctaactcttagaatttgttaactattaagagaggaagacagaaggtaatatagagatgactatttatgagtcattttatttattcattatccatctaaagagtagcaattgattgtatcacagaatggtgtttgttttacatcttttgattaggagcagtggtttatggcatagacttgcttaatttcctcctgtttcttcctctggagtggataactgtttcacaacagaaggcgataaaagatttctggtttattcattaattttgctttgagacggaatacctgatctcaaggataagatgctgattggtatgacctgaatcgaatgattagcagtatgttgcccttactctgatctccccacagtgtgagagattttcttaccttcgcatcagtttttagccatgttttggtgtttaagcagagatacggttccactttgaaagctctggaagtaattctcagatcacatatattcatctcaaatttgaaatctggagtgtttgtcttgaaattaaattgtggtattgtaagctgtcagtggaatgatctgtgctggaacctgatgcggtctagtttacacggtattgaatcatgtaagtatctcatctttcctctttgaattcagtatgacttcacataggtgaggttagcttttaagtgtacacagaggtatggttaactatcagcagacttcagttatcaattgctgatctcagaaagctaatttatctttagtgtccaataacattacatggctttctttctttgttttatgttttgtgtatatgtgcttaactgtttaaataagttctggattgcatccaaataaggtttgatatgctctcattaagaatatgatattgtgaataaatgtaatcctgactttcaataaatggcctgtaaaaaaaaaaagaaagtatttagagttagtgagttgaggggcttcgtcacatggctaaaggagatttgagtagcccctggaatgttgagtgactctgacttgtggaatgcatggagccccgtttcgttggctggcaggatctacgtgggccgagcatacagccctagatgaatgacttatgtctctgaattctgttcctaatctctgctgctcaatctgtggccacctgcagaggagccagccggatggcatcgtccttaccgagctctctggttgtcagatccttcactactccttagtggctgattactctgcgtagtgtagggtgctgtagggtgcataactgattagtgccttgcagatataagcaaagtttacaatgaagcccttgcgcttaggagcatacagtctagttatgaagagaagacacaaaacacccagtcacatcactgtgaacagacaagtttgccaggagtctgttcagacctggtgctccctgagccgcgctgagcagcagttcagcggggataccaagttggggaagatgccaagtggtaggaaggaggctggggctctggtctgcacatgccagctgatggagtttggagttggggggatatggccagttcccaatgcactggaccagccaccatccagaattaggaagtagatcagcccgtgcctggcatgcattgctttcttttcagtttctaacatatatataacctttttaagtatatatatatgtatgtatatatataactttagttatagagtctcgctgttttgcccaggatggagtacagtggtgcaatcatagcttgctgtagcctcaagtgatccctcccacctcagcctcccaagtagctgggactacatacgtgcaccaccacgcctggctaatttttttgaaaggacaagtcttgctatgttgcccagactagtcaccaactcctggtctcaagcagtcttcctgccttggcctccaaaggagttaggattacaggcataagccactgtgcccagcctaatctatataacctttcaaacaggtatctccatttgtatactaggggagaatgtagaccccacaccctcttcctcaagaaacaacttgaacgcatgccattctgccatctcagccaaggcgattgcctgtgcccttcccaagggcttggagacaccctctccctgctagccccgtgcaggggtcttcccatgtgtaccctgcagcaccgtccacctgtctgagttcgatggggcctccaggccccctgccttggtgaggcaacacgctcagcgcctgcgcgaatcttcttgcccatcagttccttttccttttatccaggatttcacacactgggacattttgtgccaacaattattaatcagttttaagattgactgggtttgtggactgtgcccagggtttgtgcacctcactcacggcagatttcctggcagccctggggatggtcctgctcccccggggacagtttccatctcatggtgtagctttgggagtggggcccactgaagaaaagcagatagcaggcactgaagttcctgcagcctgttggaccccgggccgtgtgtctttggaggacagagacattggcctacagtaaaataaagtcagatgagaaagggtggggaggctttcctgctgtaaagggattatgtattcatactcgaaatagggatacattaggggaatagattgtaatctctacatccccaatccatgaaaacaaaacagaaatggagggccaagaaacctacacagggaagacacgaaatagcaaacatacctgatttatccaagggaaggcagaggagggaaacgaaaggatgaataacaggtgaggcaagcaggacataactcgtaggatggtcagcatgcccagcgcggcggcgaggacttcggaagtcagtggacccagtggagactcagatgaaaatcagagatggtctcactgtgggaacatggtgtgcaaccatagactaaggcggcacaccttaaacatagcctaagagatgcaccgtgcagggcaggcacccacatgaagcggctatgtaaacgtgacaaagtagatattaagaaaagtaggaaggaacagtaaaaataagatcagatatcagcaaagcagaaaatggtattacagagatgttaacaaaggcagaaattatgtccttggaaagagtcgtaaaaattttcaaaattcccagccaaacctgatgaagaaaaatgaaatgacaaataatataaatgaaaaggaaagatcactacagaatctacaaatattcaaagataatgaggatgttatttaaaactttatgttgacaaatttgacagtttagatacaatgagctaagtttttgtcagagcttaacaatttaatctaaagaaatcaaaaattgaaaattaaaaatcttccctcaaagaaaaatctaggcccatacagcttcactgttcagttttatcaaatagttaaggaagaagtaattccaatcttatattagccctttcaaggaatagcagaagagagaataattcctagcttgtttcataagaccaacacaaccatgacaccaagatgccaagatgtgtcaaggatgtttgagaaatggtaaccacagaccaatgtctctcatgaacccaaattttaaaatcctaataaaatattagaatgtcaattttacaatatagaaaaatatgtatatttccagtggggtttattccattcaaaaatcaatcggtgtaattctccacattcacagaggaaaagaaaagaactttatgatgataatgatcatagtaaccaaaaaaagcatttgacaaatttcaacatccattcacgatgaaaatgcactgcaaagtaagaatataaaggaaattctcttacatgacagcgtgtatacgagtgtgcacacgtgtgtgtgcgtgtgcatgcatgtatgtgtgtgtacacgtgtgcacctgtggttttctctccatgtttcttccagtactgatcagggttgcttgttttcaggagttttcaagtgctctaccttcaagttttccccagctaaatctttcccatttctttctctaaatccctttttgatatttgcagttattttcaacttaccaccaatattttagtcttgattagaatcttcccagaaaagacaagttttccttctgattcccacatgtcccttcagctcgtgatggcgcagaatatgtttgcttgccagttaggggaacctgaggctgccttcctgggcagagtggcgatttgtactgggccgacagggcagccactgttacttatggacaggtggactaggctctttttcatcctgaggaactgctccgcgcttgggaagagccactggagtttatcagcctgcgtgtaagcatgtgggaagggggatcaggaacatttagtagaatagtccgtgctccaggtgatcagtccccacccacccgcatgcctcaccttctccatcccacccgcattttgggtcattgggggattaatttattcgtgtctcgtaagcactggcagaacaccacccgtgtgaacagcattggtgaagcctggggagttctttttgagacttccttgagcttccggcagcacgtgtgagtttcgggggtgattggaatgtttctccctggagggaggcctgatgccctggagctggctccagcccgagccccgcggcgtgttctgcctgctgccgcctacctgcagggagacgcctgagctgggaaggttctgagggttggcagggtgctctgctgtgctctttgggaggatccccttggctgttctgcatgcccagggccgtgctctccgtggaaatctatgttggagacgacaggctccggttccagctacaccagcctgacttccactggacagtgccattttctgcctctgataacaccgtggtgaagcgccttacgtaaagcaacagattttttgttttaagatgcactataattactcttttcagaaccaataatattaacccagtgaagtcaaaactgaattgttttataaactgactatggagctggtgtaaggagatgcagggaaggcttctcatctgagtcggtagcagagtacatagtgcaagaagcgtgggcaggctcccagcgcacccagagatcaaggagagtgatgggtgctgcccgcctctgaggggacggaggcagctgccacccgccgtgtccctcacgctggctttcagaaggcttcacgcaagtgggctcacaggcaagaagaaaagctgtgggccgtgtgtctcccttggctatggctcagttttaatgtaattagaagctcaacttgaaagtgagatatcaaaggaagccttcagttgctgaagatgggtgtgctgggggatgagggcgtgggttgaaaagtatccagtgactctttttctcacgtggatcagtctaacatatgtgactctggtaattgaagatggtgacaggctaaactaagctgggattccccagggagagactaggatttctggaaccagtctaacaaaaacagaaacttgaaggagaaaacagaatatgcctccctctcttccctgcttccctcctctactcaaaaaaaagaaagaaagaaaaaagcagcttttgcaatgaagaattcagtttttcgcccccgagtgtatgatggtagtgactttggtgttcctggtgcagacctgtatttttttgtgatgtcttcatctggcccctcgccctccactcttcatgatgaatatgagacctgtgcactgagggtcctcaccaacacttccttcctcacagccgtatgatttcatccggaagcggcctctaaaaataaacaccctcatgttagcctttttccaccatgcttcatatttggctcttgtataaatatctgccacgtttccactgggaattattgctgttatatattttatagacactcgactgtcatctaagtggcttattttattcccatagctagaagaaaaatacaaaaataattttgtaatgtgagtgtgattgtgggccaggagttatgttctgagaaggagctgagagtaaattatattcctgctttattgtgttgatattgtcttccctgttgtgtcctgagttagcctttgttgttccaagttattaaccagaggtggcttgataatgacgccactttggaagcgtctggctggtgtttaaaactctagctggtgataaatatattttagtcctattaatgaagaattgtaacattttagtcctattaatgaagaattttaacatccatgcagatgagcggcatcctaaaagcagcttcagatgctttggggtgttttctaccgaagatgcttttgtagaaataccgccttccttttcattttttacactggtctgttcatcaaaaaccataacttcatggaacttgcttctgtggaatgaactaaatgtaaattatttttccaaaagctttatgagtttatcatacatgttttggaaaaagtggaaaaacactaggaagaagttccagtgagcaaatgtttcccgacatgtttcacgttttgctctggtttgaagcagggcgttttgtggaaggtagggctggtggatcgctcggtcgctgggcagtgctggtcactgcctttctttggttgagctggtcttgagtcctggtacctgtgtctgccctggcattgaccccgtggtgctttctgtgcatctccgtgctcacctttctggaacacagcccctgaacagaatcatttggcaaaacatcccagtacaaaaaccagtgggttttacatggggaaagaactcaatgagtccacagttcgtgtcgatgaaggaggcactgcgtgttgggctcaaacgcatctgtaactgtgggtgccaagagacaagtagagctcagactgctgggagcgttggctggaataaagctggccctcacggggctgttaaaatacttgaacttgaattcaaagtcagatttaagctgacttcacccctcttcccttgcttctgaagattctggtttttcacgagacagaaaaaagggtggaaccaggagcttatccccttccttccttccttgcaagcagcagcaacagccattgaaactcaaagacagcaagagctctcttcccgcccactcccagcgccactcccgggggaacccatgtgggaagggctcttcctgacacctctcctgcagcacacagcacacgtcagccttgccctgcatgcagccttcccagctggagcaggtcccaccagcgccctgccaggcggcaatggtctacaccgccattttaccttccccaggtctgtggcattaggtcttcccttgtgagtggctcgtattcttttcaagatactgtaaataatttggcatcatatggaccacttgatgcttctatatgaaacatgccttataaacccttagtactgcatgatttcagattacggaaatatctgcatgagtattggctgcgatatctctgtactagaaatttcagtgctacctctacacaaacagacacactggggatgtgctgtgtgtattgtatgagtgtatcatagaatatttcattgtccgtggtagtacatttcacatcataggctgtctgtggctacttttaaaccttagacatttgaattttccctcaagctttattctggtgaagcgtgggatggggtcttagctcactttggaaggatggaacagttaagcagcgtacctggtgactggcactgtgtgtgagtgatgccacctcggcaccttcgcgttgatcatctttaggatctttaggatcactgagaattaatcattctttgcatgcataaacctgtgtaagggttgctccacgtttctgccattgctcacagataaaacacattcatgatctcagcttaatcccaagaggatgtttccccatccatcaaaaccacagtgcaggttttcactgatgggacatagggaaggtatggcaagctgggtggaggtgtgtttcctggacttttccggaataacccaacccatccctcctagtgagcacagaattacccagaaagttgaaaaggaaaacacagtttattggaacaaatatgcaaagtgatttgttcttttcacagagaaggtaaatagcatgtcagccgccaaggccctcacacacacggatctgcccgtggagtgatgaacttgtaaaagaacgtcaggtggaagcggtgagagggcctggacagttgttctgcaggtgtgttctttgtctggttaatcgcgtgcgtctccagtctgtggctggccagccgcgtccacctgcgtgctccgggcacccaaggtgcttggttaatatgcagctctctcaacatctcccccttaggagcaacaggtacccggtgctggtgttgtccgtccagatgaaagggcctggccactctgattgcacttctctttgatctccctgtagaaggtcggcttgtctgcctagagattcctctgaagggcaatttaaaagttggatttgagcaacatcaagtgaaatgtcttcccatctcacgccgtgaggagctctttggtgtggctcatggctggatgtgaggaaagatattaacccttcctttgaaacaaactgtctcacaggctgaacttgccagctacctttctcctctgcttttagaaaagaaaatattttctttctcataatgctcttggcccttgaagataaactcattgcagtgtttaaaatttgtcctgagaccctattgcctttactttgttagtgtgtgtgagactgaaggcctgtggatgggtgagatgcttcgaactgatagaaaaagaaaacagaaggaagatttttgtgggcagagccgagacgccgtctctcaaggtgttgtgatcagtaaaagaatccatttttaatggtgaactggcaaaggctgctaaataccaattactgagtaaagtgccatgagaaggtaaagccactttttgtgaattatttcattgcactaacgtgctcgtactgaaaaacatggccaggctgcttccgatacagttcacttaaagaaaaatggctcacgttaaaaatagttgctttattttgtaaatgttttagaaaagtgcattgctgtccagaaatctagatgtacacttgttttgtgtttaatgaaaaagggaaggaaaaatatctcgaaatcccaaatctcatcggtatcaataggatcataaaagtaaaggcaggaaaaggaatttgctgctcgtgtttcccatccatgtttccaggttatgtattttgtttctcaacttttatttatgttaatgaaaccagtctgctttttttttttgttatttttgatgactaagatcccatttcttaggaatttgtaactcagctgtgacaacgtagcctgagatttacacagtccccgttaagggtagaaaatagagggagggcttagctctctgttttcatagctgtgttaaagagccaaatagtaatttgttgaccgaatgtattatctgtcctgccatatgttgttcaaatgatgagacagaagaatgaaggactcttacaatgtaaacttctggaaatcatactgtttcagggttgtttacattaataacaatgatggcttacatgtatgtatggttttataattttttgagattataaaaggtatacatggtcagtgttgaaaataaagtataaagaaattaaaaatttggacggcgtggtggctcacgccggtaatcccaacactttggtaggccaaggtgggcagatcgcttgagtgcaggagttcaggaccagcctgggcaacaaggcaaaaccccgtctccaccaaaaatacaaaaaattagctgggtgagatggtgtgcacctgtggtcccagctgctcaggaggctgaggtaggaaaatctcttgagcctgggagttggaggctgcaatgagctgagatcacagcactgtaccccagcctggatgacagagtgagaccctgtctcaatttaataaataaataaaataaaaaatgtatatttctattgcataattaactattatttatgttttatcagtccttctaatttctttttttcttaggagacaggggctccctatgttgcccaggttggtcttgaactcctgggctgtagcagtcctcccaccttggcctcctgaagtgctgggattgcaggcgtaagccaccgcgcccagctttctagtttgtttttatgcctacagcgtacaaatgttactaaagtttggattgcgtcacactgcatgtgttgtagtgggatatgcctttttatgcaccagcgtatgcattgtgccacatccttagacatgacttttattggatatgcagtagcctggcttatggatgtttcataatttatttaacaccctgtgattggttatttagcttactttcatttttaactgtaccaaattgtgctgtcatgccatcctggaagtggattgcatgtgggcgccttgtacttgatagagcactttcttaaactgtatctcagtcattagcacaagtgctccatgaggcagtgaggccactgagtagtgatccgggtcacaagggaagaactgaggcccagcgagactgaagcgggtattttcacgtgagacttcgccagtacgggcaaaagcacacggtagaggattttgaaatcaccctgattgaagaccaagctggtttttgtcccaacaatagtgattccttcatttatcccacaaatatttaaatgctgcgtacgtgtcaggcactgtccttggttctggtgaatagagcagaccctgcctgctgctccgggggatgccggcccgattctttggtaactctggaaggcttgtgcacctgctggagtttgggggagagagggagggttgtggacccagtcacataccacagtgggttcaaagtctcatctttattctgggagtgactgggtgtctttaaaagtcaagttcggaagattctcatttaatgatatttgattccatgtctcatgcagaggaatacttaggtacgacggaatgagttaagtaaagggtaaagtattacttaaatatatcatctgaaaataactgcttcatatctcttgtatcttaaaatattttctggacaaaaattttatgtaaattaaaacaaaatgctgtttttcatcattgtattaggaaaaaatgtaaatacaaaatatttggtgttttgaaggatgggccggaaatggggatgtttttgtatgatgctgctgataacagtaagttgctatcagtcttgtgaccatatacatacagacataaaaatgttaaaacccttctcagtactcccactttgaaaaagtatactctagaaaaatatctaaattatagaaaaaacgttataccttgcagcttctcttatcatggtggaaaggaaaccaacctagacgtccaacactagtgagatcgtttagataatactgacacatgctctcaccaaaccgagtcagcatctaatgcctatgagactgcgtagtcagggataaatgcttccgttaagtgaaaaagcagagtgctaaagagcaggcacattagagttacaactgtgccatgtgagaaaaagcttgaagtgaatactctcaaatgatgataatggctgttttagggatgaagatcaaggaatttcctgttttttcttgtctgtatttcaaattttttatagtatagttatattactttttaaaactagcgacttcattttataaaatgacttttacttatttttaaaatttaagcaatacaggaaagcaaaagaaataacaattacctcccatctcacagcccccagataagtagtgctgatacttggtgagcctccttgtaaaagtcactctttgcttgcataaacatgtggttatatgcataaaagacagtaacataaacacagataaaacgacaaatattttcaaatgacaatagttttgtttaatacaaggttcttaaatattgtctgtaaagaaccagatagtaaatatattagtctctgtctcagttattctgccgttttgtgacagcaatcatagacaaaatgtaaatgaattaatgcagccgtgttccaataaagttttattgctcttcattctgtttagatccatttccacctggcatcattttcttcttcctgacagtttccttcaccctttctcattgcactggtctactgcaggtgacttcttacagttttttagtgcccaaaatgtctttattgcttcttgattgttgaaaggtattttcactgggtgtagaattctagattgacagggtttttttcctcccaatactttacagattttgctacactgccctcttgcatgcattgtttccattaagaattctgctgtcatcctcatctttttgtgcctctgtgtgacatgattttttcctctggtaggttgtaaggccccttatcaattttttgaacaattttattgtgatgcatcttggtgcagttcttcatgtgtcttttacttggtttcactgtccatcttgtatctgtgcatttgcagtttgcatcaaattggaaaatattttggctatttcttcaaatatatttttttccttttcctttcagaaactccaactacagatatgtacgatttcctgaagtttttcaaaacctcactgataatccttccttcctttcttccttccttttgatttcctttctctgtcctcattttgtgtagtttctataggaatatattcaagttcactaattttttcttttgcagtgtctaatctattattttcatttgatgtatttttccattgtaggtttttttagtttttaattctgaaagttctctttggatcttttttttactatattctataattctaattaactttttgaatgtctggaatacagttacattaactttttgcatcctcgtctgctaatcttaacatctgagttagttttaggtccatttcaattgactggtgtatttcttcgtaatggatcatattttcctgcttctttgtgtgcctggtaatctttgattgcatgtccagtattgtgaattttaccttgttgagttctggttatttctgcattctgatagatttccttgagctttgttctgggatacagtcacagttaaattacttgggaatagtttgactcttttgggtcttgcttttaagattcgttaggtagaaccagagcagtgtactgaggccagcccccttttcagctcgccccggatggtctgtgaataggaggcattccagtgtggctgtcaggaaaagtcatgctcccagccctgcaagagcagcggttaccaccctgtcatcctcacagatagctcttttcctgcctgggggagcttcctgacatggcggtgcccatcagtactctgatgaatatgtgagggtgacctgttgcagatctcaggattcctctttctgagatgtgtctctgtccctccagttctgtcctgcaaactctgcctgtcctggtttccgggctcacagctccatcccctcagtttgggagctggccaggcccttcctgtgtgcccctccgggtgcccggaactctcagggcagtcgcagccttttcttccttggttttctgtcactcatctgtctctgtactttgctctccagtttcttgaaaagtgtgttctatttaatttattttttctttttggttctttttggtgagagggtcaatcttgtctcttacttattttatcttgcctggaaacagaagtgctggggtgttttttaaaaaataattgtaagatacataatttaaagctgtgctattatagtatttacatgaagttttaaaaagaaatttgcttcccctaaactttctgatcatcgatagcactttttgaggcagggagccactagtggtcacctatgtctgttagcaatagacagacatgtctgttacttccaaaggactctcacagtgtaaactgaggaccctcttacaagctggtacgggaagaccaggcctgcatctgtcagagatgagaataagacagattctcctaatcaagctgcaaggagctcctgctgtaatcactccagaatatatatcaagagtggatgtgtgttctctatggcaaaaaacaggcactggaaaatttacatatttttagtttaaaatatgcatgctcttggccaatatgtttgaactgaaaaaagatagaatgtggttttctgagttatcttctttttcttttttctcaagttagttaagatttataaggtgcttactcagaaattcatggatgaagtacaacgttcaccttcacaacactttgctctggttacaaatttttgtggtgtagaaacccccaaagtgcctcgtattttctcacccgagtccagccggagatactgaccttggtctagatcgtcacctctgaaccattcctgaagaagtgggtagacaccccctcaggactgctgtaagagtggaacacattcacgtataaccagcacagaggttagtattcagtaagcactcaataaatgttggctctgaagagattcttctcatttgcatcattgaaaaggggtctttgcaatgatgcttatagcccagtttggggtgaatcatacctctaagcaactgtcattgaaagaaggccttaatgctgatagtcattgtttcagttttactttttatttctttgtcttggctctctggctaggcctttaatacagttttgaatagaagtcgtgataatgggcattcttgtcttgttactaaatttagaggaaaagctttcagcattccactgttgatttcctgtgaactctatagattgttttgtggatacccattttcccccagaatgaaagatctttttgaaattatattattctttctttaatgaggccattttcatatttgcatttatgagaaaatgtttaaaaaagtatgtgaacataaattatataatcttttgagtcaatcagaattatacaattgaaaaatagtctacaattaatgatattcaagtatctttagattttaaactcattaaatgaacattgaaagttctgttttctaattatagagccgagtttaaattgacaagagcagccacactcgagttgtctaagtcagaggctttataaacctgttggattttccaagggttgcttctcttgaataaaggtgtttttgtttctcacatattttacattttcaatgacctgtttaggcagaagcaccttttgtcactaattagtgtggtgtgacaagtaacataatgcgtatctgaaaagctccactgggtgtaagtggagttcacacctcttaatgagtgccttcaagagtgtttttgtcattcccagggagaactagtgccccttgaatagaaaactgctgtaaatggaaaaaggatgtgtcttaggagcctggtgtaagtgcagatgggcccaccctgtcctctgactttagggccttcctcaaagccaaggccctcttgtgcgatggggctcttctccttcttagaattcctacatccagagtaatggagacgacttgggatcatgcttcaggatatatgtaggtgctcaacacaggctggtttctgtttttaatttctggcagaatgaaccacttgaaaatgaattttcattacgattttaggagggctgagagtagatgaggtaagagatctgcctagggggcaggatcgaaggaggctgtcactctcagatttgtgcaagtgacttgtgttccccaaattcacatgttggagccctagccctcagtacgtcggagcgtgactgtatttggagatggggcctttaagcaggtacttaaagttaaattggggttgttagaataggccctaattcagcctgactagtgtccttataagaagaggagattagggcacagatataccataggcttctgtgcacagagatgaccatgtgaagtggcagcaaggggtggccgtccgcaagccaagaagagaggcgtcagagaaaatcaactctgccaacaccttgaacctagacttgcagcatccagagctgtgagaaaataaatgtctgttctttaaaccacccggtctatggtattttgttatggcagcctgagcaaattcattcagcaagtgccagccttgcactcgcgggagagtgagtgcctcctgcagtgctcagtctggtctcaggctgaaattctaggtagatgcacattttcccagttggcaggtgctggctcatgctgaaggggaacatatgctcaggattcctgctttatgtacttcaaaaggagacatgtgacatgtttcacttaacttcatctaaatttcctagacacaccaatctgtaacggtttagaactcaacccggtggttatacagctttcctgaagtggagaggtgggctacttatcttgtatgagtcccatgagaactaaagaacaatggttcaaaaaacagatggatgtctcccatcttacattccctccaggaagaagtagttgaagaaataatggatataaatttccttgaattaagaacacatgaaagacttaagaataagaagtccaagagaggaccaaagaggcaaaaaaaaaaaaaaaagaaaaaaaaaagaaaaataactgacgtctatctagaagagcacagtgaaatttaagaatagagagaaaaatctaaaacattagcaagaacaaacaacacatataaagaaccagtggtcatattggcttcagatttgtcaacagcaatattgaatgtaagaagagaatggaggcatgttttcagcgtattaaaggaaaataacttagaacagagttttatatgcagctaaaactttaaaatatgagggcttggcaaaactattctcacaaggcctcaaaagttacaccttaacaattataataaatgtaaatgaactaaactcaccagtaagaaaaagactgaaaaatggaataaaatataaaatccaaatatacgccactcaaaggttatccaaagtataaggactttcaaactttgagggtaaatggatggaaagaagcatgtcaggaaaatacccaaagaaaactggcatagctataatgatatgtaaaatagattctaagactaacagccttgttagagatagaaaaggtgaatacacaataacaaaacaagtaaaatagattaacagagtaaaacataaatgacaaaaataatttgtattcttgaaaatatatagccatggaagtatacattttaagttagaaaatgaacagaataaaccttttaaaaagcagaagaaaagatcattggaaattagtggaaaaaatacaaagatcttaaaaaaccatgaattgtttgtttaagagaaaaaaatagattaaaggtaagatatctgaaatggctatattagcattagatgatgtatattctacaaaaaaagttactagggttaaagagagatgttacatagcgataaagtattcagttcaccaaaaagacctaacagtcttaaatggctatgtacctgacaacagaattccaaaatacatgaagcaaaaacggaaaggagaaatagataagtccacaattataaatggagatttcaccatttcttactgatcaacagatcctaaaatcagtaaggatatagacaatttgaacagcattatctactaacttgatgtaattaacatttctggaatacacttaacaaaggccaagatgtggaaaatccagaatatttgaaagttcttagtaacccatcattcaaagaagtcacagggaaacttagaaaatgttttgaattaaatgaacatgaaagcacaacctatcaaaagctgtgggttgcggctaaaagtgtgctttgagggaaatttataacattaagtttttataatagcaaaaggtctcaaaacaatgatctaagctgctgctttaagaaaacagaaaagtaagagcaagtcaaacccaagacaaacagaaggaaggagataataaagataaaaacaaagatgaataaacatggaaaacagaaaaacagtggaaaatatcaatgagtcaaagaactggttctttggaaaaatattaattaaactgataaatcggtggctagactgaccaaaaaaaaaaaaaaagagagtgaagtcatatattaacaatgttatgatgagaggggccattgctacaaaacatactgacactgaaaaaaaaagtgcatagcaggacagtttcgctacccatatgtttgactgcttagataaatgaataactttttttttttttttttggagacagagtctagctctttctcccagcctggagttcagaggcacgatcttggctcactgcatccttctcctcccgggttcaagtgattcttctgcctcagcctcctgagtagctgggactacaggtgagcaccaccatgcccacctaatttttgtatttttagtagagacaggattttaccatattggccaggctggtctcaaactcctggcctcatcatccacccacctcggcctcccaaaatgctgagattataggcgtgagccactgtgcccagcctgaataacttttttgaaaggcacagactaccaagctcattcaagaagaaatagtcttaaatctatcataataattgaatttataatttaagcctttccataatgaaaatttcagacgtagttgtcttcattggggaattctacaaaacatttatggaagaaataatgtctgttctagaaaattcttccagaaaatacacgaggaggaaatactttccaactctttttatgatggcagcattaccttgataccacaaccaaataaagggattagaagaaaattacagaccaatattcctaatgtacataaaatgcaaaagtcctcaggaatattaccaacttgaaaccaggaaatatataaaggatgatggaacatgaccaacttgagtttatcttatgaatgtaagactgttcagtatttcacaattaatcagtttaccatatcaataggaaaaatgaagataaacctgtgttaatctcgaagaaatttcctgatttgataaaaaggaatctatcaaatacttattgctgacataattcctaatgataaaagattgaatgttttcctcctaaaatcagaaataagacaaagatgtctgtccactcttcctacagctattcagtggaaggtcctagccagtccagtacatcaagggaaaaaatgattttggaaaagtaagaaataaaactttatttatagaaggcatgattgtctatacagaaaattcccaaaaacctacaaaactacgcaacatacaaaaaccaattgcctttctatatactagcaatgaatattggatactaaaattttaaatatagttccatttataatagatgaaaatgtgcagtagttcatgtccaatgatatttgcaggatatatatactgaaaactacaaaaccttaaataaaataacatttaaagaaatggagagatatactgtgttcttagattggaagactcaatattctccccaaactgatggatttaacatgattccagtcaaaatcacagcaggtcttttcctagaaactgataagccattctgaaatctatgtggaaatttacagttgtacaagttttccaaaattatttttgacaacccatcactagagaatgttaaagtaactgatcatataattccttcaagaatggtcattaaattctggatttcacagtttcttttagttcgtatttcacaagatagaagctttacatttttcagattaaggtagttttcacctttgtgcatgctacatcttggggaaaatactgagacaaaatgactcattggaattatttttgattttttgatactcggctgacaattatagtctgtgttatgacagttatagcctgtgtcatacgtactcagaattaactaacatagtcttcctcctaacttccctgcatattggaacattagaattcttttggttggttgaagaaacatcctagaattttaaaatattttgtatctaatgtaatgctgaaaacatgaaatccacataatgtatgcggcatagctaatattagaagcatgttcaaggagcagcctctggggttaatagagtttaatttgcaagacaaatgaaagcttattttctcctaggctctctgctcataattctagtagggccacttttgaagaatagtaccttcaacagacacagagaacccttgttggacagcaacagaacttgctcacagtgagacccgacatcccctccgctcagtgggcatttcctacagtgcagagttgtgcgttgaaaagtgcctcttcactccctacatgaggttcctcacacaaccccgcacctgggcgggcgggcgggcgtagggggcataaatggcttatccctatgaacttcatcattatgaaatgtaaaaatggacagtcccattgccccagaaacagtgggggagcttttaagtaaatccaggtttatctgcatttgggaatattctgcattttttgaaaatgatgttcccaggaatctttataaccaaggagaatccttactgtaaacattccacctgaatttttccaaaaaaaaaatagatcattaagaacaatagacaaaggaatatgcttttaaaaatagtgattatctctgaaggtgggattgtggctaatttttaactaccctggtgtgaccttatgtgaccctgtgtgagtcaacatgtctggcctcaggggtgtgtgtggagggggcaccctttgccattgcattacacaagtctttgaactgactgtccttcttactaaatgctattagcatctcttagtcactgtggcagccaaaaatgcttccacgttttctaagcattccacaggtgtatgttcctggcctgattcaggatagaccagtaactcctgaaagtaatcaaaggggccggctattgtggctcacgtctgtagtcacagctacttgggaggctgaggcgggaagaccacctgagccccgaagttcaagactgcagtgagccgcgatcccaccaaggcattccagcctgggctgcagaataagaacctgtctcttaagaaaaaaaaaagaaaaaaaggtaataaaagagcaccaggaagcataggtgatgcacctcccatgtagagaaggctgggcgagcgaatgtgtagtggtttctgcggctccattgttagtgatgacttacggatggaaaagggagttttgtagctgagtgaaaactgttagaaaaccaaatgccgctgtcatgtttttgtctcgtgcgcttccccttcaccttcatccttgggcccatgctgtggccaactgaggagtaccctgaggttaagcgtcccccatggcaggtgaggctgtggggtgggaggagggctgggagatagcagattagagatctacaagagaatagaaagtttgattcaaggagaaaaactggagtaagcagtttggagaagtcagatgtttaaaacatgaaaagaaatgtaactttgagttgcagtggttttgagtttcctgatcttgatgtgccagtaactccctgggggctgacaaatccagggggaaggttcaaaggcagagagcctgtttgagctgggccagggcacagaggcttgctcagaagacgtggacggcagcagagcctgggcttgagagtcgagctccaccttcttcaggctctttccagcggggcgggacaaggacccacacatgctaagcgagcagggaccctcaagcctgtgactgttcgtgccagtgaaaagggcaccagtgcactgatttcttccgttcacccagaaacaacgatttcttcaatgttcacagtagtctgttaaccacctcttcgtggtgcatctttgagcctgtgtttacagcagtcctctctttggtcttaacaacccaacgtgaattttgtggcatgctacaaattgaggcatcaaagctatgctttttacattgacttttgagaaattcgacagagttctgaaacccaaatcttgacctttcatggatatgatggtaacctggcttgaggttttttttcatctctttcccaaactacctgttctttccatcggcattttaagtagcttgagcacttggtttcactcttcaatactttgatgatgcgaatatctgcagatgcctactgtatgcccagcccagcctctctacagagagaccttcccagccagccccggtctaacccatcatgctgttgagtgttcttcctagcagacatcattatattactcatgcattcattttagggggttatggtctattccattgctcccctctcccagagcagtgctttaggggagccaggtctgtcttactcccggtacacccagcacctgtaactctctagcaaatcctagatgcttggtgagtgagtgagtacattgaagtacattgagtacagtgaggccacacaatttaaaaagtgacaatggcagtacactgcggcatgtgctggaaaatgaagtccagggtgctgggtggcctcatggcagggaggctcccctaggctggcgtcggggccaggcagcctgaggatgtgaaattcaagaggacacagcaagaggctggaaggaaactagttggggacaggggtgagaggactcgattgaaggggtcccactgcaaagggccccatgagcccatccagagtgcttgggttccccccctgaggcctggtgagagcccgtggaagggccgagcctggggagctcacaccgaggcctcaattcctgcttccctttcagacacgcattcatccttaactctttatcagaagggaaataaaacctcccagatagcttggttgtgaggattaaattaggaaaaaaaataaagctatagctgttattggccttgcccggtgctcctggaccgtggttagtggatggagcctttcctcatcctccagcttcttgcctgtgtttgtagggctcacgacagcttgtaattatttcatttgtgtgggtcttactttttgcacatctcttcactgcgtggcaggtcctgtggaggcagagcttgggtctgttttgtccactttgttcccagtccaggcagaaggatgggcagggagtggacgtccagataatgaacctgaagtgagtgaatgaatgcactaagctcaagtcagggttttctttacatagaaattctcccacgctcctttttgcttttagtcttgaggatcaacagtgttcatgtactaaatcaagcctgaaagccctttttttttttttttttttgagatggagtcttgctctgtcacccatgctggagtgcagtagcatgatcttggctcactgcaacctccgcctcctgggttcaagcgattctgctgcctcagcctcctgagcagctgggattataggcgcccaccaccatgcctagctgatttttgtatttttttggtagagatgaggttttaccatgttaatcaggctggtctcgaactcctgacctcaggtgatccacccacctcagcctcccaaagtgctgggattacaggcatgaaccactgtacctggccaaaagcccacgtttggcagggtggctggcagccttggggcctcatccacggtgaggttgtgtttggcctctctttgcaggttgatggctggaagggggaagggttctgtggtcaggcctgtgcttcatggagatgtctgaccgttgggactgtacctttcatcctttggatgagatgctctgccttgaggcagaagcatggaaagccggtggatttgtgcgtgtcggtggttttccactgggtctccaatccggactcagcattgtgggaccaccagtggctccccctgccacttcttgtggacacgttctttctccttagagcatctgttccaggccagcggcggtgttactttccagcctggggatgactttatggcgtgatgtctaatctccagtgggcaagtggtgaaggtactctagcatccatccagtggccagtcggccgagggcctgtctgctcatggggaagtgtcctctgatggcagcccagtgtcttgctaaccagcagaccactgcagaaggcaacgctggcctcctagaggtgtggcttgtttgcatctctatgtttgtgaccaagtcgtttccttccttggtctcagaatctgcttggcacttactaatagcatttgttcaacatgcatgatcccggtatgtgaagtacagatatgacatttataagccagacactgcgtttgactaatgttggcaaagtcacactaagagcctcccagtgttcagatggcggaagggaaggcagataggagtccagtccccaggactctgaggccccaccttgtgccttggtagaagtgaagacagatcgcctggggaagttggaagaagtagccgagacatttctcctggctcagagcagagggggatttacgttggcctatgaaggaagagtaagtatgtagaaccttcacttgtagagagctgagactttactgtcacccttgttttagggagcctacatggcacctaagactcaaatttacatttttaactaactgaagccaaataaaagaccttttatcccaactgggtacactctaaagtctcgacatgattatgcctgtgatcctgcacaaatcgtctcaaagatcttggaaaattggttagtgtcggggcacggtggcagttagtactggggcattggaagcaccagagcttaccttagctagacgtttccatcccgtggcagcttaacacgtggcatcctcactggtcttacagcattatggggaatgcaaaataaggacttgtctccttccagaagcctgctgcccatcagaaatatatatatatatatatatatatatatatatatattttcagggaatggtagagaacagtggagaagtagatgcttgtcaggcgtcttgtctgctgggccaaggtgaatcaggaggtgagagcggcggctttcctcttgtttgggcagcgggtgaaggacaggcgtggcaggctgtatggtgagtgtgggcatggccgcccctccgtcctctttcccctctggcccgtctcgcatctgaacacctgggagtctgtgattagacctgagaagaggaaatgaggggcagttcccttccattttcctcccagccgctcagtccaggtgtgtgtcagtttgcacgcctccctctggaagtccgtgtctctgcgaggctcctcagccccggtagcccccacgccaagtcccatttactcagggtttctgctggtgacggctctaataggcacttcacctgctctgcggaggcgcctgcggaatggtggtcgctctcattagctctgctcacccgcccagcgttacaggcagctggggagggattcaggggctgctgtgttcagcagtaatcagagccccttctgtgcacattcgacgctcaagtgtgtagtttaccacgggagatcaagaaatacgttaaatgcataaaattaaaggcagcggcctgcaggatccccaggtggcgtgtgctgggaattggatgcacttggctgtgtgtgtcacttaggaaatgcgctagggggtcagcagcttccccatcgaagcgttggttagtttgtgaaaagtaaaattccaaatatttgaaataataaggggccagatacgtttggagcttgagaagaactatttcaccagccaagagatcctaaacattttttggcttaatagaaaataatagcctattttgaacaataatctttgtaaatccaagaagaaaaaacagttcatctccctttatagggtctgatttgtgtctgttcaatttaaatagcggcaacagaaatacaagtgtctttgggtgattttgttctgctcttaccaacagatgacaatcacgtcttatggtttttgatttgacagaacggttcatttcatcagctttctagcagcccatttgattcaatttccctctgcagtgttttactgaaaatgacaaaaatgttcttttacataaagcctgcgagtctgtgaaggaacataaatgtgctgtgctgtttacatactaacttaattgtaatttaaatgcccttttcattccataaatatagccataggcttttcatttccttcaagccttcagctcacagagcagtttatatgtaaactggagtcagttgcttcataaagtgaatttctggaggaaataatatagtatatatcaaaatctagataggtaatgggaaattgattgtgacaatacaatattagaaacacatctccataatattttatttattacactttccaccttttgctgtcaagggaaaatatttcatcttgcaccgcgaactccagtctgtagagattttgacctcaatattctcacacaaatgaatatagtgtgtaaggtagcacaattttccctgtgtaaaatcatgcataaaaaacaattcatttaaagcatctaaatgtttccaaattactgcaggtaatttttacagcttaattcctccgagacaccattttaaatgaacccataattcaattttcagactttgcatttcaaatttttatgttgaaagtaatttcctttcttgcttaagttgtgctcagaaccagattcataaaatgtgtatgatgtatgtctgtagaatcagtgactgttagaagcttaataacaaatatgcaaggaagaaattaaatgatttttctcttcagtagttcagtttaacattgatttctaaaagaaatgattctcactttgccgctaagtttctttctttcactttttttcttttcttttttcttcttgcagtgttccaggggataaaactgtccttgtatctgtattttgaatgatttggaatcttttatctttgcatattcctttagaccagaaaagaagttgaataatgttcagactggctcccatgttaaggtagcacttagagattctctgaatatcatccctgaagctatggcttcctaaagacttttgacctcttaaattagtgaagagtggacaccaccgcttaagccctgctaagaccagttaaaagcatctgtggtctgggcggagggagctttgagtacaatggaaaatggcaccaccgtgttcatgcttgcgagctttccatcctgatggctctcctctgccttttcctgtggctgtgggatttttcaaaacccttttccatgtctgcccttcaatagaacactccaagtatccagttttattaatgtccagaagcgtaaatcacagccccctgttttgtcattccagtcattttagtcactaaaggattacttcaagtgactgaactcggctgttatctgtttgagtttttgcagccaggtcatctcaggggactgggaacaagctttctgcccccttaactatgtcgagtggatggctttagctggaccactttttgtgattgatgtacattctgtgtcgctgtatcttcccgcgacatggtaatgcaaacttagaaaaaaaaataagatggaaatggtgctgcaagtttttaaaatcaagggttgggcagtgcagggggagctattgtttaaaaaataaaagttgggaggaagatataatggattttgtcagtggtattagggcgatgaggcattcttgagttcagcaaatattggcagataattctgctttatggaaactattaaatgtaattggtcacatcagagacacaattggcatctgtactttgaagctgaatctcctcaggttgagagagagaaagagagattaagacggactcttcagagaccatggactacagggcccaaagttataaatctggaagatgtaaataaaggaatattttaggctaacgttgctccaagaagcagtatttgcctgtaagaaatgtaataatagaggtgccaatacaagatagcaaaagttacccaggaaagatgttaagtgacatgctgtcttcatttttaaacaggacaaattatttaattgggaattttgccgacactgttgaagcaattatcatatttaaactgtttatcttctccacattctgcctgtattttttttcttctttgcattaatctttttcctctttagcatctagagagggtccctttctcgtggagatcggcattgtagaccttaaaaggtctcacttgagaaatatttttgatattattgaataattattaattcatgcaagaaacaaaaggaagggcactcaccggctcgtggccagagcagactctcattctttacttctgagtgtttgggggcttctagcgaataatccctggatgacgggtcctagtggttttgagaccaccagtgggtagcctcgccctgggaggggcttgagcagccttgaggtgcttttgtgctttgcacgttcgtaattgtgaacctcaacgcaaagcaggtgttgttgtaaatctggtgtctctgtggaagcaatgccagtcctctaattcatcttcgccaagctagaggacgcgagcacatgtgcaggtctgtgacctaaagcccttgctggccagggtgctattcttacctttgggcttccagaaagagccagctcctggtggagtgaaggtcctacctccagatgcctccgaaggtgccggtacgtgattggaataggaatgcgcatgaacggagaaaaccctcaccattgcgtccttttgttctttttgcgaggaagagatccatgggttggctcttactgaacatgaaatgttggaagtggaacactgcagtgttaccagtgagctgtgtaatcgccacctctgacagggatcctgctcgaggagcacgtctttccttggtgtggccgtctccaagtactttgggtggtggtaaatttacccttctcggtcacacactgtgaagatgtgagtttcccaatttcagcatttggagccatgtccttggtgagggcaggaggaatttgtcaccctttctcgatgtgcctgggactagggcagagacggttagtctcaggagagccaggtgtgccagctgcccctgcctgccatggctcccgcattgtggccaggactttttctggcagtggtactgcccgagggccgcagtcctggtcacattccacttggggacagagtgtgcaaggggctgatctgaagatccggctggaacctgggagccacaggatcctggggaccctctttggctgtaccccgtacctctgtatttgctcccacatgctgtctgatttctctggatggcctggatgcctctgttcccagcatctcctcggcatgctccctgcagcccttggcctgtgtccagtgggccccgacccggaggctcctgccccgtagctcaggtccggtcttggcctcagccttcccttaggtgctcgtttctccagtacctgcagcaccggcgcttttagattgcattctttatgcattaattagtaatgtggtggtcccaggtgactaataagctaaagaaagaactagtgtgagtgaatttctttaaaggtcatttggctctaggaaaaccttttttttaagaaaaaaaaaagcattttatagaaatgttcaatggcaaagtgaaatgtaaagtattacatgttttttactatagcgaacaaattgcccctttttattccgtttatgtcttcatctgctacatttagccagatatatttgtctacctaattttctgcaaactggaagacataatcccccaatgtgaaaacaccaagagttacatgatgataattataactcatgaggggaaaagtgtcgcctatagaatccataccggtcgtttgcctgagagaacgtgctcatcctggccctgttggattgtctccacagatgtttttcatttcgtatttggtttgattaaagacaaaattcacccatcaaaaggaagaacggccctgcagagtgtgagttcttcattcgagagcatgtgctagttaaaaagaaagaaaaaagatatcttaatccaatttctgagctgcactgatcccaaattgaactgaatttccattaataactcaacctaaaaatcctttaggtgttctctgggggctggaaacagaggccggtggcgtggtgtgatgttcagcgttggccaggatcacttgcttcacccaggtgttgggcctgcacactgagtgcccgagaggaaaggttccgggaaagctgctgtcggaagccggggtttgtgggatcgtgtgtaggagtagatgtggaggggcttgtgtgaatgggggagttatgaaaccaggactgaagacaacagaaaggccccctgggagacaggtccctggcttgccctgtgcttccccgccactcggggggccggccatgcggagaacactctcctctcccagccaggcttcagaactggggggctcggcctccttcctctggccccagcagcccccgagcggagacgctggagttccagtagagtggagggaaaagtgtctttgacagcgaggtgagctgcctgcctgcacggtgggtcccctgggtgactcaggcccccttcctggaaggcaaagggaggggcacgtttctgaccctcctgagggaacggaggagactggagagggaacattctagtatgtgcgtgcgcccatgcgaaggctttcaaaggcctgagagcagacttcagagctgatcacaaagttgaaggtgggaggaggggagcaagaaagcatcggcactcagagtccccaggcatgggcacctgacacggtgctgtcccccgcagtggctgctgctgttggtgtgcctactgtgtgggggcttctgtgggagaggaccctgtcctccgcacgtcagctgccggagagtcagctggtgccagatggccggccggcctgcctgcctctgggaggcctcagtgcctgttggattccctgccatgcagggcgcacccacggggtgacgtgtgggaccctcccaagcgtgcccgtgcacccatgcagctgtggccgcagtctccactgttttgaatatttgttgtgttcctcctggtaggatgcatgatgttttgggactgtgctggcagctctgtcttccagttccttcccaagcagtgtgggctgagggtgccagcagaatgcccgccccaggacacgatccagtggctctcgggatccctccagggttggctgagaatatatcagtggcactgatcttgtcccagaatgcttggtcgtccggtcggctgtgacaaaagagaaacatggtccgggttatacacagcctttccttgtctttatttctagacaccctttatttcaagactctactccactggacttcatgtccggttattaataagcagttctcgttctgtcatcgagcctgctctggagttaactgtcaaataatctgaactaaaaagttaaatcatataggctttgaaaattagcatccctaagtctctgtccttttgtatttgaaaacattgatcattttccaccccctcaggatggccagtatcctctggatttattgctaacagtaactgctcagtttcacacccatcctgaaaccatttgaggtgatcctgtaattgccatgtgtgtgtattactaatcaaggctgctccctctacaaaacactgagtggcccccaggccgaggtgctgcagagatggcccgtgtgggaggggtaacgcctgcaaacccgaccctgatcaccaatggagtggcctcacgtggcctccctgatggtggcccttgactgtggtcagcactggactggcccaccctatgagatgtctcaggcagcttgcaagattacatcatgtgatggccaatgcttctgctaaacaagaggcagggagccgaatggacaggcctcaggaagcacagcgtggtggccgtcacagccttctgggaaggctatttctgcatcactgaggccccacagcccagggtgtttaggatgaagggcacagatttccagatgtgaagagtgtcaggtgggctaggggcaggagaagcatgaggaggaccctgtgctggggatgagaggagagcggccctgcagtcaaggggccaggtggagccacctttggggatgcggggagaacttggtggccctcagagacccctgcttggagaccccacctcccccttgacaagactgcggcctgtgctgggcacagctggcccagagcgagggccacaccctactactgcaccctccacgcctgtctgtccttgcccacctcggtggctgcctcgccgacccccgccttgcagctggagtagctgtgctgataaagatgcaggtgggaagctggatggtgaggtagcccatctgtggtttgggatccgagaagacggcaagacctcagcttcatgagaagagagacctgaagatccatgctggggaagggcgaggatggaaaggggtgcagggcgtggagcaggtgcccaggtcgggtacagagacaggcctgggacctggaggacctgcacgcggggtcgggcacctgccacactctcccatgtctttgaagcctcttgtggtagaagagaaggtgctcatattttaccttctgtgccttagtatgtagtttggtattgtgttaagtggacagaaatcacatacccctgctcactctgagcctgcatcctttgaccgtcactgtgaacctcagatcgagacaccagcctcagcgggggctgagatagggcattccccattcccactggctgcttggagggctgtgagggacctgctgcctggagcacagggcctgtatgggtgggtaagtccctggagagacaggaggaggcaggggtgtgcaagcctcttgaggtatgaggaaggtggccggggtctcgggaagcttgtctggccctggcaggcaggacaagggccccctcctgcccatacctctaccttaggccccttgtcatgacacgtgatacctgagggtggggggctgtatgggcatttggaatgtgacggcacaagccacagtgggtcacttgtttctacaaatgcctgagaagaaaactattcttctaactcagagaagtgggatttcccactgaaaatcagtggaaatcacttataatggtctttgcaaattccttgcatctaaggaagtgcctgtggagcagcagtgggaggaaaccatgcaggctcgatggagagggtgaccgctgcaccctcatccctggtgtcagcacactaccgaggtgctcctggtttaaggacgtttgtgcacccacccggaggtatgcatggaaagaaagcactgcagccataccccagccagtgtaggggtgggacacagtcccgtgggggccccgcggagggcctgggcagatgcagggctgcgcactgccgtggtttcctgtgtgtctgccaggagtgaagacctgagcagcctcactggcctggtgtggaggggccgcctccgagcatgcggagaagtggtttgcatggctggaagtcaatgtttatccgtctttagactcagttgaagacacatttctttcacacattaccatttttaaaacccattaaggtctgattttccaaggcgctgaccctgacgcttctagagggcctcatcccggaagctggtggggagagcaggaaaatcttccccgttgagttttaaacgtccagacctttgttgtctccttgtgacccttgcaggagagctctcgtggcttctgtgcatgttcgtgtgtgactcgcccggctgagggactggcataaacaaacagggatgagcttgtaaaacactttgtaatcccttgaaaaggagaaaaatataaatgaaaatcactgtttaacagtgaaggcaggaagggagctgttcctcagtatagctgtgggttgtcgttacgtgagcaggagggaatttcactttggatggatttggattttctcttcatgctcatgctctctaaatcttgcaaaagcacatggtaaacacacagcgcatgtgtttctggaggaaacgcacagtgtccatatagagcaggcactgattttgcactgaaagaacgtggatgagaagttccacgtgtttaaataaactggcaacagcggtcccagatagcttagccgggcagcagtcagaggtgccctggcctggggactgagctaaggtctcagaagggtcagctagccaagctcttcaccggacaacccctgaattaaccagacacatcacagatgcagactgttgattccagggaacccaggtgaaaggccaaggagaggtgaggtagttggtgcggtgcccctcctggagtcccttcaggactatggcactacagttctatgtaagctgtcacccaggactcatcttcagtggagtctggactgcagtcgggaggtgacaaacatccatggcatgagggcagcaagagcccctctcttgggaaccagttgtggccactatctgcccagtgaacatgggcttcagccccgagcatgggagggctcctggttgggcatctccctgggagttccttggtactgcctcctgcagggtgaggaggggtggggcctacttccaggcctctggaagcagcatcggcatgtcctttctggtgtgaactccaaatatctgagatggtctcagttaatttagaaagtttattttgccaagattaaggacatgcgcctgtgacccagcctcaggaggtcctgatgacacgtgccccaggtggtcggggcaccgcttggttttatagattttagagagacatgatacatcaattaatatatgtaagaagtacattggttctgtccagaaaggcagggacaactcgaagcagggaaggggcttccaggtcacaggtaggtgagagtcaagtggttgcaccgagtttctgataagcctctccaaaggaggcaatcagagatgtctttctctctgtgagcagagggatgactgaatacaacgggaggcaggttggccctgagcagtttccagcttgactttcccctttagattagtaatttgggggccccaaggttctcctttcatgctgggaggagggtttttccacacgtctcagacccaactctcgggcttcttaacccaaaagaacttccacgcagaagacagcgaaaatagtgcacttcattttctaagacatctaaagctgccacaatgactgtgagttaggtgagctctatgaattaggctagggatttacaaccacttagcaagttctaagtaactgtaaaagatcccatagactgcaaattgtgtttcatttggggacagataccctgtcttggggatttaagtgtgtttacctgcccagagttgacacagacgactgtcccttagcttcctttcctcatgctggttttaagtgcttcgaatcgggattttcctacccatctgatgcattccattgaaaattcaggaatacacatgtatgtgactgtttattggcaagtaattgtgaaataggccagaaatctaccagcttcctttaattaatgtaacaaatacttagcaaggacctcctgcattctagggattgtgggggtgggggggggagcaacaaacaaaacagataaaccctgccctgaggcgccccttgtcttgtctgggggtggaggtggggcaggcgtgagacagaagaaacaggtaaaatacagttcaaagtcaggtgctggtcagtgtcttggagaattctaaagcagggaggagggatggggtgagttttaaatgtggtgactgctgaagaaatggcctctgacagcctggaggaggagctggagctgggggggggacaggctggccagctcctccaacacacacacacacacacacacacacacacacacacacacacacacacacacacacacacacaccctctcccccaaggacccacaaggactgcggcctcttagcgtgtgtggagtcatcacactgacccttagcagtgtggcctgacttcatgaggcccccgttgtcatggagatgctgggaatgggaggatttgccaccctccagtgaggagcccccatcccatgagtgcaaagcctgaaccggcccttccctaattggcacctctatcctattttctttggctgaggaaattctcgtaaatgtatatttaatgtggtgttgagattggtagttctcccccatcccccaaagatcatcaaatctctgggggtctttcaaaacctaaaggtgatctccctggtcctattatgctgttttgtttttgcttcttttctttttcttgaaagacctaattgtggagttttttcccccttctatgaatcccaagtaaggaactaaaatggaagacgggcttctggctcccgctgcagcagatgggataattctacaggtgattgccctggaggtctgcaagggagggagagcggcaccattagactaacacagctctattattgactaatgacgaacagcgtcgccttgccttgccaccttaaaacagacacagggatttgctactctatttgttttataaaatatgcattgagagcaacaccaaaatgctgaatgacaggtgaccctcagagcacgcctggtatgcactgcgttagcttgccagtatttcttagagacttatttgattctaattcagtaggatttttaaccccaacattttgaaatcttgctttgaaagtccatgttattcccattaacgtcagtgagtttttcacatatctaaatatctaatatcatgctttgagaattgaagcccagcctgctctttaaaagcaagggagctcaccacatcctggagttctgcagtgatttgacatgtcctggaagaaattatcttcgcaagaaagtaagtttagttgattgaaatgaaattaacaccacatttctgtgtcataatgtattaacctgattggctagctggattccagcctgtttacaaacatcctgaagcctagatggccccttcctcagtgtccttaactgctgttctcgcccttagctcgcgtgcccaaccctaaggctgaaaacgccccctgtaggctactgtaagctgtagcattcaaggcctcccgggtgtcgctgtaatttcttgtatacattttagctccatctgtggcataggtaccattcaatgttatcttaatacactagctttggattttgtggctgcaacaataacaaaaaaaaatccttggttctgatgacttcatgttgtttcagaagatactcaaggccgggtgcagtggctcacacctgtaatcccaacactttgggaggccgaggcaggtggattacctaaggtcaggagttcgagaccagcctggccaacacagtgaaaccccatctctactaaaaatacaaaacttacctgggcatggtggtgcacacccgtagtctcagctactcgggaggctgaggcaggagaattgcttgaacctgggaggcggaggttgcagtgagccaagatcgcaccactgcgctccagcctgggtggcagagcgagactccctgtgtggaaaaaaaaaaaaaagatactcagatgtagctgtctctgcctgggttgttttctaaatgcgtttggctggagatagaacagatcctgcctctatccacggcgtaagggagttagcttcatggcaagctctctggagaacacaggccattgtacctgctcatgagaacagaagtgaaagtcacacagcatgcatattagttccgaggctactggcattattatttaatgatgagttagtgcaaattgaggggtgaggaagtagcatgtacaaaggccctgaagatgaatgactgtgtgaaattttgaagagcagtttagcccgaaaatattccatgagtagctgccaggagagcttttctggaacagtattaaactttagaaaaagtgttctgacatttatagactgacacgaaaacagaagtaaaagtctaaattgaaccaaagtcctccttaaagattgcctttgaaattgagtaatggcggatgcccagcacctgatgtttgggcacgggcgacaggacgtagggtggtcatccgaatatccctgccccactccccagctctctatggcattagtagatgctggaagatgaggccgtgttttctctttcatcacccgtgcagtgaaggatttgcgtggtctttggtgcttttcttctaaataatgaacaattatttcttgcgacattttggttttttactgccaattccaacagccatttgtcttttcagagctaagtttataacttcctcctttctctcctgtcacttttaccccattctgatttttcatctccctgccaattgtggtttcgtttctgagcactcatttattaatccttctttttcatttcccagaacacgtgctggtgtaaatctttttgcagttaaagtattacattaacctttttgatagcatggggtggtatctcggcggatgggcgagtgctgttcgcctgtggtctgtctcaggggttctagttggaaggcgtcctgcagccatttcttcagaggctaaggtgtgggggagcaccttggggaagaagaaaacatagtttctgcccttacaaagctgataccccatcaaacttgagattaaaacagacaaaaaacccaagaacctacagagcactgcagagaggccttgggaccctctgacagagtcagtggggagtcggctgggaagggcagcttttctgtcccagcagccttgcttcctcttcagcatgctgagggacatggagccctccaccattatctgaattgattccatctttctctcctgcctctgctgtgggtttccataatgtgaaattaatgcatgtgcttaggttgcggggggccaacccctcagaaatatgcaaagacttcaagggagaccttttcttttcacaaagaggaagatcccccacccccaacacacacacacacacacacacacacgcacacacatgcacagtttgcatagccggagtagggagtatctctttctggggaatgttcgtatgtcactgttgattttacattgtttttcctttctttgacttgaaaatttttaaagtaacacaaatttattattttaaaaacttcaactctggaagtacagccgtaaaatcctctttccagaagcaatcagtcttagtcctttggaatgcaaccttataaatctgtttctgttgtaaatatacttccctgttcttacctgcctttacctggagagtacatagtatattcttttgtgagtaggactttaacttcctaatatatcataggctttccgcagctggttctgtattatggattactgtaatttattaacttttcccactttgagtggaaatttagtttatttccaactttttttttttgcttttatggtgttatgaacatttgtgtatgtctgtatttctgtgctgtgtgcaagtatttctgtgggatagacgtctaggagaggaattgtttggccaaagggcatacacatttaaatgttcacggatgcagcccagacccccctcataaggctgtaccaactcatactctcagcagtaataaagacgcgtccatttctcacacctctgcagaggatttctaaaatggctttttatttttcaaaaagcttacatttgacaactattgatgttgtgcaactttctgtgtttattagccaattatatttttttctcctttgatttacttatacatattctttgcttttttcgattgtttcttttagtaactctgcagtatggctactagtcctttgtctaacaagttatacatattttattctagtctcttttcttagcagtttagtggtgtcttttagtcacgctggagttttaaagttttccgcaatttaatctgacgatcaatttactggagtttccagttttgagtcctgctttgaagcgccactgtaagatttcgaaaaaggactatcttgacttacggttttgttttaatatttttaatttactggtaatttgctttcgtgtgacctgagaatgatctgacataaggtttttctacatagatggttttgctacaccctttccataggcttcactgtcatctaccctcatcactgaaatgtccccttcatcttattctgacctttcctgtgtgtgggtctagatacaggctctgttctgtccattgctattcctgggccagctcttccctgatagtaatgtggctctgcagacagttccacgtgtagaggatgtgtcctttttcattcttgtttgtaaataagaatgggggtggggacacgggaggcagaatcataaacaaatagcctgacagaacagggataataaaaatttaaagaaaaagggggttaggggaagtagagtaagatcatgccctactgtataggtcataggtaggaatcaaaggaaactatttcaagctcacagaccaggaagtggaagattaggcaaggaaaaaaaggaattaaaatagggtgaccagtcatcccagctcgcctgtgactgaggggcctcccaggacacggaactttccgttttaacactgggaaaatcctgggtaaactgctgggacaagttggtcaccctagattacagacgctataaaagatatacacacaaaggtaccactagaataaaaacactttacaaaatattaacctaaaagaaaaagcaaagaagactaaagagacacagtaaccctcactgcaattccagcatcagccaacaggacaaagcggaagctgtgtcaggaactgtcagggggcttagctgcttctggaaatgaaatttcacgttggcttggtaaggcagcccgtagctcagcacatgtgagcagcacatgtgaaacacagtgattcacaagggaagggcaaagggatgggcggtgattaatcaggcaaatgaaaccatagggaagcaggggttgccatcttgggattagaccaagcagaaatcaggctaaaaaggcattataagagacagatgagaacaccttaaaatgctaaaagtcacactcataatgaagataaaacccatgtaacacagaaaccacctgtataaagcagaacctacagcatacgcaaagagaaataaatagcaacacggaaattgtcagagatgttaacacactattctcagtacaagacaggtcaagtggccacaagtaaggaatgatacaggagacccaaacaacctatcccgtcacagatacgtattgaaatgcattcgctgagtagaaaatacgtctgtttctcaacatacatggaatatttacaaaagcttatcaaaaattaggttatgaagaaaagtttcataaaagaattgttacaatcaacattctctgatcacagtgcaataaaactataaattgttaacaaaaacaaggcccatccacctagagacttaaaacctattcttgaatgaaagtgtaaatataaaccaacgtaatagaatgtctgtaaaataataactctgtgtatcaaaggcatagttaatgcagtgattagagaattcatgactgtagacacctatatcagtaaaaatgagggaagaaaaataaatggaattaataccaaactcagaaaactatgaaaaattaaaagggaagccaaaaaagtataggaaaggaaataatagaagcagaaaataacgaagtagagaaggaaaaagcatttatttaatcagtaaatcaaattctaggtcctttgaaaaaaatttaaacagacaaatcattagttattttattcaaggaaaaaaatggggaaacacaaatatataaaatgagaatgacaacagggaaataagtattgatacagaagtttttaaaaagcacaagagactaatttgcaaataaatatgaaaacatttttgaagtgcataattaggaaaaatccagttttagcaaaattaaccccagtagagatagaaagcttaaataaaccaatttacatggaagaaacagagaacattttcaaagaactacctcacaaaatgggtctgagcccagttgctttcacaggggaattctagtaaatcttttgtgtagatgattctaatgatacataaattgtttaaaagcataagaaatgaagggaaacgtcccatattttttatgcagcaagtacaaattgaaacctaaacctggtaaagatagtatattgtaaggaaaataaaaactaatataatatggaaatattgatgcagaaatcccaatgaatattagtgaatagattccgacacctcattagtagtataatatacctcaacaaatataacctttctatgcccaggaatgcaagggtagtttggtattaggaaatctgttcattgcattgcagatgaataatataatcatgcaaaaaggaaggaaaaaagtaccaatgcaagtaacttaaacactgtactctgatgacatgtactcaattgtagggggaaaactacaaatattcttcttaataactttgtttttcatagtgatgtggaattatttcatgtgtatgtggattgagaaaatgactaagtgtgttgatgtttgggagaaccccctgtgaagaagagggacacttacatggagtaggcgtcaaggaagaagttggtgcagttgacttggaatcagcatcatctatatggactcattatttctcaaacatgcacatatgtacacacttcttccagctctagctagaactaaaaaggcctagaggcagtaataccccagtcacaaagaacacacctagttcccagtcttattttcaaaataccatgcaccactgaaaaggatcttgtgcagcttggagaaatggctgattccaggatgggggcagcaaagacacaaaaggagcctagaacaagaagaatgataagcaggatgagaaggaagaatacaaaatgagcccagaattagcagggggaagagaagccaatttttaaaatgggcaaaacattggaacaggcacttcaccaaagaatgcatataaatggaagataagcatatgaaaatatgctcaacatcttcacccttagcaaatgaaaactaaaaccacaaggagattccactacatgcttattagaatggctaaagtgaactgacagtgccaagtgctgatgaagatgcagagcagccagagtccattgcgggggaaaatgctgaattacagccaccagggtgacagtcaggcaggtttaaaaaatagagttgaacatacacttaccatatggcacagaaatctgacttaaatgtttactcaagtgaacaaaaacagatacctactcacccacccatccactccttcagtcacccacccactccatcagtcacccacccactccatcactctctctctcttcacccactcacccacctactcannnnnnnnnnnnnnnnnnnnnnnnnnnnnnnnnnnnnnnnnnnnnaccccccaactcacttacccccacacccgctcacccacccatcctctcccctctcccaactctctctctcccaactctctctctctctctaactcagaaaagtggctttactcagagtctccccaagccttaaacagccattccctcacttggagaactgagtaagtagataagctgtagttcatccctaccatgcagttcagatcagccctgagaaaggagcagacaattgatacatacaacatcatgaatgactctcaaggcattatgcatttgatagtggaagaagccagacactgagatgacattactccacttacaggactgactgtgggaggcaaaaccactgggacagcaaatcagtggtagcgagggatgggattgagggggaaagaggtttcctatgaaggaccacaggaagtgcttaggatgatggaactctggcttgagcttagtgatggtcatgtgactgtaggtgtttgtcaaaacttacagaactaaacaccaacaagggtgagttttacttcatgtaaaaaatgttaatgtcatgaaagacaaaggctgtaaaactgttccagcttgagggagactgaagagacatggcgactgaatacaacgtgtgcctgtactccagggaaagtgtattgtgggagagacttaattgggacaattgatgaaattggctatggattatatgttagataaaagcactgtgttgatgtagaatttcctcagtttgacaactgtactgtattatggttacctaagagaatattcttaggaaataagatgtgtgatatacccaaagtaactctcaaatggttcacacaaacaaataataatgtttgtgtggggagggagggggagagaaagaaaaaacagtggcaagatggtaaaaacaggtgaatctaggtaaagaatatactggtgttctctgtattcttgtaacttttctgcaagtttaacgttatttgaaacaaattttaactatttcagtgttctagatcatatatctttttccatgcttttagaatgcatttgtcaactttcacgttttaaaaatccagttacagttttgattcagggtgcattcactatgtagattaatttgggatcacaatgaatttctgttaattttgagaaaatttatatttctgatattttcctatctaggaatatgctgttttttcacttattcagcacttcttttatgtctttccataaaattttatactatgagtcatagaactcatattttttgctaagtttagccatatatattttttaatgtttgttttataaatgagctcttttcacctcattgaaattactaatttattatttctgacatacagaaaagctgttgacttttgtacttggccattctgctaaattctcttattagttctaacatcaatttattctctttaactttctctaataatacctggaaataatgataattttgtttattccttcctaatatttttatctgttatttctttgtcttgtcatgcattgaccagaacctagacaacaatgctgagagtagtgatactgttgatggggtgtgcctacccaacagttgtagaagtttttgtttctaatgtttgctgcttatgaaacataagatggtaattaacaggtgattgctggaagttcttggcttggttcccacacctgaaaagcatttgtgatttactgaaaaccagtgcatgttgaaggcttcccagccttacataattgagattcactttgactgtcatattgccaaaaatggactcaaaccctgaagttgtatccataccatcttgagaatcagttgtttgaagcgtcacccattgtttctaaccatttttgttataaagataatacacacagagagaagcgcctgcagtgaatctttgtgtaaccatcatgcagatcaggagacaaaccatggcggcccctcagaactctgccacgtgtttcttcccatcttttgctgctgctgctcccagaagtaaccctattccgacttttctgggttttcttggtaatcaatttctggtttttctttatagagttgttgcctaagtatgcacccttcaacacgatactgttgttttgcttgtactttttgttaactgtacatataataaattatgttatatatttctttattgcaggctcctttaatccagtgttatgtttgggagacgcacccatacaactgcatgtcaccgtagcttgttcatttccagtgtcgtgtagtgtcccttcatgtgaatttatcacagtttattagtatcttccactctgatggacatttggtagttggaattttcattactaatgatgcccctgcctgtggtcattcctgcctgcctcttgatgcacacaggcacgcatttctgctgggtatgtcctagttccagactcactggttatacggtatggatgtaattattgttagttttccagtgtgattaaacatcagattagcgcccattagcaatgtctgaggctgcctgttgctccactcgggtgcccgtttggtattaggagcttcttcagccattcttgtgtttgtgttcatgtatctcattgtggttttaattttcatttctataatgactaatgtggttgaatatgtttttgtatgattatttgccatttgtatttgctctttttaaagtatttgtacaggactttcacccattctcttattgtgttgccttatataggaattatttctatgttctagatatggatcctttgctggccatatatgttgaaagtatctccactctttggcttgcctttcattattttaattgtgtcttgctgaacagaaggttttaatgtcaaggtagtttttagtcaatcccctcatttatgattggtgcattttgtcaggtttaagaagtcttttctctcccataagaacgtgaagaaaacatattctcctatgttttatagaccataggttggcaaacttttttctgtaaaggactaaatagtaaacattttaagctttgtggaccacagatagtctctgctacatattcatcttaaaaaaaaaaaaagaataacctttagaagtataaaaaccattcttagatgctgggccagagtgggccaggctgtactttgcctgttcctgttctagaagtcacagttatttgctctcacctttacagttatgatttcagttgcagttggttttgttttttgttgtttgggtttacagcatgagacatgggacatctctaaatggatatttattcatgttgagaagtccatttattccccatgtctatgcagtgacccctttgtcacaagtgaaatgagtctgtttctcagttgtctattccattttattgtcctatttgcttattctcccaccataccgcactactttaattattgtagctttataacaaattttcaaatctaatagagaaagtacttcatttgttctttttacaactgtcttggttattcttggttaagacatttccattagtatataaatgaatcagtttgtcacatttcagtttcagagtaatttttaaaagaactttttctttttgaaatgtagagaaggtttttagaaaatctttttcttcttgaaattgtagagaaacatctctacaattttgagtcatcaaatctgtaaacatattatagtcctccatttgttgaggttgtcttaatctttcccaatcatgacttaaagcctttccctacagaagtcttgcatacattttgttggatttattattaggtagatgaatatttaaatatatataatctattgtaagtgttatgcatttattaattggcagtgcttccttaagtgtttgttggagcatgctgctgaaagcatcttggcttatacatttccatagaagatttaaaattataggacactaggtttcctgatatttttgtttttttaaaaatcaacttattttgttttactgcaatttttttttgttaagagacagagtctcactatgttgcccagactggcttcaaattcctggactcaaacaattctcccacctcagcctcctaaaaagctggaactatggatgcacaccactgtgcccacctctaatttcctttttttcctgatctttctggctggttgcttaccaattttactcacctttttaatgaccccacttctggttttactgctttttcttatttttttgtttgttttctgtttcatcagtttcctatatgagatcaacccacagacatacaattttatttgagcatttgtattgcttagaaagcatttataaaattttattaaattcttctcgacatttttctttcagcatggcattacactgcagattaataatttccaattaaaggttgggtggaagctcttcaattgcacagttaaaaagactttgaaatatggagatttctttttgtacttgccttgggatccacaaaaaacaaaacactaccagaacagtaatttgtgctcagaaattatatccactgtaaatttctgtgggaatagaaatctggagaagtaaatgaacagctgatgtttcttatgattcagttgttacttttcatcacaataactttactgaattttaagcatataattactgttttgccttgtaactttaggttgaatttatttttaaaaaatataaagtccgatttacaaagctatttaatgtttgataacaatagttgaaggaaattcttttgattcagaaaaattttaatatcaaacctgaaccataaaaattgcagtaaaacgttactacctctgctaagtcattgaagtgctttgtgatacagtatgtcaggatatccagcttcagtttctgactaaatttcatagaaatgattgtcattaggtccgtgagcatcaatgaagtacaccattgattacactctttaaataatgtgcaatagattcagattcacatattttatgcagagtacctgctagtaggtaatatagtaaccataggccttaacattttcataagtttttcagtttagccaactaatccttttttgcttcacacaatttcacaaccaccacttataacacatcttagcagattccacttcaggttgtaccgaagtagtactttctcatttttctgaaaatcttttctttggatttaaaaattttttctttgaaaatattcttgccatggccatagtttgccagctgttaatctagctttcaaaataagaaaccacaaagaagagaaaattgaaacatagacctagtagaagaaaggcaataatgaaaagcataaattaatgtaatggaaataaaaaaaatttttgagaaaatcaaagaaaccaatagcttatttcagttttgaagacatcaataaaaatgataaaactcaaactgagaaagagattacaaattacccaaattgatgtggtaagaggaaataagtacagatcctacagacattaaaagattatgaaggacatattataaacagttatgccagtaaatgtgacaacagacaaaatggacagaaacattgaaagacacaaactatcaaagctctctcaggaattcgtaacttagttgctgtggtgcctgtatgactgtacatgtcagtactcattgaactgtatgtatgaaaagatttaatttttctgtatgtgaaaattatctcaatttacttgactttaaaatattgtttaatgctgtcagtcatttgagctacacgtagatttaccatttttattcttttcatcctttctgtgtctgtagccttctttatgtgataatcctccttctgcctgaagaataccttttcagcagcagcaagctgaagccagccagctccgagagccagttctttaatttacgagaattttatgagctggctgtcaaacacacccattagtaaaattcgaattatataaatttacagttaaatacattatgtttggaaagagaacacacattcaaaactgattccttccaattattgtactaattgtgctgttatccataccttggaggccatttttatgatgctgtgatactccacatttagtgctgtcaccttggtagcttgaagtcagtcctggtaggaatatttacacagcagaaattagcaaatgctactaattagaagtttatttgattatctagaccagaggttggtaaactatggcctggggctggggctggacatctttttttttttggtaaataagtatttgtcaacacagccacactcatttgtttatgtcttgtctgtggctgctttcatagctcagtagcagtcaagtgggagcaactgagacttccggcccacaaaacacaatatatttactatctggccctttgagaaaatgtttgccaaccaaaatctagatttcaaaatgtgatggagaagatgttagtaaggtgcattcattttcagatgtcttgtgtgtaactgttacattttgaatagctccagaaatttagcccctcttccagtggttaaaagtatcatctcattcaacaaagaaatcgctcatgtcattgccgaagacgtgaagttctgacataacatcttcatcacctctgtctcgtcactttgcagcattcatgtagaactgtgtgttcaccagttgcaaccacagattggctatggacatgagtttggcaaatatcaacaaagtcatgctataagaatcagctggctatacagaatttacaacaaagagtattgtgtattgaattatttgtaaattgtatacttcacatcctttatatcagtagagtttattctttaagaaatgcacatctacatgaatacttgttttggaatgccagctaaacatttatcagtacaccattgcctttatttcatttcacagggaattgctggcaagttctggtttcagtttcttttttagaaaatgtcttaattgtatctgtatttttatatcatttgttataggggtctaggtttccagttattttattcagaatccagagatactgtgactttttcttcaggcttccatcattcttcttgagaagtcagctcttctttcaagtaatgtcttttctctaaattgagatctgactaggtgtggacaccttttatttatcttgctttgagatcacagggattcctgaatctatagctcaatgtctttcaacagtttcagaatgttctcatctcttacttcttcagaggttatttttgctccattcccttgaatttccttctttgaacccatttacgcatcggtacacttccctgtatcttctaaatctcttgttctccgttatttcccattattttatatccgtggggtccattgtgttgatttcttctgatcgctctaacagttcattagttttctttgctactgtgcctaatttggttttaaacccattcatagaatacattatttcaatgatttctcaattctagtattttcatttttttaaatagttggtgattctttcctgaatttgagatcttagcttttttcctgcttgaaggtagtaaagcatagttattttacattccaacacctggaatccctgtgatctattttttgtctttatttctgccatttttgttcatattgtcttatctcctcgtgggtctagttgttttttattttgtgccatattagtacattggagaaacagtgtgtagaaatgacgtattgcccgggaggatgttttcttcctctagcagtgcttggggcaccggcagtgtgggatcagctcattctaatcctagggattaatacgatcagagcagggctgtggctcttttgaggtttgctctagtgacagctcacttttactcctacaaggtggccattcagattcttcccccaagttgagggtgctcaaaggaccctgcaagacactgtctgttgccccagggcagtcacctcgcaggaatggtgcttcatcccagggtaggggcagctcctgtgctgctgtttcctcctgtacgctggcccaaaattgtcgctgtctgctcttagaatatgacccactcctttcataaagctgagttcaaatcccacatcccaatttaaaaaaaaaaatcatgttataagcaacactaacaacaaatccacttttctctcagccctgcccacctccccatcttcctttctgagacatgcagcatttctctgcaacaagcaaaattttgtatgtgcaaacacaccctcccaccccaaactttattttagtctctgtgtcttggttaaggtgtcttcctcgcagtgcctgccaccttgcggtcgagcccagctggcaaatgaagctgagctccagttctgcctgatgcaccaccccatgccttggtcttctgctggaggctgggggaggtgagcactggccaaggaccagccctctggttctgtccacatcggcttgatgcccattcaggggttgcaagttctcctggtctggatctattagttgaagaaattgccacctcgtaatttcaaattagtgggaattaaaaatttaatgggatgtatgtattttttggatcatatgaaactatgttttatgtggtatttaatgtgagtttaaatatgcttactaaatatgacttttgttaatatctcagttgatgctcgtgcgaaaaaagtctgcctttctacctttctttcctacctttctgccaaacccagtccttttactaatattttaaagtattgatttgaagcagcagtgtggttgcttctgtctgggtttgaacaagtaactgaattttaattcctgagacctcttacatatagcaattgtcttggctgttgtaggaaggcagcaccctcattcctctgatttagctctctttgattctacaggaagttgttgccactgtctctttttattaaactaaatgccagaattctttcatgtcatcataagatgttaatgcatattgctttggggaccaaagtcatacaattagaaaccactcaaatgcttttttattctaattctgaggttaccaattccttaaaattagtaaattttcactgattttgcaagccagttgtaaaaaaaaaaaatagtataaactcctcactgacggtagtttggaagctgcattgtttggatgtgatgtttcagtgccacacacgttagcggtgggaactggaagccagtcacgaatcggctatctgcttcagggatctggctttgcactcctgcccctgcccctgaagtggctctagggacagctgtggtttgagtggactcttgctccttcctgacctcttaatggccacatggacccccttgcttatctttgagagcagggccttgatggaaatgcaaatgtgtttctctttggtaacccagataccaaaaccaagtgcagtcctggaaggtgaaaagagtttccaaaggaaaaataaaagacacatttctaggaagcatgggaaaaccttggtggctttgtcctctggtgacagcagcctgggggaggtggagtagctgggatgcccccagctttcgcctcccctgggctctatcctgcatgttcttggtccatagccctctgtgggccatatctttccagcatcagtacctgttggggtccgtgctaggaacacagcagtgagagatgaagatgtggcctccctgaccgcctggagtccacagtgcaggggaggagggtgactttcaacaactaatgaacaaagcgtggctcagtcgtagctgagagaggcactgcccaggagaagtatgaggcatcgtgggagcatttatcagagtcagaggaggcttctttgagaggtagcttttaaatgagatctgaaccacgtggaacaagtaagagctcacgagtgcctgtgaagaaggaccccaccttgcacttgggggacccgaggaggacctgtgtgcttgccgtgcaaagcagcaggacagaggacccagctgagggccaggcgggagcaagggcccagcacactgggaggtttgagagggtgtcaggaggccatttggatggagaagccacgggcaaccagaggagtttcgtctcgagtcctcaccctggctgtagtgtggtgagcacattggatttggagaggttaggcagatgcaggcaggccagttactggaccatcatggtggtctaggcagggaatgactgggtttagactagtagaaggatgacagcagtgacgtctgtaagtggacagattgccggaagagttaggagttaaaacgaggactttgtgattaaatagggccaaagaggaggataaggcaggcgtgggcccgtgttgctggcatgtgtgactagcaggaggggagtccccatcagaaggggaaacagagcaggaagccaggagtggcgggaacaacgcttcaaccttgggcctgctcttgttgaggtccagggaaccagtgggtcggatccgtgagcatgcaggcatggagctcagagaagcagcatgtgtcagagatatggcctgagagccacacacccactgctgctgctgtgatctccttgggtgagagcatcagggagaagagagaaagacccagtaggtggtgtcgccaagggagcaggccgtggtgacagaggctggtggaaccatcgggaaaaagggtgccagagcccatttccctgtggcagccaccaccccctcctcacaacacccaccaggtcccttttccttaaatcaaaacctggtggatttcaggggcaggcgctgctcagttgtggcctctgcaaggtcccggccatgtgtcaccattgagtagctgctacctggcactgcgccgggctctcatgagcacatgtgagtgagggagggaaggggctccattggctgagcagggtgcaccctacctctcctgtaactcccaggagtggccgtcccacacccagatggggagtcggggtgaagccaccatcctgtgcgtgaatcaatggaaggcaaggctggactcacccccgcctttccccagggcattgggccggatgttactgagcctccttcacttcctcttccctgtggccgccccccgaccttcatttccttggtaatgggacactttggccgctgtcatggttggccaggctcggtgtgggcggcacccaccagttccttctgtgaacatacaggttgatggcaacagcgctggggccatggggatgactgcggggagaagggctcatggcagagcaagcgcagtggaccctctccctctggccagtgttcttctgtgaagaggtgcatctctgcgtctctgcggcgtactctgcgagggtccctgtggaagtggctgagatcagcaagacgacgtgtttgcaggggttgggccacaccaggctctgcacgtgacatggagcctgcagctggaagaacagtctgtttaataaaaaataaccatttgataattataatcacttttaaattgataaatggattcttttaaataaaagaaaccattaagaatgattgttctgcagaaaaagcacatgaggaaatgaaattttctatctcattgggaatttcttggtaaatatgcaagcagatacatacattacatttagattttagaagtaaaatgacctcatatactttacttttttagcacagagaattctgtatagcataaagcagtaaatcacagatactgggcattatgagtgtatttttcttttggaaaaaaaaacattgaaaaagcagagttattaattggagtcctcaaggtccttatttcagtaaatctgaaatggtgaccatcttacccatagctaagttgggatgccaaagccatttccaccatcagcgtgctagtagtaaccatccaggggcaaagcggctgattctgcagcctgggcatgtggtatgtgggtgtctctgatgggccaagggaaatgacaggcccttgtgctgaagactgataggagttgatttacatgaaacacatgtgtttttttttttaaagacaattttaatgcacatattttcattttcagctttatagtgttttatgtcttttgcctttgtgatttaaattgtcttatattatttataagcattttctattatttataattatttttaatgattttatgtaataccattttatttctagcttgacctgagttggcctatgctaacacatttaagctttcctaattcccaaggttaccataaatcagcaggtccctaacttctgtattcatctctgccctgtagagaatagccaacctcaggttttcgcagccatgcctcatctctctgtttctctaaagggaagccatagcaggtgcctgggtaatgtccagatctgaaaaatcccatgtaacctggagttgagggcctgtctttcacccagtctgtttgtaagcagtgcctctgcccccaccatgtccccacctgacaggccagctcaacacctgcctgcctcctcgtccctgctctaacactagtcagggcgcacagcccagcgaagtgctctgtctgctgggaggaggtactggctgtgatcggactgccccccacaaagccctgagcaggtgaagggtgtgggccagccgggggcgaaggaacaggtcaccgaggccactgccagcaccaccaagaatcaggccaggttccgggggcatctctgtccccaccagcagcactgcccttcagctttttgatgaggccggttgttggccataagaggagcggtgataagtttagattgttttggtgtctgtaggtcattactggaattacaccagccagccatgaggtcataaagttaccttgacagattgtgaatgccgagtccacagtaactctggagggctgcctggcatcgtccttcatcattgtccagaaacgctcctctcgggaaggctgggcgtaaaactgaaaagaggaggctcaaggaaagaacgcctcggtggctccatgcaggaaacattatttctgatttcaagctggagagagaaaggactttggggcccctgttttggaggcctggagtgatgagtactgtgtctccaagctcagaatgaagccaccagtggtggctgcctttgtttctgcactttcagttcctgcaggtgcaggagcttgccagggctgctgtcagggacacttttccaggccccgctgccctggctgggtttccttctctgagcaggaacaagtgcccgatgctgttgctggtgcagattggagggctgccagggctgggtgactccctgccgcattttgccaagcttgtgtagctgcttctgcctcttggaggggctgtgttagaaagcatgcatcacctccagttacctcaggcagcaggaaagacttttaacctactaaacaagcgtcttccctgggaaaatacatcctttggttgagactgtaggagacacactgtaagttatttatcttgaaccctaaactgcatgtaaaaaatgtaaccaaaccctcagtgcctggggcgaaatccactccctaatgttttaatgacacaggatccactatgctacgtgtgcaccgggtgtagacttggtccagtgcatgtggtgctaagccataagggactgttaggaagagccgggcatggtggctcatgcctgtggtcccagcactttgggaggccgaggtgggtagatcacttgaagtcgggagttcgagaccagtcccggccaacatggcaaaaccctgtctctactaaaaatacaaaaactcgccgagcgtggtggtgcacacctgtaatcccagctactcgggaggctgaggtgggaggatcgcttgaacccaggaggcagaggttgcagtgagccaagatcatgccattgctctccagcctggatgacagactgagactccatctcaaaaaaaaaaaaaagaatcgtgatattcttgataggaagtaaatgttagtcataggattacaagattttattctaagctcttacaagcaagcagttcagattaatgtgttttcttagaaaacttgatttgattaaatttcatactttttatctattccccaaaatttatgcggtccttgtgtgcttgagggttctaggaacaaagtgattggggaaacaccggtcccctctgctgtgggaccctgcgggcttccagaactggcgtgaggtccgagtcgctgtgggaccctgcgggcttccacaactggcatgaggtctgagtcccggtgtttcacaatattacttgaccaaagagcgtttttttcacaaacacatgaggcagcccatgtgactccagggacccgcaaagcacagcttgagaaatgttggtatgtttcaatggaaatgtatgtaattaagaatattagtacaatatttattaaaagtttctgtcttgaatgaagtaataggatatcctttaggaagcctgatgtcgggacgtgctgtggggtatttttatgttaggtgttaacattcagcaaacaaatccaggctctacttttatcctttaatgaaagattttattttttattcagcattggtgcattgaggacttacagccatcttatcttacctcgatgccattgaaacaaaaaaattagtcatagaaaacaaacctaatgccttcctttgcaagttccagtcagaagtgtcgcatataccagacaacacatcatttttatagttatagagagaactcctatgtacttcatgggaatacaaaaatgtcacaaaattaaaaggaatttttccaaaattactgtgactgaacagatcattccacgctccgttataccattctgatcctaatcccatagtttaagtgtagaggctggaaaatgtcttcgatttagaaaggaaagacaggcgagtgctgtacaatggtgcaattcagtggccaacgagcccagcagtcgcagaccccatacattcctctcgttcatatcctatcgatttgtgacagcgatcacatgctattgtagtacaaggaagaggtttttttaaccgactgtatgacttgtagacttttctgtgaattttcattaaggttggtgaattgtacaagctgaggaaagccaagacaagctagttaaaatctcctggcacacaggtcagcctgagttcagattttatttcgcgggcatgattttggggatcccgtgctagattgtagttgtgttgtaataaagccccctttccagcgctgcagtgggttgtggaaattgttgagaggagaaaccaccttctcctaggcatctgtatttggttacccgccagcactgagacatgcaggcatggaaaggcagactcaggaaggttcaggaattctaccgactttggagcatgctctcccccggatctgaaacactggcccccgtcttatccacccaccactccttaagacatccaggcgtggaagggaagattcaggaaggttcaggaattctaccgactttggagcatgctctcccctggatctgaaacactggcccccgccttctccgcctcccgctcctttaaccagtcgtcaggtatttcctcaggtacccgctctgggaagccttccctgaccctcctttgcccccgtggggacgtggctgctgcttcccccgtgtgcctgtggccccttgtgcccagcgccatcgccactccgtgagggtagatgtgggtgccggccgtgtctgatgcctccccacaggggccttgggcacgctgtgtggacgctgcctgtgcgtgcttcctgagcgaccccatcagtaaagcgtcgccaccatgcaatgctgctggcagtccttgtactgagacaatgtggtagctgccatcctgaatttccctctgaaactgctcccaccaccagtgctgcctgtgctgtggccctgctttgtgtcctgtggcctaacactggagcgccggctgctacctgtctgtctcctgtgctggacaggaagcaccatgcaggcggcgttgtcgtccgatggtctccacctgtggccgtagcaccgggtgcgctgtggactgggacacttccatgtcactccacacgtgtgccccgctgtggcactgtaaatattcatttgagctggtaaggaaaatgacattttaaatgccatgatgatatatagtgtatttctcatgtgaatcacgttttccttagtatggctcagcagcacgccatgtttccgtcccatagagaccatgcttcctgtggggacgcccatggtcctggctacctctgctgaaagacggccaaggtgactcttcagctataagagagatcactcatcctggaaacttgtcagagcaggagaattccagaaggatcaatatttttaaaaaattctgttcctaaacttttgctctgcaaaaggtcttgtaaaaagagaacagagacaagtcagcccaggagaaaataccattgacctttgaacaacacagacttgaactctgtgggtccacttacatgtggatttttttcaaccaaatgtggatggaaatatagtgttcacaggatatgaaaaccgtgtatatggagggccagcttttcatatacacagaatctacagggctgattgtaggacttgtgtaggtgcagatttttgtatccatgaaatcctggaggcactcaccagcatataccgaggaacaactgtatttgcaaatcccatatctgacagaggagttgtattcagaacatgaaaccaactctctaaactcaaaaataagaaaataaacattccagctagaaattggacaaacaatctgaacagagacttcatccaagaggagatacgtaggaccataagcacaggaaacaatgtttattgttagccaacagagaaatgcaaatcagagcctcagtgaggttccacgcagagaccacacactcctacagccactcggagaccacgtggccacttcccagaaagttaagcatctgtttccacaggaaccggaagttgtacttctgctcttgtatcctaaagaaaggaaaacttatgtccacacaaaaactgtacacaagtgtccatgtcaactttatttgtagtgacccccaaattggaagcaattcagatgtccttccaaagatgaaagaaaaagcaaactgtggtctatccatacaatggaatacttatgaaaacagaataaaaagcagccaactattgatacacggtacaatttggatggatctaaagggcattaggtggagtaaaggaagctaatcctaaaagataggattttttttgtatgtaacactcttgaaatgacaagcagtgatggggaagagataagggttaacagagactggggacagatgacttcgtaggtgtagcctgacaggtgtctttgtgatgagacagttcagtatcctgtctggggttttgtgcatgtaaatctaaacacattataaaatttcattttaaaacataatttttaaaagtccattaaaaataaaaatacataagaatttaaaatgtttgtaaaaactggtgacatcaaataagataggtagtttagttagatgtattgtatcaatgccagcttcctggttttggtaacgcatgattatgtagaaagttaagctgaatgaaggtgcctgggaactgtcactaatatttttcttgtgaatcttcaatttcaaactataaagtttaaaaaaatttgtgccttttacataccagttttttgttgtttttgagacggagtttcactctgtcactcaggctggagtgcagtggcgcagtcttggctcattgcaaacttcatctcccgggttcaagcgattctcctgcctcagcctcccaagtagctgggattataggcgcacgccaccatgtccggctaattttcatatttttggtacagatggggtttcaccatgttggccaggctggcctcaaactcctgacctcaagtgatccaccagcctcggcctccctaagtgccgggattacaggcgtgagccaccacgcccagcccatacccatttttaaaaagagaaaatggacaagagagcagggaatggcgttggctttgctgctgtgagtcttggaaaacccatttccagtgcaagtgcctgcgtaggagtacgggggcagcattcttgtaatgaaagtgagccctaaagccaaaaggtgatattccccctgaaatttaggaaagaaaggaaactcttaggctggaaaaatgtggctgaacttgatactgttcatttgatggttctttgattagcctcattacctagtatttgaacaacataaaaaattggttaagaatagccaaagagaaaatgcccgggtgagtgctaggcgtccatacacatggcagcttttaacaacgtgcagccatgaaatatggaaaacttcctgacgttgatcacagttgaaacttcatactttcttaattcagcctcttattgacagtaatatattttaactcaagaatgtgttcattcagtgtatattgacttggcttgttgaaatgttcacagtacatgtgaacactgggtttcctgtcatgatgacttaagacaggaggacagcagtgagtgattcctgccagtcaaggaactttccctggaaccccacttgaatggtaataatctgctcctataattgctgtggaaaaggaaagccctctggagattttacatctaatcatttatttataaatctgtagatggcagtctgcagaagatgtgtcaggggtcaactttgtgctcaaaacagttgcctgatgtttacatttcacagtgtatttttttaacagtacctccagcccccatcatcacaaaaggaccctggcttgctggtagctgctccccactcatcccacagcccagacacttcattacagatgcctcggcagaggctggtcccctctgtatttgctgaaatatgcatgtttttccatctcattaattcagtctacatacaattaatttttgcctattaataaaccccttggtgttagcgacagctatctaaaccacttcacctagtgtggaatgagcaagtgtacttgcaaatttccatccctggtctgcattttttagtgttgtatttgtgggttggagagtttgggtgcataaatcaagcattgtgaagaaatataactgccgaagactctgggttcagactggctgatgggaagtttgaaatacgaattagttccacattaattggggatagagggagatgcaggggggccatcccagcacgtggtagtcagggagggtctctggctatgggaaaatttgtcagccttgtatgtgcgtgagaccaactttctttttccacaaatacaaatcctctccaaattggacacttctcaaaagatatcttttctgtgtgttttcaaatctcataatttcttaaacatctaataaagtctgtgaatacacgtaagtgattgtgtatgtggtaactacaccagccaacagcattgaaaggaaaaaggaagaaaacacaaaaatcagaatggagccttgaagttgagatgagcaccacctagctcatttagagacatccacaggaaaggaggttccccaagacttttgttatgctccaaagccctgagacagatccatgtcacaaggacacctttctcatggttcaacatcaccagccaggaggaaatgcagaattctgtataaatgttaggaattcttagatttctcacctggatttgtaaaaattgcagttcatggcgagagacatccgggagatccaaatgccatcctcctagaacttgctggaggaaccagattctttctaagcgatttgcatcttgatgtgatgctacagttctatgacaggcccgagtagctgatgaaattctacgtgggaaaagcttttgagtgcctgtcctggtaaacctgtgacagtggcatcacataaaggtttccagaatgttctgtgaggagattgagccaatgtcgttggtcagcttaattggaagcaggtgattgaaagtcagataaacatgcaagatttgctgatttttaaatatgccatatgtgtcaaatgtatgaattgtgatgatggacaagaacactttcgcagctttaatgggagcatgtaatgacttgaacaagactgcttagttttggttactgatgatcaagtacagaatcttgctggtgtctccaaaacttcctgcctggcctgggcagctgtcctggctccctctggccagttctctgccaggcagccagtgtgaatctggaaggggctagtcctgtcttcccctccctgtctagtgcctttaacgtctccgctgagcctgccacctcctggcctcctcgaccctccacctccccgagccgtggaggtgagtcctagaccttcttctgtgggctcctctccccggggccctttcggctcagccccacttctcttattcacccacttgtgttctctgtagctaaatgatacataacaggaactcgttaagtagcttgtgcagtgaatgagttaatcctaggtgttttcagaacagtgaatttcaggttcctgactccgctttgagctcattcaaagaaagtcatgtaaataagacctaatcattgcaagaagtctaatgaagaaaccattcattatctctggagatgggcaggtacacctcacagaaagtgaagtctgttgctgatgaatagtctgcatgcccacatcttcctctgggtttctaagtaattgaataagaaacgtttctatttatattcttatttatgtgcaactgtatttaattattccctagttttgaggattggccaataaaccttttcttcccttttgccattgattattcttaagtttaagacaatgcccagtggcagatgtgcttaaccgccatccttcatctagttcatgtgactttttaatgtcaattataaagaaaattactcctttggcttcagaagtttatttaaatctcttctgagaaaattggcagctcttcggagttaatgtccagagcagcagaaacagaaactggagggcacagactggtggatatgtgaacagaagcactttttttaaacaaagttaaaaaaaaaatgttatgctattgctaataaattgagtcaggggaaagaaaaaaaaaagagatccctaaatcagcttccaagctgccattaagatgggcaagtaagataattccacataaataagaccagaggccttgtctctgtttttatttatgtatttattttattatttttttgagacagagtctcgctttgttgcccaggctggagtacagtggtgtgatctcctctcactgcaacctctgcctcccgggttcaagggattcccctaccttagcctcccaagtagctaggattacaggcgcccaccaccacatccgactaatttttgtatttttggtagaaatggggttttctgctgctctcaaactcctgacctcaagtgatccacccacctgggcctcccaaagtgctgggattatagacatgtgccaccgtgcccggcctgccagggctgtttttaaatgaggatttctccatttaaggaggtcacctgtcctggacggtatttcctaaatgcctggcataggtgacatcatgcgaacaagtgatggttcagaatacagaagtcatgagtttgaaggttgtgatagaggaaggccgggagagaagtgagaacagaacgtgcttgccctgggcctgcagctgttgccagcatcttctgtcagctgatctgggcagggcgtgggggttcttctcaggcctacctcctaagaacaaaaacatgactgaccacgagcctgtcctcaggatgcagcctccatccttggtgggcacagctgagagaggaagttctgagctgctttggggtagggctctgttgcactcaccctcccatctccttagtcgctgcaaccctgtgtcgcaaatagtaggttctcagcaagtgtgctgaaccaaggggtaagaacaacgtttttatttttttatttaatttatttttattttttgtttttacatttattttttaatccatttggaatttttctttttgagatatatataatagggatgaacttttatttcatttttctagacaggtgtacagttaccttaggtacatatattgaattgttatgtctcaccaatgcaccacaacgtagcagtctctcatagcccgacgtatcacccaaagttctttgtctcacgaccaagaaagttaaggagcgccgacgccaagggtatcactggactgaaaatttaataagcaaaagaagaaagctctctggtgcacaggggggacccagaagagggttgctgtttttacagttgaatgcaaaggcttttataggaaactgatgagagctgggcatcttatttgcatacggtgcaaatctgtggtagctccaccccgtcctcctagtgcacacgtaggcccttagcttgagttactccatattgctttgtttcccttactgtgcatgtgtcaggggacaaaatttttcattgtgggcatgtctgggaaactcacatgtgtagccctttttttttttttttatactttaagttctagggtacatgtgcacaacgtgcaggtttgttacgtatgtatacatgtgccatgttggtgtgctgcacccattaactcatcacttacattaggtatatctcctaatgctatccctcccccagccccccaccccacaacaggccctggtgtgtgatgttccccttcctgtgtccaagtgttctcattgttcagttcccacctatgagtgagaacacatggtgtttggttttctgtccttgcaatagtttgctgagaatgatggtttccagcttcatccatgtccctataaaagacatgaactcatcattttttatggctgcatagtattccatggtgtatatgtgccacattttcttaatccagtctatcatggatggacatttggcttggtctttgctattgtgaatagtgccacagtaaacatacgtgtgcatgtgcctttatagcagcatgatttataatccttggggtatatgtccagtaatgggttggctgggccaaatggtatttctagttctagatccttgaggaatcgccacactgacttccacaatggttgaactagtttacagtcccaccaacagtattaaagtgttcctatttctccacatcctctccagcacctgttgtttcctggctttttaatgatcgccattctaactggtgtgagatggtatctcattgtggttttgatttgcatttctctgatggccagtgatggtgagcattttttcatgtgtctgttggctgcgtaaatgtcttcttttgagaagtctctgttcatatccttcacccactttttgatggtgttgtttgatttttttcttgtaaatgtgtttaaattctttgtagatcctggatattagccctttgtcagatgggtagattgcaaaaattttctcccattctgtaggtcgcctgttccctctgatggtagtttattttgatgtgcagaagctctttagtttaaagacttcatgtctaaaacaccaaaagcaatggcaacaaaagccaaaattgacaaatggtatctaattaaactaaagaacaacgtttttattctgtatcatcaaggagggaacccagcacgcctctatccttttaagagacacggcaagcatcagacctgagggacatcatcatttccttgcagctcagaatgcacttaagtgtcatgtagtgggttttctgtttatgggtttgttttttttttagaaaatgtgttcttttctatcttttgtttgtttttgagacagggtctcgctgtgtcacccaggctggatggagtacagtggcaagatctcagctcactgcaacctcagcctcctgggtagctgagactacaggtgtgcaccaccacgcccagctaatttttgtattttttgtagagatggggtttagccactttgcccaggtttgtctcaaattcctggactcaagttgtccacctgccccagcctccaaagtgctgggattacaggtgtgtgccactgcgcccagcccaaccctgtcctttgtttcttacaatattcaacagtcagtcacttctagctttcactttgtcccataaaaatatttcattgaaaattgcaagccatggcagtttgcagtgtttctaagctgaggagttcagctccacacccaacagagctccagcttctggtttgattcttagagataggagtgacttttttcaatcatgtacatcataattaggaggaaggcattcagtcttgaacatggggacaaaaaagtgctggagatagtagcttgagagttgcaaatatttattttgattctgactttaattcttaaaaatgtttgtcaagaagacagtggtgtgatggagcaggtccttcggttaccacaagcacacaccctttctctgtagtcttatagcttgttttcttggtcgattgtgccagctcttataaaaatattatgctcccaggcaaagggccatttctgttggaattgttgagaagattcttggcttaactcttgatccaactctgatcagcttggccaagactagacttgacaagtttgctctgaattgcctcatgctgctgtgtggggtttcaaatcattggcttcccagtgctttctgggctagaccaacaaaacaatgcctgggaaaagagagatgataggccgtgataaaactaaaactgcgtaatactggaattaactgagttggccatgtagatggcaagatattaaaattgagtccttgtgtgccaaagtcgtaaactcattcagataggccctaggtctgtgaatgtttgttgttgaatcctaggctctgggtggaaccgaaagctgaaaaacatgaaattccccctctgtcctttggatcttattcagacagtcatttcctagctatttcaagttttgatcaaaacagacacgcagtagaagcccagtctaaaacatcggtagtttatatcacatatttacttccatgtgtcttaagtggttaagttgtagaattatgtcttttagagaatggatgaagaagtctaggagtacaataggcaagagaatatagcaaagtagttatattttgtcaattttaaagtaaattctgaatcattttaagtatattcagtaacacccgtttgcccccaccttccttcctttgaggttttcacttattcactcattaataattcatcagtctttgctgtttgtggcatgagtatgtacaaaaggcactgcggcgtccattgctgtgagtaatatagagatgtccaaaggtgtggctttacctgtggaaaccacaggaccatacccagagcatttggaggtgccatatgctgcttaagggtggcacatggaggggaggctgggctgcacgcatgctggtcctgaggtgaccctctggccgcaggagagctggaaaggtgccagccgtgggtgccatgcacttgtctgaggccaggatggggagaccacattccaggtacagggataagaggaggaaagtcccaggagtgggaaggcctgggggaaaaggggagaaggtcagggggaggcaagttggccagatcggctggagcttgggattcagccaggacagagcctgagccccaggccagactgcagggctgtgcccagcactggatgcagagtttggatctgattctgagtatgtggtgatgactcggggaggcttgtgagcaggatggtgacaaccaggcaggattttaggaaggtttgtctggttttggcaggttctctggatgtgactggagtgtgaagaggccagtttagaggctctggaggttgttcagaagtggcaacaaaagggaatggaaataagagatgttgcaaagcagaaaccaactgacatggagtgcgggagaacttgaaggcagcagtgggaactgggagctgttcccggcgtggggagaaggctgacgttgatgttgcctaaggagttagaggtgatgaccaggttccaggtggctgatctggataggcagctgcatggggcaggagccccagtgtggcacagctgtgtctgtcccctgccggtcctcagaaagtgacacctaacactgtcccagtccacacagagccttgtccagtagtcagggtgaggtgagtggaagcaagaagaggagctggcaacaggacttgggagaggcggagagcacagcaggcagctgggcccagacgtcagccccaggcagtgtcctgaagcagcgtgtgcacctgggcagtgcaggcatcgcgagtaagaagagggtgttagctcggataactggggctcctgagcagccttcaagaggacaggttccttggggctgtgggtttcaaataacatcatggaggagggagcagagaggcttgaaaataaacggcggtggccggggggagcacaaagaagccaggcctggcagtggcacaggtgtcaggggtttcatgaaggaggggcccgggagtgtgcctgccacatggacactggagcgaaggtgcaccctgaggcagcccacagtgaggaattcaaacgcagcttcctgggctggatcctgcagggcctgagttctctgttccaggggcatcttcatctgaggatttggggtgtccgtgccctctcctggttgaaagtgttagaagccacgttggagaggccaccactcaggtgctaaagttaaagctctagagtttggtgcctgccacttagctgcatggccttgggagttattcactcctctgcactttggttttctcgttaatcaaactggaatccagatactcacctcctaccttgttatgggaactagacgtgggcggtgcacgtgggggcaccgagcacagtgcccagcacccagtgggtgctcaggggatggcagctgccatgatttttgggactgaatgctttgataccacccaaatatatggtctgaggtggttgtaaatagaattagcagaggagatgatacagactcagagttgaattagggtttgaagaagggcttaggtctggagcgttacaggtgggaggaccagcagagagtggtcaggaatcaggaatgacaggacacacctggggagcctgagcggcggcttccaggcagggaagaaaagctcggggcagtatgagtccagaccaggggcctatcaggcgccttctatgcagggtcaggtggtaaagaattatctcagccttagtgggctagaagatctctgtcatagctattcagctccgttgctttctgagtaaacaaatgggcgtggctgtgttccaatgaaactttatttacaaaaacagatggtgggccagtttggtatgtggaggcatgttgactatggacaccttgaaaatcccatgtggcaacagatatgagccaagtggtgacgtggaatgccccatcgttgagggatggggacgcaagggcagcaaggaggtcctgtgggtccgggtgtggcgtgggcccagcgtggccatggcatctggggcctcagctgcagggttgcagtggaaggaaggggaaagaagctcagagtgcattctgagggtcaaactggcctgtaagtgacaaactgaggtcacttcacatgtacatggagggagacaggctgtctttggagcagtgtccatgcaagcctgcctggagggagctgccaccctcagctgcagccccagacctcgcggttgctctcatccgtcgttcccagtgtgggcagtgacgcagcaccacggtaagttctgtagagtggacgccactcgctggcaaagcccagcagggcaaggaataagtgtcactcagtctttatccagaaaaatccaccaatgtacttttagtgcagtattaacacatggtagaaaatggaattgcctagaggattttaatctctgatggattattcttgtacctgtacctgtctgatggtcgtgtaagtccatgttaacaaacctgggaccacaggaaaggagaactgatgcgaatacaaacaggtggaggatttccaggcgtcagtggggtctgggagacttttccaagaagtgttttcattgcagttaacatttttaaagatgaatatctcactattataaaggtcaatgccacttctgtaatattaatttgcaattgaaaggtattttcttttaagaagtcccctttttcaagtttctcaaactggaattttcttgagcatctaagaatcctttcctttcaaaagatccccaagttaccccggtctaagctaagaagggttcagcgttggccggaagcataactctagctctccaaggccttgggctgcggcagggtttgcatgtccaggcagtaggtggaggcttctcttggtcagtgtgtctgctcagggggaggcctggctggggaagcgggtagcagtttgggaccagagcttaaaagagaaggagagaccggtgcggtggctcaggcctataatcccagcactttgggaggatggggcaggtagatcacaaggtcgggagttcgagaccagactgaccaacatggtgaaaccccatctttactaaagatacaaaaattagcagggtgtggtggcgcacgcctataataccagctactcaggaggctgaggcaggagaatcacttgaacccgagaggtggaggttgcagtgagccgacatcatgctgctgcactgcagcgtgggcgacagagtgagattccatctaaaaagaaaaaaaaaaaagtgagactttgaaagtgatgacagtttccacagttcccatgggcaggtggctcagaatgaggtggcctgaggcccacagtctgtccttggggactgggtggcccccacgtccaggcagcagggagaggacgtgctggctgccaagatggggtgggagaagcccagggcatcaagtgccacggaaataaagctggttgccttagttgaatggcgcctttgagttcccagaagctcttctcagcgggaggctccctgtctttcacctctgctcttctgaggtaccagttgaagggtttggggggtgaaatcaaggcatagggctcctggcaacactacccctggctccggggtttgcatgccggggcttcttccttgtcctggctgtcagagaacacctggaaataaatgctgcattgttttgctggaaaatcctgacaccacctcctgccttcccctgggagggctgagacctggcctaggcatggagcttacggtccacagacctgcctgcctgcagcatgacagcctcccagagggctgtattgatttttgaagaggaggaaaaaggcatacaaaattggacttgccagccttctttgagtagaaattggtgcttcctaaagggaatcttaattggctagcttcgaagctaaaatgttttctcccccttcccttctcagaactctccagcccccctgtttgttcttgtgagacttttccaagccccagttacttttctttcctgctttggaacataattggattcttcgctgggtagagttttgcttggaagacctgagggtgtagctgaaccaagtttgagcaccctggaaggaagacagaagatgccgggagaccagccagctcaaaggagaaagggagggggacagcatctgaactctggcctccagcatgatttcatcctttaaactgaaaaccctgagtttcagtgccagcgacgacacttgttgaaaaagtacaaatgttttctgcttcttgtaatctacttcttgcaaatattagtactctggaaaaaagatttattttaataatgtgagtttcagatttttttctgtagttaacgttgttttattactctatatccttgccagaaagcgtgttttaagagtttcaattcaaaattaaatatgacctcagtgttttaaaatacaattatattaactgtccatttaatagttgctgaggatttttttggccactgatggatagtcaagatacttgtctgagattaaatgcagtattctcaactctgctaaccagctaacttgttccagctgcagcaatcaacaggaaaaacaagggctttctatgaagtgagctggagaaagttgttcccggataaaattgcagtactattctataagctgtgcttttcttttaaaaactccactgtgtttcataatagggaactatctattatttatttagaactgtacaaaccaatttacaagacaggtaatttagtgacagaattatttattaatgagcccaagtatacaagttaatgggaccgagccccgtggaggtcaatcctcatataatccatgccttttggaaagaaaagtattgtcttcagaacatttagttatgattgttaaatttaaattacgatatattctcttgctaagacaaaaaataattttttctgaattgcatgatgacagagttagtctgtaagctgtgtggagatgaattgtgtcaattaggggtaggtacatcttagccctgttggtaccaaaagtattatttctcattgcatgggctcacaggagaaagcaagcctgttctttaatagagacgacaaatcagaaaccgctgcctgcctgggagatggaacagtcgtgcaggcgaggagctcagagggcgggcgtggcttcccaagctctggcacagcctgcaggccttatcaggtgctctgcttctggggtactcggcactttgctcttccggtggatgggggaggggcgggctgttccatgtgacagcatgtgggcttgtcatgattcggggtgaccactggcttccatttcccaggagtggctttgtcctcgtggtcttacggtatgtttccagtagatgagaaggcatgcctacagacagggcctgctggtgtctgctgtgtgtcatggggggaggcaaggttttcctcactgggacctcttcactccccctttattaatgaccccctggctcctccccagaggcccagaagcctagaggagaaatgagggtacagcatagatgccttagtgtaacgagtggggctgctggaactcaacagactatttacagttacagcatgaaggtggtgcttgaaggatttgctgcttcgtttcatttttctcatttcatctcatcatgaagtcgattgcattatatcgggggtggggaatggaacagacacagaggagaacccaccaagttctgtgtcttcaaacctgcagcatttccaggttccgactgcagagtcctatcaaagtaagcaaaattggaagtgatgcccatttcctgggctttcacaaactttgttattctgcagtctaccacaaaatctgaaaaggcagagaaatgtagctttcactgtttagaaaatctttgtgagtttttcttccccctagggaatggttttcagcacattattcattggaaaaatgaaatctgaaatgtaggtgtattttcagtgcacgtgctccggaggagcctcagcacccttgtgtcttgtctacccattcgctcagtgggcagggattgagcactgggaatgtgctgggtcggagccgagggctggaggcagagttgggaccagccccaggatggtgcctggctgtttgtcccagggctcactggaacagccctcctgggcagcccttggttggacttctttacgcagcccagtccacacctcacctgtgcattcgtcaagccattgagtgcagtgttgtggcctgaatcactccaggccttgctttggagggttgacagtaggggacacggcaggccgggggcattctgggacccaggtctcctgcctatgtggaatactgatgtgtgttgtgtggacaggtcactgatgtgtttaaatgtaaatctgaccttcctttaagagcaattgggcagcagtctgggagcttgagactgtatgatgtggacacctagtatctctttctggaagcttctagtgtataatagaaagtaggttggttactcattcccattgtctttgaataatggggcagtgggcctggattgttgtcctgtggattggggaagagatcatagagatcatagaagtaaccttagagtaaaagaaagtaaatcaaaatgctattctatgtagaatatatgccatcaagggcagagcatgtgggcgtgtggacttgtcatgatgaggagtgaccactggcttccatttcaaagaggagagctggagtgcttctattccacggagatgccccagactaaggtctttggagtcaggctttcattccattcctgggtctgtcccttatgcgtttggtaagttgttattacataacctccggacctcagtttcctgttttagaaatagagataatggtacctcccccaagggtctttgggaggaataaatagaacagcttataatggaatgcctggcacatgttaggcactcagtaaatagcagctgtgcagtgttgtgcgagagcttacatcgagctgttttcccagagtgcattgatcctcaaccgtgttcatgtacccctgcccaaggtgccatattgtgtaatggagatgtgacgtcgaggcgccatgttgcctggaacttctggagtcagccaccttgcctgtggctgaccttggctgtgttcctgagagagtgaggatgtgaaattgcatgacacaaagtcggtcatcttgtgcccgtctcatctactctcactggtggttcagttcttctctgcccctaaattcttacatcccagagcaggttcttggttgagacacaggtgcttgcctcaggtttccttggaaaactccagtggcaccaagcggtcagtagcctgtagcggccacttgcactgttgtccccttttgtggacgtggacgttgactctccatgtctggtctgtgcaggaaagagtgagtcctctctttctcactccagagcctgcaggggtacccaccctcagccgggcagggcaagccaggacagaggctttgagggcatctgaggaggaaactgcaaggtgtgcagtttggcccagcagagagagaccagaatgcagagggtactcagggcaggcggttgctactctgggctgtgtgcgtcatagcgtttgcatgacagacaccagcggttgaccaaatgccccatttgaagcccatgtccaggcatgcagtgttgatctctgtgtatagatcgacgtggcttcttctctagggttggggaagagaactgtttaataatgcacagttgcctagcctcaaagatcctttgagaaatagctactctgtgcaagttttcaacaatttgtttagactaatggaatgactctttaaaagtttatatctttacagatatacaagcactttatttctaagcaactaatttaagctgggaaagaagaacgtgccctcatgtgtgtgtaaaacgttagaaagcagctctgttcactgccgtggtggtggaaggcatgtgcaacacagacataaggctatttgaactctttatttgccacatttacaatattaataatagcgtttctagaagttgtcacatcaagtaaaagatcttcattccaggctgtctttaggggccaaattgagactggatgcatgcatttaataaattgtagtctcacgtagtcatttttgtaaataattagtttcagtgaaagaataagttagcatattgtatgcatctaatgttgcaaatgtacatacagcaaactttgctattaatcaacagtcaggcatcgcaagtggggtctcatacataatgaattgtgcttaagcctcatgggcttcttgatagaaaaataaaagaaaacacaagtgcagtaagcttttgaataaaatttaactagattgctctgcatcctgtaattgttttggaatctttagggacctgatcattcatctatagttttggggtgtttttatcttcatctgtcaaatagtagagacttttaatgatatgttaaaatgttgataaaatacaattttccttttaatgatttgaacatttggaggggggaggtaaataggctttttaaggctttctgatctgccaagtatactatttgggttgtcttttaaaaatattttcattatttcctgtatttttaagaatcaattatttttaaaaagaaaaatatatatagtccttatggggaagagttgaaaatttacataaagtgttctctgtatttttggtgggtgttttaaaatactatggtaaatacctttgcagttttgtttaggatctgacattaatttgagccccagatattgagggcatagcgtgccagttaaaaatcggtatccagttttagcaagatacctacgaccacccagaaagtaacttggaacctaacttaattttaaatggcctctttctcctcttcacattattgacattagtacatgaacccgttggtggcctataataggatcataaacataggattcattttgggatggggttgaaggcataaaagcaaggagtgagatttatgtccacctttattatgaaccacacagtaaaagtgcagtaaagatctgctgacttgacagccagagctcctcacagccctcctgcaagcactcatggaacccggccttctccaggaagacctcctgtttacttctgcgctaggaatgggctgtgctcatcacttacttccctgtcttatatgatgtccttttgtacagaatgcatctttaaaataggccctacaactaaacacataacagtcaatcagtagactcacctgtgataagtgggaggccctcttgtaccagaaagtttaaaaaaaaaaatacattactcatacctgtcattgtttgttacgtaaacttaagcatatttttgatgttttgtgcgtgtttattcacttcttcctttcatagttgaacacatcttgttcttgaggttgcgttggaaatcagtagggtggcgcatgaatcactgagaacagcccacagtgtgtggtcagtgccatcgtcatcatcgtcatcagcaacggcagctcaagaccagcaaggccgcggttgtgtctgtcatgagcccgttggcatgccgtttgttttttatctttgccacagttgcactgttgagatccatgtttcctattactaacatcagcacttttaattttccgtttctactcagtttcctaaaagaactatagaatattcaaataattgcatgcgctttgtcaaacgtacatggtcatagtgcccaaacagttgctggccaccacgcagagccacggagcagtcactgccatgttccttcgcagcctccttggggcctccatgaaacatcggggccaatggaaggcggaagtgctgtttctgatgttgacctgtgtgtttgaccctcaccttcccttcctgcgcagtcggctgtcaactccagaggaagggacagccctgagtcagtattctcaccactaaccgcatgcatttcagatcctcagtaaatgattgaatgaaattaagccactgcatttgtctgaaatatagagtcaaaaggttttattcagcctcctgtttaaaataaaatgatctttattaagagcaggtagcatagtttatttcttttcttcagtcttacccctgaaagaaaacatctgagctttagcaggaagttataattaaatgcaggacaaatccatcaaacacaagacactctgctagagatctctaaatgggacataattgtgcatttaccagtgatatttagcaagagtctccatgcagcgtggataatctttggctgaaggcatgttccttcctacatgagccccggagtctgctgctctgcccttcagtcccgaagcctctcctggccctccacaccaggttctggaagccagaggaggtggggtgctcactagctgggtttggaaaatgttgctcatcacctgagcatctgaagtgctgtgtgtggcgaggccactaaaagcttttcagatccccaccagtttccgtgcaacctccttcacagcctcatggaagccttgcgtccaagctcggcaccttgccagattccagaggaactcagaggagcacctgtctttggaacgaactctttccttgggtgaccctccagggtggtcaggtagcattcccagaccataagatgaaaacgtcgtccatggagagagagaggaggtgttcgggtcacaggagaggcagagggtacacagcactccccatctggagtgtcccacggtcagcccgatggtgcctcagatgtgagtaacttatgaaggactcttggccgattttcttaaatcaaacaggattcaagccaagtacatcgtgtgttaatgtctctggggagtagaattcattcagaaatggacatttagtgattctctactgccagtggaatcttaaggcacccaaaaatctgaatacccaaatctcccagctggctggtcaagttttagaatgttgagcactctaaactgggaagagcctggtagccgtggtaccaggaacactcactcttcctgcttgctgctttcctcatgctgagctgggctgagatcaagactcctggggcacttgcttcctctaccctttgtctgtggccaggtgggattcccacacagtcaaaggaagcccgtgtccaacaggggccatttcccttaaatttctctcatcacccccagctctgctgtgcctcaggtgggccgctgccactcttccttcacgttcttgataatatcagtgtcttgaaaggaagcttcttgcaggtagggaggacgcttttccctggaatagctgctgtgctcatatgagtttgtgctggaacattctaaccacctttctgtgccctggtttgggttgaagggaaggcgatttaaatcaaaataaatctgcaaggcagttcatcactgggacattgtttttccaagccggggaaggcgaatgggttagggcagcttcccacagacggcaactccgggagaatatcaccggggccttccagtctgccgcagccccgggagcttctacccagggcaggtcagtgttgtccggtttgattttaaggaacccctggcattgccaacagttgtgtttttcttaaagaaatccttgagccaggtccacatggctctagctttgctgtgttaaggtgcccgacgccctgttgtcacatgtacacacgcccagcaaagctgggctgcttcacccaccagccaccatcctctcgtgccaagtcaaagaaagtgaaagccaccagtgtcatgatatttgcctcgggattattctgtgggtgacacgtgatgtcctaggagaggcctaggggaggtgcgactctgatgggctctgagtgtttccccaccaatgctgggagagggtcttgtctcctgcagggttcaagggatgggataggaaggggctgaggtgccaggcaaaagtcttgtctcctgcagggtttgagggatgggacaggaaggggctgaggtaccaggtgagggtcttgtctcctgcactggctcctgctggcatcatgagctggcatccgtggcagcccccggagctgcaggatttgggcttccgagcaaaggtgctcccccggcaaggatggggcggaccacagggccggcatttcagtggtgggtgagttgcagggcccctggggaagactgggacgtggcatttccatgagcgtgggctacggagcccgtaattgttagtgtttcagggtttgccagtggggaagcttgaggaactcccccgtgataagcgccgccgtgagagaggccatcaccccagctcttcttccagggccgagcgcggcagggaaggaggagagggcagggcaggagaataaatttcattttactgtagaaatggaaatttgtgtcatggctttaaaaatctggttttatgtgtgtgtttaatgccattcattttaaatgtagtatcataaatcattgcttcagaatcaaagctgtttaattacatttcacccatgaatagttatctaatgccaatagagaaagagttaaaaaggagaactacagagtaaatcagaggttgagatcttcagcacaagcataaaaaatcaatttaagatgaattttactactataaaaattcttcaaatatccctttaagagtgggaactgctaggaaagccagctcacatttcaattccctcagcagcatgagagaaggacgcccgcgtgggcagaggcttggtgtgcaccccgttttgctcaggggtgatgaaggaatcctaactctggagtctgagcagttgctgggggcacagaacctcccagctctcgtggtagaatgccccctctcccacagtgtaccctcgcttccctgagaaaccccatctgcggggtgtgatggccagccagaccccgctagtcctgaagactaaccctgaccttgaggtgcatgcctcgccaaccaatcccacatcccagtcttacccggggaccgtacaactcacccaccactgaaacggcagcccctgtgctccactccatcctcgccgggggggcacctttgcttcggagcccaaatcctgcagccccaggtgccaccacggacgccagctcatgacaccagcagaggtagtgcaggagacaagaccctcacccagcgcctcagccccttcctgtcccatccctcgaaccctgaaggagatgtcagctgagctcttgctgcaggaggtgccaggcccaggtggcttgatcaggggttttgtttcctcagttgaaggtcggggcacatgggccccatcacgcttgctcttcctgtctgggcagtggtggttgacagcagccagctctgcatcactcaggagggagccggggctaaccctcactgcacagggcttccacccctctgttcggccgccttccccggggatcaggacagcaaagtacattacatatttctccatcgttcttcttagatagcatcagtacactgtttattcgcttagcaaagagcagagcaagaattgaatgactgaaggtgtgtctctgaaattgaataatgtttaagccaagcagaagttctcctttccgtggccagacctcactaacggggaaggaaattgggcagtgaaaagacagcactcccatgccctaaggaaactctgagagaggccacttcgttgcctgctcggcaggcccattctctgcctgcagagtgagcccggcttcccccagggcctctttgtgacgggaccgacaagggtttccaggcagtggcttgggctgtggagacctcagcctgtgtattaagggtactgggctgaatgagggcactgtctgcgtgagttcccttgggcagggatctgggtaaggcggcagtttggagaagaccggggcatgttctgtctggccgcagtgtccacggggtcagcgtaatttagccggctctgctgggcttggttcacaggtccgactgctggtcacagttatccgtggctgtcggtcatcctagtgagcttccttctttttcccttcattctctggctccttccttaaaaccgtcaggatttgtgtgcttggaaacctctgaccaccctcctgctccaccgtgaaaaacagtgtatgggggcccctatgtgcatctcacccaaaaaggtccatttttagaaagacccgaggatctcggcagagacttttacacccacaaaatgctccagcccagagacccagcctccagcacaggacagcgtgtgagactggcccgaggtcttccatcgccgcccctgctgtcggatgacatgcacatttctgcacctgcaggacctcaaagcgaagtaaccctggacacacccttcactgggtctctttcccccacatctcccccaacaatggaaggcaagcaccgctccacacgaaaataacaacacgggtgcagttctgtgcctctccttagcttctccctgccgccccgtgggcttggtcatggtgtcaccacgcactgtagatgtcgcagacgcaggcccatggccgtgtgtgcccctgggcatgtctgctgtcttctggggaaatggaaacgccaccataggcatttactcaggcagaagctccagaactttagatcccagctttgccgtttttaattgtctcttgttaaaatgtgagtatcccagatggaatgcaaaagaggttcgtgctgctgaggccctggtttcttttctgaatggatgtgccagggtatttccgcccacagtacactttaagccaaagtaatttgtatcatctttaacacaaacccaaaacacgaaaggctgtgtttgtttaactagacgtgtaagctatagttatctttatttccgctttaactgcataagagaggaaacctttttaactataaggaaggtgttcggcttccttttatctcttgcctcattatgtacttttgactttattcagatttgtacaagcttggtttttacctcacaggaaaagcgagaactaatcgctccagagatcatctgagctctttgtgtgaaggtgttttaagaagttgtgactacatcttcttttctaaaacagcctccaattctgtgatacaaagtgaaatgccagttgtttgcagctccggggctgtggtcctcctggacaccagcggtagcaacaggccccatccacacagggctggggagacaggtccccttctgcacggggcccaggagacaggccctcattcatacaaggccagggagaccagcagaatcagcacggggccagggcaacagccccatccacacagggccgggcagacaggctgaatccgcacagagctggggttggagctgagagtcatccctgaccccagcttcatggtcctccagctcttccctgcaccattgccatgttcttactgctgcagccctgcgtcagggcagctgcggtgccttctgcctcttgccaggggcccccagcccccaccagtcacactgtgggccgcactcataggacaaagtgcccttcccgccctgacacgcacagtccttgcccacctttctgtgagtctcagtccccgaggcctccactctgcgtctacgttcacactgtctgtcctacgtccgggatggctctgttgcctcctctccatggactggccgtgcataccttgtgtggacagagttgggacggtgctcccggctgcatcggccgcctgtgctgggccacatgtccaggcaagtgaagccttcactgggaccctcccagagcagcatgggtgtgtcgaggagaaacattctgtagatctcagcgcacgccccccaaggcagcccaggaaggaagggtgaagggcccgcgggagctgtgcgtccacagcatccacagtgcagtgacgtttcccaccttttcacagaagcctgaggagcagcactgtctgcagaaggaaactagaaaacttccgtgctccaagcctgggaagtcccggggaagcatgccgtttgtctggggcctcgagaggcagggaaggaaggaagggagtcacctgaagaaatcggacccagggccagggcttcccacgggggtccacagcacttgaaatcacaacgggatgtgtcatgcactccacagccccaggtggcagcgggagacctccccttcagggccatgtcctcagtccgtggaacacagccccagaaaatccacccctgctggagatggggaatcctttccatgagggcccaccaggtcgaagccacagatgaatgaacaccccaaacagaagcagccacaaaacagtctgaagcgactcccagaggtacaggttcaaactgcaggaaatcaaagggaggagagtgtccagaaagaaccaagagggccgcgcagtagctcacacctttaatcccagcagtttggggggcccacgcgggcggatcacctgaggtcaggagttcgagaccagcctggccaacgtgatgaagccaacatggagaaaccccatctctactaaagatacaaaaagttagctggccgtggtggcagtcgcctgtaatcccagctactagggaagatgaggcagaagaatcacttgaacccgggatatggaggttgcagtgagccaagatcgagccattgtactccagccacggcaacaagagcaaaactccgtctcaaaacaaacaaacaaacaccaggaaggtttgagaaagaaccaagtagacacaggcacacgaggcacagggctgcccccgagaggacagactcaccgatgaaggaaacacagagtaggccctctggagcgtgggaatcaggggactgcaggtaaaccctgaggaatcccctgaacacagcacacggccatggaggaggcagaacgcgtggatgtggccttgcgttgttggactcggggtggggtgggccgtgtggtgcagtctaatgactgtgtcgatatttctgggaactgttttcaatagtgagtgcttgatgatttaggtgcagccgtgccatctgtaagtcttacaaagggacactgtcacttgggttgccttgcgctgtgatgcagactctcagaacacacgtcctgggaggcctgaaggtggagagtggttgcggggcctcggtgcgtccttgcctcaccagtccccctttctgctgcacagctagttgagacgtgtgtgcccatgaagcagccacaggtgtttgcccgtttagatgcagtaggtgtttgcttttccgatgtgtggaggcagggcccagaggtttactaagcccctgttctcacttttgcagtgccgtggaggtcccagcccccgctgcggttctcggaggtccggagcccctgatgcagtgcacagcctggctgaatgcctatttccaccagcccgaggctatcgaagagttccccgtgccggctcttcaccatcccgttttccagcaaggtcggtaactaagccatctgcggtgtttcctttggggagcttgacttattaacgatcgctgacatcacagttcattttattgagtataccaacttggtatttttacatcagctaaacagaggcagcgtttggccgagctggagggacgggggttcgccgcctccacccactccaacacttgtgttagttttggcacagggttgcataattcttggcaaaggcaataaaaatgaagcatgcagatcgactcttgactctcgctggctgaaaggtttaaataggaacacatctgaatggcagtaaatttttcaataagcttattgtgaacttcaactatctgcttgccaacagcacagaaaacgagacttgtgcgtggacatttagctatttccatacactctgttggtgacacttacatcatagcaggtagcagcattggagcttctcaaataattttacatttaatttctcaaacgtaccagagttagacatattctttcttaagagatgacttgagaacttacctgtatgtagcctgcttaaggcttgtgataatctaaaacatttcccagacatttcttttaaagcttgtgtttggctctgctcaatacagaaattaattacagcaactaaaatcattccagacacatgccagaaatttattttgcatagtgagtttttcataatcatttttgtgtataaatgaacatatattcatatatgatgtatatatggagttgtacacttatatatccttaaagggaaaaattaccttgagattttagatgtggtgaatttaaagcaattttgaatttcagatcagatttgctgggtaagcttaacagtattctaattgctgcggtgcttctcagcacaaaacaaacttgaaaatggagagaacttttcaagggaagcaggtaaagaaacccctgaaggttgggctaatacctgagttcactaaccaagtcagacaggcgaacatatgaagtcatgagcacgttttgtgcataatgaactgaagctgtgcagctataatgaaccaggcaccttgctgtcctctgaatcatacagaactgtctccagaagggttcagtggggatctctaggatgggcagataggaagctagagtgggtgggcctttacatggaaccacaaacgtccaagaaacctctcatcatctctgcccaccaatgggccgctgccaggacaaaggcactaccaaagcctcctgggctgccgccagctgggggccacctctccccagcgccacaagccagtgagccaattagacggtgtgggggaccttgctcactgtgcacctgatgggccgggcacagggcaggatgttgctgaatggcccaaggaagtcagagattggttttgtttattaaagttggggcttggggatcttagagtggtgaactcttctctatacgatctctttttgggggttcgcctgccaggaggagcaaggctgaagagctgtccagaggcttttcttctccttaagcctgtgaaatatgtgagctgaaatgtaaggtctcaggacagaaaagttctcttacaaaaccagggcaggaggtatctgcataatcatatggaggctgggagaatgagcctgcaaacccctgaagtttacctaaggtttgttgggcaacttcatgaaaaacataggggcaaaagttccatgaaaatcgttagttttctccaagtcatatggtggccctggccatggagctagaccctgctggcctggtctcaccagggtccagagagtggtgtgctctcaggcaggccaggaagaaccggaggaggaggcctccgcagctgctgacaggagctccagggcaggagtggccagcaaggaaggtggcaccggaaataatcagacactctccaaaccacccctgcaagcactgaacccccgctgagccttttccccctcacttctgcccatggcagtgtttgctgctcctagagccgaggacaggcgggcccctggggcttctcagtcaagtccctagtgcttaagcagagttgggattggccacacctacccctgcctccctggctttcagcccacgccaggccaggctgcttcctgggctggcaggtcatgataggtcttggtgaccaggaagacctcagagtagccgccaggatactggtaaaggctgtctggctcccccgtggccctgcccctcttggaaagccctacagtgcgggtggatacctctagctgggacgaggtccactccagccaagttttgggatggtagtgcgacagccgctcacatccttctctcttggtgttctagaactctgaggctggctgcagacccagggtgctgagctcagggccttctctcgagggtaggggctggagtcccctgggccaggcctgcctgcggatggttagtggttgctgtgggggctgggattccccaccacagcatgtgtaagccaggtttttaacatttagctcaatcgtttactcctgggcaggggccaggtgtatggattttactgtttgaagaaggggaggtggatggtggatggttgctaacagggagttaattggttctcccagatgtggatacgcccctctctgtctggcatgagtttggtttgctctctgtccaggttgttatcttgtaacatcagtgaaatcaacagtgaggggccaggtcttctagaggaaaagtcttttgacatctcagagccgcctggaagctgtggagtaacagaaatcaacctgctttgcagactgagaggagcgggtccattgtaacatggaatgaacatttccttgaccaattcctttttctgcacattttaatttctgtatatgtttaacatacttttgcatatcatttttcaccatagtctcacttctgagattgagaccaggtttatctatttcaacctggtttgtctatgtcaacatttttaaaaatgtgattgtatttgagctcatccttgagttccagcacattgaccatttctttctgaaggcctggctggtaaaacttctgactgcgcagtaccaagccctcatcccttcctcaggcctgtcctgctgctgaaagaccctctctcctgcacacggcctcttcgcggtaccacctcaccttccaggattcctctctggaacgaacatgctgtttgtgatttgctttttaaggctaaccacaaaaatatgcattacgttgaaccatatgaaattgctattttttaggttaaaacttatcaaataccagaaatttcagatggttcaacttcttatcttggggaatttccaaagacaggttagtagctaggtagctgttgaagtatttctgccaagggacagtgaagctgcctttcccgaccaggtgtccggaggtccccggggctgcctcattgtgaggttgggacaggtgggatttcccagtgggagggcgctgaggctctggaaggaagcctcattgttctgctgaagggattaagaggaaagctgagctgtccagtgaagcatattctaatttctcgttcaagtgttgttttagtcaggtcatttcctaaaataaaattagtcaaagttttcttggtttggggttttttggcttttttggtttgctattctggtttttttaaagtgtcaacaaaatccattttctagctactgtgtgaccgagggctagcatcttgtcgtacaacgtagctttttaaggaggtaattttttcccataagcctctcgcaagggtcagctttgtatttatttctaattcatttttcctcaagaaatacttatttaatgaagccattatttttgaaatacatttttacttttttcttttataatgaaatatcatttaaactttgaacactccctgatttcttagtgtttatttatgaaaatgtttagcttctttatataatgtgccttctggagaagctgtaggggtcagcagccaatgcagctacaagaaatcctttctaccctagtttgccaaaagcagctttttacaatgagttcaagaaaagcagacctacggaaagcgaggatggactttcagatacagaacccatctgggcacgtcctcaggtccctgagccctcccacccatggaaaccctgccagcaggtatggctgaccccaggctgctgagggaggtcctgccaaggcaggaccaggccttggggctgcccacgcgagactgtggggagcctagctgggaccccagccttctcacagttgaaggtgttcaacggacgagttctgagttttctttgtaaagtgactgcaatgttcccttttaaatgaaatatttaacactttaataattccttcgtcacagctattggcttacagctatgaaatccagttgcatgacagcagtaaaatctcccttttttaacacctgctggtagaagtaagtttttgtaacttctattatagagcctcagaaaggattcatatttttgtatttttgtgtctccatcgaattcctcatttcaaaagcgcctctaacaaaagccctgccccagagttaagggaaagggccttcagggtgaattcgttaaggttcccaccgtgtcctggaagatgggccctctttgctggtgcttctagtgaggactgcttgggtcctggaaggggcatgtcccgggagaggatgacgagggaggagaggagaagagagtggcgtcattacttgggtcctcaccggagccagccctttaagattagaaatccttcttgaagagccaagcaaaggcttatccagccccctacaaccccatcctgctgcctactcacatccaggaaagagcccacccctgatgggtgcccaagtagatggcctcccctggaaagaggcatattagccctcctcacccgagggtcctagggcccgtttgggtgttcttaaaatgtgccctataagtcgtgatccagcctgagtttttctacagagacactgcagccaagaggggatgtttttctcgtagcttccacatagatcacggcagcacgcaggctttgtcctttcagcactttgtaccgatattttccctgaacttaagaaaaaaattaccaattgaaagagaagagaatagctaaaataggagatgcatttgccaccacgtgtgggtggccaccgctgttccccttgattttaaacgagggctcataaatattgttgaccttgctgagatattacctggtggagctggaaggtttgtaaaccttcttccgatgcccgtttattgattagaacaagctaacaacactgcacttaagtggaaaaaacagctggtaaaaatgtaattctttcagccttagggctgctgtgctccttttctggagagcaaatgtggaaatcaagatctgtggccttctggaaccttcaccaggaaaggtgaaaagaagaagaacccatccacagctgagagtggatggcaggcccgcgggtttccaggtggccagtaggattgtccgatgtctggaatgagtaccggggccgccaccaggaacacttgtcatttctaccatggagaggaaagcccagtgcatttctgtggttcagaaacttgacacaaagagaaaagctggaatgtttaaaagcaaaaatagggcagagatcagtgaaagtgcaggatgtgtgtgaaacaagggtagagtgagcactggtggggatggaggtggtgaggggtcttctgagctggggacgtttacttacaccagccctgcctcccaagaacccatcccctgtgggtccagaagaccagatccccgccaatgtccttccctttcagagctgtctggaggagcatgccactagttcccagggtctcatctgccggcacacggcctgactttcatgggaagtccccattgatgctgttcccttcccagtgagtgggctcccgtcacccgtcctggctcatttgaatacctgcatcacctccagcccctcagcagaacaagaatgtcagataatccagaatgctgttgagagctgctccaggttgggggctcgcagccccagcatccaaaagcctggtttcagcagggcatgcccgcagagcccctaggcgccccgagctctcctggtttgcccgggctttgcctgcacgggctggccccgtggactgcctggccaggccagcccagtaacagcgaagcacaccactctcagctcctgagcttggctgaccagctatactctggcatattggtgaatttcatgggccaaagaacctgaggttcagattgtgtcttagttcattgtttcatatttgaatatgcagtttcctacctagcaattgtcatgagtactttcttgctgtttatactatgaacaacatcttgggctaggagagagtttttaaagtttcaacaatgattcattcaagcactttcctttttcaagttactcatatctcagttcattcaatggggttgggggatttatatcagaatcctctagacatttcatttataatattctacctataaatttttatacttcttacccctcctcaagatacactaaaaccttagcatgggcacacgcacacacataccctgtttctgagaattattgttctaaaggaatttatcaaaatggatgtagctcctatgaatgcttttgctgtgtgctttaccctctactaagcctaacattcctaatttaatagctatttttgtttgagacttaaaaactgtgcgcattgaaggaatgttttgccgttgaggaaatgccagcccctctcctaggaaaggggtgctcggctcctggtccactggcagtggctggaacagaaccacagcctgctgaatcccaggaaattcatggtgtccctgtgcagagccctctgactaatcagcgatcccacaatgcctgtagcagaagcatagttaggtgagagttttatcctgaatgtaagaggtggccaggtccttagttccctgaggttccgtgagtcgggggtaaaggaagcagccctcacacagagtaatttaccaagcctgagagggaaccaagaggactgtttgagagtcagccacttccaaaccttggtggacataacgagggtctctactacaataagcaggacttgtaatatgtaaaattattatgagtgctgcttttatgggaaaatattcacattaaaatataatttaactctggtgaagtaattaaacagtaaatcagtgatggcttctattaaaaattaagtcatcgtaattatgtgaatgcctttagaaggattttccgcagtgtcctggcgttggccttgagtggacttctcaaaaagtagaagtaaccaggtttctgcctgtgaggaaatgtaaattgcatcattgcttcctttaataaattttcattttaaatgggctttgaaaaataggaattttctctctgttttaaagtaaaaaacacacttttcacttaaatatgtttctaaatttctatttccactgtagtcattagctggacatgtgccgctccaaaagagaatgttaaccttcgtctcttttgtcgtcataaatgcacattcatgttttacaggtaatgttcgtgcatttgaaataattccagcaataataagtagaattatctccactacctgtgtttatagagaaaatgatgttttaataacgtgtgcatagaattggactatgttatcaatacgttaaatgtgtaaatattagtataaaattaatagtgataatgctgaaaaactattgcaggagctgaaagtgtaagaactatgacttaatgtaaatgctttcacacatacggtttttgcctgcaatccttatgttcaggctgactcggaatataagattcatgagtctctgtccctctttatatgttgtttcatgtgtcagaatggaaaaagcaaatatttacgtagagggaactcctccctcctgttggaggtacgcggcggtcagtgtagcttccgaggccgcgtggagatgggaacatcctcaagacagagcagacttcctggaggctcagccggaacgtctccagctctgtagcacgttttaattccatacaagaagttactcccaaagaagtaaattgaagaacgaaatcgaggaaaagaaagtccttttttgaaagctcttaaacacttgactccgtttagttcggatcaggccttctctgcccttccaaagattcaggttaggtattggtaacgcccaggaagcacccactctggcgagcccaccctctccgccagtaaatatatacagtgtagctgttactatgacaacgacttttttttcttgagtactgtttttaattgttgcacaaacacatattgtgtaagaaaggggaattgtccatagtcttccacgtgtggatgtgtgtgcccacactgtctgctttctttaaaaatgcacattcctttctggattgggctccgcgatcccccgcctgccaagcaacctgattttctcttcagcctttcctcacttagatggttttagtaagacctagcaaccgagctcaagagacacgtcaggacttactgcttgcccaagacatatacttttcatagaaaattcgcgtctcttcctcttttcagaataaaatatgcaagaaccaacagaaatggcacattcccctgcttttccccaagaattgggcctttgatgttcaagagcagctgatattaaaggctatccctagaaggctgtagaaactgtacctatttatgacaaatgtaaaacagcacaaatctagctgaatgtgatggtatcattagtttgtgaatcgcatccttgaaaataactgtgaaggagccaaatcggtttaaaagaagataacaaaatggtttaagctacttaggttgaatgccaattatattttaatattcaactgagcatattttactaagaaaaaaggccgcattgacgcatgcataactcattggcagcgtcggccagctgtgccgctccactctccgaatcactttgtgcattttagtagcatggtaatttagtagaggactacctgagtgatggcattttcaatgagcaggtaatctacagagaatttttatatggttatgagttctgtgcttcagcccggcaacacaaaaatacatcaagaccaattacggtatcaactttcagtgtgatacccttgccacgcaagtgcatgtatttctgccccaggcatttcaaattgcatctaatttgaaatctttggggttttaattaaatttcagaatatatggaattcttcattagtacctgctctgaatagcagatcatccttctcccagtctctcgttaaagaagtaggctgtggtaaatagcgtgttcagtagctgatcatttgtgggacctgggtattggaacagaaatagtgaaatgcaaaataatatcaaaaagattattagtccagggagagtctcttgatttgtattttaatggaattttacatttctcttaatgatttgcaaattgtcctctgattataagatgcattaagcttttcattttaatggcaaagacacagccattagcagaatttttttttctgtcttctttttagagtgcttccctgcagcagataaatattgaaaccattaacaccttttgatgtatggtacagtctgcatcttagacccacacatggctggccggctgtggtccctccgtgccgcacacctggccggggaccctgactcttctctgaggacagtgagcagcagtaatgcctgtttccttttctggaaaacaggattctttttgaaaatttcatcagaaggtggtgtttatttgtattaaagcaatgcatttaaatattattcatggcccaatgtgtatttaaaaagctggtcttaccagtgttagggttgacggtgcccacagctcctgccttgctctggtctgcggggctggccttggtgattttggaaatggaatctggccttgcccccaggatgtttctctgtcaacccatgtgctgtgagagacacacagagctctttctgtgttagccagctgaccacagcacgaccccaacgtggggacacttgactttggtttggcctctgagataatgtcttggttttaaggccaggacttctaatgccctagaagatgaatatgatttacacgaccagagctacaaggcaaagctcatctcttctgcttcatctgctgaatgtgcacagggagctttaggcttcgacctggcatgcagtgacagtctgtgaaggcagtggcgcttcgggctaggtgtctccttgtgtcggagacctgtggaatccagcagctccgtctgatcgtatagttaggaaaaccaaggggactagagaatggcactgctgagtgcgggcagtggtggctgccccccacccccaccctgggcaagtgaggtcaggcctggccctgcttgccctccatttcgaagggcaattcttcactccaggcttgcacagctgacccgagagtgagtgtctctgagcagctgtggctctcagtcacttaccccctcaccttctcacttctcttcatgggtcttccaggatctgagggatgaagccagacacacctcctgcccttcctttgtcctctcctggtgagtgtcaccttcccgggctgtcaagagctggaccatgtgcccactcaggtgtgtcaccttcctgggctgtctagagccagtctgcatgcctgctaaggcgtgtcaccttccgctcaggtgtgtcacctttctgagatgtctagagccagtccacgtgcctgctcaggcacatcaccttcctaggctgtctagaggcagtctgtatgcttgctcaggcatgtcaccttctgctcaggcatgtcaccttcccgggatgtctagagctagttcgtttgcccgctcaggtgcatcaccttccgctcaggtgtgtcccctttctgagatgtctagagccggtccatgtgcccgctcaggtatgtcaccttcctgagatgtctagagccggtctgtctgcctgctcaggcgtgtcaccgtcccaggctgtccagagccgatctgtgtgcccattcagctgtgtcaccttctgctcaggcatgtcaccttcccgaggtgcccagagctggtctgtgtgcccgctcaggcgtgtcaccttctgctcaggcatgtcaccttcccgggctgtctagagctggtccgtgtgtccactcaggtacgtcaccttcccaggctgtctagagccagtccgtgtgcctgctcagatatactgtcaccatgtgggccctactcttgtgtcagggccattagctggcacatgctgtgtggttgcctggtgcgcgctggggcaacctcgggaaacactcttagcctttgtattgatctgtgcaggctgccaaaacaaagtgatgccaactggggtcttatacaacagaaatctttctcagctctggagcctggaagtccgagaccgaggtgcggcagggtgtcagctactcagaccaaggtgctgaggctgtcctgcttgccctgcagatggccgtctccttgctgcgtcctcactaggcctttcctctgggcgtgcatcgctcgggtctctatatcataatctccccttcttagaaggacaccagtcagatgggattagggctacctgaacaaccgaatgagaacttcttcacctcttaaagaccccatctgctgatacagttgaaatgccgagggtcagggctgcaacatacgaattttggcagaacatagtttagcccataacaccctttccgagcctctgattatctgtctgtaaagtggggacagtagtaacaatgtgtaaaatgtcatgagggtaaaatgaggccaccaaacagtcagcaaaagaaatacctgcttatttcacagatagtcttttctccaaaatcccagtggtagttagcaagtcaggacagctgactccacctggtcctttggaactcagggaagattgggccgttattaggaagtgctgctctttgcagccaacagaacttcccaaggacgcccgccctccgcccttgcttgctatgtgtacgagttacaggaagtgtggctggtatagccccgcagctgttcagaaggagtgttttggtttgtcatctccacatgaaatgaatggagccaattcatactgtaactgagaaaagaacatttttcaaccattatttcttctccctactcactgttaagctctaggccacaataaatggctgcctgctgggactcctgcactctgggatgacacgttcaaagcgtgtgcccatgtaggctgctgcaagagggtaagcatgattggagtggggtcactggggtctggggagccagcctcggcccctcctggctcagcacagccctcgcggccttgggggcccacagggtcactctcccccaaccctcccacagcaccgggctgtctgctctgtgcttcactctgcactagctggttcctgagtaccaggaggcattctctgatatgctatggatacagttatggacaaaatggactcttaggaaggcagcaagtaaggggaatggaggggcaaagagcacacagctaaagattgcctgactcaactgtggtagtcactggtgcactgcaggttggcatttgcaccctgctagcatgtgctcctgaaactggggccggagagctttcttctctgtctgagcactcagagcagtgcctgccaatgctgtgacaatgaacgaatgaataagcaaaatgtcaacccattttcagagttttgtttaatgtccctggacctggatctctcttgagagtgagcattgaatgggccttccctgcccctactgagagctcagggcatggaccccaaacgcttgggtctctcctcttccctcttctgttgtaaatttaaatgtcagggggaaaaaaaaaaaagcaagaaaaatatgtaaataaatacatttgcaatcatatgttatcggatgagaagggtagcggtttcaagagttacattcagagtaatcgttgagcacattgatggcaagttgatagtttcgttattatgaaatatttactttggacaaaggagtattcaaaactgacttacgaggtataaataataaaggacaaagtcatatatatgccacccaggtgatgtaataatttgttttcttcccttctgtcagtagacatttgggttctgaagtttttgcctttaaaactaatgatgttacagatattctaggttgtgtgccctagtgctccagctggctggaattcatgggcggagttcgcgagaagagggaactatacagagaaagaattccagaggtctgcatggtatcccattgagtctgttgcagattacaaagtcatacatgcatttgtaaaccacatgaaaccagacaactattggggaactataagttgaacaaatttcagataagtgaacctcactagaactagaaaatatgtggacaagtatgaaaattttcttctattattttatttaaaagatgattaactgttcatgataaagttaataaagatgtattttgtagtttataatacacgtagaaggaaaacatatgacaacaatagcatagaagatgagactggggaaatggaaatacattgttctaagtttcttactttatgaacaagtataatatttaagggcagactttgataaattatgaatgcatattaaaaatcctagaataccagtaaaaataaccagaatctatagctcatgggccaacagaaaagataaaatagaatgctaattcttttattagaattagcatattagaatgctaaaatgtaaaagaagatagggtaaagggggaacaaagaacagatgggaaaaataacaagttggcagacttaaacccaatcatattaataattacattaaatgtaaatgttttaagattcaaataaaaagacatagattagtagactggtttaaaaagccagagcctgttatatattttctactagacaaaaataatgtaaaatgatgacagagtcctatgtaaagatggaaggaaaaaaaaaggaatacattgacagaaagatataagtaaaattgtatttattttcagatcacataattatttacatagaatatcttgaataatgttgaaaataactattaaaaccaataagtgaatttgagaagtttgaggatacaattttaacataaaatgtattctatttttatataatgtaattaaaaagtaaattataaaacagttgctttatgtatttaacattagcattattaaagattattatttaaagatatgcaaggcctctctactaaacagcataaaaacatgactgaaagaaattaaagaagacctaagtaaatggatctttattagttattggaagaggcggtgttacggagaggtcacatctacacaaattgccctctgcattcagttcagtcacacttttaaattatttcaaaatgcaaagagcctagaatatttaaaacaatcttgaaaaagaagaatgaatttgtaggacttacattacctggtttcaagacttcctacaaatctgtggtaatcaagacactgcagtaaggatcaaaacttagaacagtgcaacagagagagagaccagtgttttttcagttcttgtatctttgagaaagacacaaagtagatcaatgaggaaagtaaagtcttgttggccaggcatggtggcttacgcctgtaaccccagcactttgtgaggccatggcaggcggatcacttgaggccaggagttcaagaccagccttgcaaacatagcaagaccctgtctctactaaaaacacaaaaaacagccaagcatggtggtgcacacctgtaatcccagctactcgggaggctaaggcatatgaatcacttgaacccaggagacagaggttgcagtgagctgagatcatgccactgcattccagtttgggtgacagaggaagactctatcacaaaaaaaaaaaaaaaaaaaaaaaaaagtcttgtcaactaatggtgctgagcaactggatatccatttttttttccattccattttcagatcactttaatggttagaaatttgttccataacttatttatttccataggtttttggggaacagatggtatttggttacatgagtaagttctttagtggtggtttgtgagattttgtgcacccattacacgagcagtatacactgaacgtgatatgtagtctttcatccctcacccacttcccaaccattccccctgagtccccaaagtctattgtgtcattcttatgtctttacctcctcatagcttagctcccgtggataaccattttcagataaatattattcaccatgaccttgacctcacaccatacacaaaaattaatctgaactatatcatatacctaaaggagaagctgaaactctaaagctcttagaagaaaacatgagtatttttctgatttgggtaggcacacatttcttataacaccaaaataaaaaacaatgaaagaaattattaataaattaaactttattaaaagacttcattaagtaaatgaggaacaggccacagaatgagagaaatttttacaaaacacatatctgacaaaggacttctaagaagggtatatgaagactctgataactccataaaaggaccaacaacccagtaaataactggacaaaatatctcacattttcatcgcaaagacacataatacacagattggcccctgagctcatgagaaagtgctcggcatcatcagtcattagggaagtacaggttaaaaccacagtgaaagacatctgcatatatcccagggcagctcagatcagacaccaccaagtgtcgcagagactgccgcagcctcgcctctcgtatacattggtgggtgttaaaatgttgtaacctctttgcaaaaggtctagcagctgcttataaaactaagtgttctcctaccccgctacccaacaattccactctagggcatttatccaggagaaattaaaacctacgtccacaaaaacgtattcaagagtgttcacagcagctttgcttgctttatttataattgctgcaattgggaattgcttgtatgtccatctgtaggaaagtggataaattacctgagggatatccatgtagagcctgttcctatctgtgaacttagcattgaaaaggaataatccacagacacacacagcctcgtggatgagtctcggtaacgtcatgctgagcttaaggagccggacacagcaagagcctgcctctgattatatttattgaagctctgcagttgccaaaaacaatctggatagggaaaagttagaagaggaactgcttctggggttgtgcaggcagtgagaaactgggaaggggcatgagggaatgttctagaccatgacggccatggtctatatcttaacaggttaggtcacataggtatctatctgtgtttgtcagaattcatcaaatgatgttgaagatggtacatttcactgtgtgtgtaaattccaccttaaaggaaaaaagaaccataaatggacattgaactcttaatggtatatgtgctgaaggacttggagagagtacactgatgtctgcagcttattttgaaatgcagcaaaaataataataaaatggatatggggtggagagatggatagatatatgataaaaacaaatacaggctaaaatgtcaattatatcatctgaggtataaagctattcattgtaaaactcttccaactctatgtggctggggtttttcataatatgttggaggaaaatagtaaatattatggatttttattccttgaaagcaaatttgggggaaagatcatgaaaactgtggcctccttatcccagatggtgaagatacaacctagtatggcctcagcgagatactgagtgcactctcagtttgcacctggagggcagggtgagtctgggaggtctgtgaattgtcagtggacctcccggtcctctccagagccctgcaggatcgggtggatacactgacctgatggacaggaagaggaagcctctgggccagacctttggacactgttgccttactcttcttctctccagccaagcgagtggccttgggaggtgagtgtggtgtcgccttgcagccttgcactcagctttgcagccgtccctgtccagccagcttccacgcaagtggaagacacacagaatccacagcccaggcagctgctctcacctgtgtgtggagcacagggtgcccatcctcagagaccctgcccagcccctcgctgccatcccctctgctagaccaggcatgtgggtcagcgctgccctgtctggcccgaagttccatgtcagtagccgtggatcaaatgatgaaggcagagttatctaattacggagtgttttctctaatatttccacagcctgctgctgtcatggaacatggagattcattacttagaatgtcaaattaatagcgttcctggacctgaaacatcattgtgtcaacttctccaccttttccaggtggtggtttgagtttgtgcacatggcatgcctattgccccagcacggccacagctttccaaagtgccgcccagggctggggtctgcccacttcctcggaggtctgtccatgctccgggcaggctacagcctgcaggatgcagatgcccagattggagcagcaccctgtgccctcaagaggagcacagctcacacatccacgtaactcttgtccttagcagtagtgaggggcttctgcaggcagaggagtcggctccacggtcctccatgtaaactaccgggatcaggagcctagggttcaattctgctgtcacgtgtctgcactgtagcctgttctgccttctcaaccagccccttctagctcctggggcagtttctctttagctgaaacttcccttcatcttccaccaataccatgttgcgttacagtttccctcttctcacagaacgagccttgggagagaagtgtgttctgtcacacagcctggccatggctcaggtccacaaggtcagctccagactctcagtgcaatgagggaccatgagtagcttctgcttgctgagtgctttccaagtggcggggcctctgccaagtgctttgtgatcctcatatccaagtggaggaaactcaactttagacagtgactgagctccaacagctgatccttggcacagatgagacttgaacctgggtccttctgactccagaatgcaagctcataggaaggggtaaatttactgggaagatctctgccagccaggtccttgatggcacagggccacgtgcaggtggagtccaggcgagacttgtccttgggaacacgagctggttttgaagctactgtagtcctgggttgcccgcccatgggtgttgtgaggacgctctccagcatcactgctgcccacgtgccctgaggggtcttaggttccaccccaggtcacattcagtgttttgtctgattcttcaccagaagggagcagcctcacgcagactgagcaggaacagtagcattggtgttttccacagatcttttggaagaatttgaacttctgatcatgtatatatgacactttttaaagttttaagtgatgcatggaaacttgatattgtaaatttaaatatcagtcattttcagttttgtctctttgctgctcaaaatgaaaaatcttctcactcttcccctactccataatatggtcatggagttttgacctaattaaaagcatcagaattaagttgctaagtttgaatgggaatgtagtggtgtttaaggggacttaggagaccctgtcctcatgtcctttctgtcactataggttttgttactgtttaaagtccatctgcccagcttttagataattaattctaattttgagaacttgggagatgttgcaaaaactgttggagctgattttaagattggtgtaatatacctggtattactagagtcagtcagtgaagtcatagatgaagttgtgacatttggcccagggttccctgctgaattctgaaataccatgatgctatcaagagaagagccatgggttagccagtctccatgtgacacccagtgagcttcactgctggtactcccactcttgttccttctcggatggagtcaggtctggccccaagctacagcaggatatggaggaagtgatggtgtgcgacttccgaggctaggtcataagaggccttgcagctcccagtgtcctcagtcacctgctgtgagggcagccagtaccatgtcagaggacatacaggcagccccaggagaggcccatgtggtgaggagccagggaagtcagccctgttggaaatagatcctccagccccagtcgagccttcggatgagtgcagctatgcagaagaccccaagtgacaactgctgagcccgacccttctgaattcaaggccatgaaagaaaggtcatttgtgttgtttggggccacgaagttggggattatctgttacctgtctgtagtgactggcacaagatgtgaggcactccccagtagttacttattcatcacacttcctttcatagctggtccttgtcctttcctctggtgtaaagtacagactgtgaagacccgccctctgttccttccagctgtttttggctgtctcttgtgtacaaatgctgtaggagatgcaaaggtgactcgcagcatcccccaagaatgcctgggcttggtgctgccagaaaggtatatgaggagccccgggtaagccagcactgcaggcagcaaggtagccttcagctgtgtgggctggggagaacttcatggaggaggtagcatttgcaccagactttgaggtagatgggatttgaacacatggagtaaggggaaacaacatggactgaggctgggcctgtgtgtgaaacagcaagcaatcccttctggctggagcaggggagggtgtgaggaggggctgccagcctccctccaggccaagaaggccatcaggtctcactgggggacagtgaggagctactcaaggcatgatgggagccaggctggacttgaacaggactcattggactgtccaggtgctgggtgagagagggaggaggggacatggagccagcaccaggggacaagggggacctgaagcagctgtgaccgtggatggcagggaaaagaagaagaagggattcattttggcatagagttgggaattgcagcagtcacttgagaatgacagagatgggaaggttagggattagggtcagtggcatggacgtgagcgatgaacccatacaagtgggtgagaaaaaggctgaagaaggtgaggcagcatagggagtgggtgacgccagtgatggctgatgtggtgtgaccagaggaaggggccaagggggcggaccccgcagggtccataatggtggtgattgccttgggggagttcaggggtcgcagaagaggacctgattatgccatcctcacttgtaaattctgcttggtctcctgacgctatcagggtcagacccagccctctcatggcccgctgtgtggcatgtgctgctccctggctcttgcccatgcccctcctcctggccaagccacactccacctgcatcagccataggccctcccgccactgcccgcctgcaggtctcagcaccagcgttgcctccccagaagcctccctgaccatggtccctgttgtgtgccccaccaccccctgttctctgtccccctggtattggttcgtctgcttgtggtaactgctgaatgccagccccaatgcccccgcctcccatcgccatcagcgtcaccagcatcacaaaggtcagcacgaggtagctgctcacagaatatttattaagaataagaaattaataaagggactaattggtaaatcttaacatgcccacactgggtcttttccccatgtcacgtgagcctgaacttggaacatccatatttccagaagacatcaggctctttctctagtgaccttagaaatccccgcattgaagggagacggccctggcatggggcccctgccactgggtggggaggggtggggaccagactgtgccagggaccccaaggagttggagggtgcagagcttcttgacctgagtggacagggagaccctctgagctcatcctctgtaacaggatgagcatggactcttcaggggacaaacttcgtgcctcgtgtgaaaaacgaaagggccccacgggctgtgtctgatggtgttacccactgcacagggaaggcacctttgcaccccagtcccagccaggagagcagcaggtcgcaatgtcttgctagcctggcccctctgccctcaatgactttgcaagcaccttggcctccctgtcccactcccctgccggcacctgcgtgtccctgtcctgccgagctgccagcctcacctgcgtgcctctcgtcctcatttgaataggtgagcaaccaaagtcagctgtgccgttggagccggattccatcactcaaaatccaggcacagctccttttgaattcctcagctgccccgaggcaggggctcaatgttgatactgagattaatccccaaagagcttctcatttctctgcagagaaattaaagcttgccagtttccttttgcccgtccttctgacagctctgtcagtaatgatatgcctgccgcgtggcataatccgtgtcccgtggtaaagaataattcattaagaaatttagggcccagctcctttccgttgggttggtcttcaaaagttaactaatggcggcagcagcacgatgatcaatggaaaattattgaacagagctcagggctgcttcagaccagctcaaggagccacctgggtggagagcagtcagacccacccacccccttagatttgtcagcattccctgaaacacagtcagacggtgttgatatgaggtgtctgctgggcgtggacagtggggtggatggggtactgccctagtttgggaagcagcttatttttagccttgtagaagcagcgtgaagtgtctactggtaaagccagcacgacttctcctcccttctgaacaccagcaagaagcttctagatgtttctgatgaacaaataggagttcctgtactggctgagaggggcagcctacatacttaggttctttggggaggtcagtgcgtttttagcaaccattggcgcattgagcatgaaatggcgtggagctgaaactcactaccaactgcagtgaaaccaacaaatggaagacgtgaactgatgctggccctaatgactctgggcaagacgagggacattattgttttgcatgcattgataatgtgtcatctggaatcagattttctactttcatgttgttcgataacaaggttgtgccctgtgagtctgggattgtgtgaggcgagcgtgcgtattcattctactgcagaggaggctggggaggaatcagagcatcctgtgtctgcaaggtctggcgtgtttctaagggaaggcagagaaagccagtgctccaaagacagcagagcagacgcgaggtttgcaggcatgaggatgacaaatgaaattcgcagaattcctcagacttgatttccctcccttctataattaacctcagggataccttgactgcgctgaggtccatgtgcttgagcacttgctgtcctgcttgccctgccctcctctgatttttttttgcacagcatgattctatttctgctattgttcagaaaccattagcacctattcagaagtcagttattcagctttgagctgaatgacaattatttgaatggtaaagggtgttaatgtataattattcacattcataccaggacagtcacagtttaatcatttctctgtaggcttccttaagtttgtgcttaaagtcttaggcataattcttttgttaaataagtttaggaggctctaagtattgggaaagtgagtataaatacgcctctgggggagcttcaaggatgtggtgcctcacctccaggagcgagcctcctaggtgaaactgtcactaggcgccccacacttcagccaggaggaaggtccatttccgagggctggtagcataatctggcctccaggtgagctctgaggtcgtgttctggcgtgcccaggactagatggagcctaccggggcattcctatgtgtgacacagagccctgccaggcccggtcgggctcagagtgggcttaacccttcagaccctcgattcctctggacccctctttaagatgattgacgaccccaaagagcttttgatgataagggctatattgtgcacatttgccatattggaaattaaacctaagacttttttttttttttttttttttttgcgacggagtctcgctctgttgcccaagcttgagtgcagtgacacgatctcggcttactgcaacatctgcctcctgggttcaagagattcttctgcctcagcttcatacaccctgcatatgccggctgcctcctcaagcagtacagctgggattacaggcacccgccaccacacccggctgattttagtgtttttagtagagttgcggtttcaccattttggccaggctggtcttgaactcctgatcttgtgatccacctgcctcggcctcccaaagtgctgggattacaggcctgagccaccacgccctgccctgagactttttaaatgtattaacttatttaaaaataacaacagtaaacctatggcaggatatcataggtaatatgcttctggaaatgagttttccaagacagacacttgaggagagtggcactgttgtccatttttgcagaatggaatgccttgatgcctgcctcagtggaagacagctgggttctcagatctgcctctgcgtttaatctgttgtgttgtcacatcacgtagcccccagaaaactcttttgtcacctgtaagagaatgagaatctaaaaggcaaataacatcctagtattgctatggaaatgattttgacctcacaaaccccctaaaggggtctcaggaacccctgatgatccctagaccacattttgagaatctctgttctaaaaagtccatttcttttactctaaaatattactcacattgcctgatatgttgtgggctcctccttttttaaattttttttattatactttaagttctagggtacatgtacacaatgtgcaggtttgttacgtaggtatacatgtgctatgttggtgtgctgcacccatctattcgtcatttatattaggtatttctcctaatgctatccctcccccaaccccccaccccccgacaggccccagtgtgtgatgttccctgccctgtgtccatgtgttctcattgttcagttcccacctgtgagtgagaacatgcggtgtttggttttctgtccttgtgatagtttgcttagaatgatggtttccaacttcatccatgtccctgcaaaggacatgaactcatccttttttatggctgcatggtattccatagtgtacacatgccacattttctttttttttggcattttttttaatttattattattatactttaagttttagggtgcatgtgcataatgtgcaggttagttacatatgtatacatgtgccatgcttgtgcactgcacccactaactcgtcatctagcattaggtatatctcccaatgctatccctcccccgtccccccaccccacaacagtccccagaatgtgatgttcgccttcctgtgtccatgtgttctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtaaataatgccgcaataaacatacgtgtgcacgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagacggtatctcattgtggtttggatttgcatttctctgatggccagtgatggtgagcattttttcatgtgttttttggctgcataaatgtctacttttgagaagtgtctgttcatgtccttcgcccacttttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgtcttagacatgaagtccttgcccatgcctatgtcctgaatggtaatgcctaggttttcttctaggttttttatggttttaggtctaacgtttaagtctttaatccatcttgaattgatttttgtataaggtgtaaggaagggatccagtttcaactttctacatatggctagccagttttcccagcaccatttattaaatagggaatactttccccattgcttgtttttgtcaggtttgtcaaagatcagatagttgtagatatgcggcgttatttctgaggactctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatacgaactttaaagtagttttttccaattctgtgaagaaagtcattggtagcttgatggggatggcactgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagtgattgtgaatgggagttcactcatgatttggctctctgtttgtctgttattggtgtataagaatgcttgtgatttttgtacattgattttgtatcctgagactttgctgaagttgcttttcagcttaaggagattttgggctgagacagtggggtcttctggatatacaatcatgtcatctgcaaacagggacaattttacttcctcttttcctaattgaataccctttatttccttctcctgcctgattgccctggccagaacttccaacactatgttgaataggagtggtgagagagggtatccctgtcttgtgccagttttcaaagggaatgcttccagtttttgcccattcagtatgatattggctgtgggtttgtcatagatagcacttattattttgagatacgtcccatcaatacctaatttattgagagtttttagcatgaagggttgttgaattttgtcaaaggccttttctgcatctattgagataatcatgtagtttttgtctttggttctgtttatatgctggattacatttattgatttgcatatattgaaccagccttgcatcccagggatgaagcccacttgatcatggtggatcagctttttgatgtgctgctggattcggtttgccagtattttattgaggatttttgcatcaatgttaattaaggatattggtctaaaattctcttttttggttgtgtctctgcccagctttggtatcaggatgatgctggcctcataaaatgagttagggaggattccctccttttctattgattggaatagtttcagaagcaatggtaccagttcctccttgtacctctggtagaattcggctgtgaatccatctggtcctggactctttttgttgataagctattgattattgccacaatttcagctcctgttattggtctattcagagattcaacttcttcctggtttagtcttgggagagtgtatgtgtcaaggaatttatccatttcttctagattttctagtttatttgtgtagaggtgtttgtagtattctctgatggtagtttgtatttctgtgggattggtgatgatatcccctttatcattttttattgcgtctatttgattcttctctctctttttctttattagtcttgctagcggtctatcaattttgttgatcctttcaaaaagccaactcctggattcgttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtcctcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttacgaatctgggtgctcctgtattgggtgcatatatatttaggatagttagctcttcttgttgaattgatccctttaccattaagtaatggccttctttgtctcttttgatctttgttggtttaaagtgtgttttatcagagactaggattgcaacccctgcctttttttgttttccatttgcttggtagatcttcctccatccttttattttgagcctgtgtgtgtctctgcccgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagttttttcctagtcttgatggtctacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttaagaagcttagtttggctggatatgaaattctgggttgaaaattcttttctttaagaatgttgaatattggcccccattctcttctggcttgtagagtttctgccaagagatctgctgttagtctgatgggcttccctttgagggtaacccgacctttctctctggctgcccttaacatttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccctgtcactttcaggtacaccaatcagacatagatttggtattttcacatagtcccatatttcttggaggctgtgcgcgtttctttttattcttttttctctaaacttctcgcttcatttcattcatttcatcttccatcgctgataccctttcttccagttgattgcatcggctcctgaggcttctgcattcttcacgtagttctcgagccttggttttcagctccatcagctcctttaagcacttctctgtattggttactctagttatacattcttctaaatttttttcaaagttttcaacttctttgcctttggtttgaatgtcctcccgtagctcggagtaatttgatcgtctgaagccttcttctctcaactcgtcaaagtcattctccatccagctttgttccgttgctggtgaggaactgcgttcctttggaggaggagaggcgctctgctttttagagtttccagtttttctgctctgttttttccccatctttgtggttttatctacctttggtctttgatgatggtgatgtacagatgggtttttggtgtggatgtcctttctgtttgttagttttccttctaacatacaggaccctcagctgcaggtctgttggagtacccggccgtgtgaggtgtcagtctggccctgctggggggtgcctcccagttaggctgcttgagggtcaggggtcagggacccacttgaggaggcagtctgcccgttctcagatctgtagctgcgtgctgggagaaccactgctctcttcaaagctgtcagacagggacatttaagtctgcagaggttactgctgtctttttgttggtctgtgccctgcccccagaggtggagcctacagaggcaggcaggcctccttgagctgtggtgggctccacccagttcgagcttcccggctgcgttgttaacctaagcaagcctgggcaatggcgggtgcccctccccaagcctcgctgccaccttgcagtttgatctcagactgctgtgctagcaatcagcgagactccgtgggcataggaccctccaagccaggtgcgggatataatctcctggtgcgccgttttttaagcccgtcggaaaagggcagtattcaggtgggagtgacccgattttccaggtgccgtctgtcaccaatttctttgactaggaaagggaactccctgaccccttgcgcttccggagtgaggcaatgcctcgccctgctttggctcgcgcacggtgcacgcacccactgacctgcgcccactgtctggcactccctagtgagatgaatccggtacctcagatggaaatgcagaaatcacccatcttctgcgtcgctcacactgggagctgtagaccagagctgttcctattcggccatcttggctcctccccatgtgccacattttcttaatccacatcattgatgggcatttgggttggttccaagtctttgctattgtgaatagtgccgcagtaaacatacatgtgcatgtgtctttatagtagcatgattcacagctgaattctaccagaggtacaaagaagagctggtaccattccttctgaaactattccaatgaatagaaaaagagggaatcctcactaactcattttatgaggccagcatcatcctaataccaaaggctggcagagacacaacaaaaaaagagaattttaggccaatatccctgatgaacattgatgtgaaaatcttcaataaaatgctggcaaaccgaatccagcagcacatcaaaaagtttatccaccaccatcaagtcggcttcatccctgggatccaaggctggttcaacatacacaaatcaataaacatgttccatcacgtaaacagaaccaaagacaaaaaccatatgattatctcaatagatgcagaaaaggccttcaacaaaattcagcagcgcttcatgctaaaaactctcagtaaactaggtattgacggaacgtatctcaaataataagagctatttatgacaaacccacagccaatatcatactgaatgggcaaaactggaagcattcactttgaaaatcggcacaagacaaggatgcagtctctcaccactcctgttcaacatactgctggaagttctggctagggcaatcaggcaagagaaagaaataaagggtattcaattaggaaaagaggaagtcagttgtctctgtttgcagatgacatgattctatatttagaaaaccccattgtctcagcccaaaatctcctcttttttattttcgaaaaaattacagcagagttcactcttcttggtgtgcagcaggaggtgcacgtgctgtgcttgtccatcagtgtctgctttgtgcatctctgttgacctgcctctaacactgggacgagcatcagccaaatcagaaccaggtcagagcccctacgccctggtcagatcagaaccaggtcagaactcccctacaccacagtcagatcagaaccaggtcagaacccctataccaagcttgtccaatccgcagcctgcgagccacctgcagcccaggatagctttgaatgtggcccaacataaattcataaactttcttaacacattatgagtttttttatgattttttttaactcctcagctatcattagtgttagttattttatatgtggcctaagacaattcttccagtatggctcagggaagccaaaagattagacacccctgccctacaccttggtcagatcagatccaggtcagaggccctacatcctgtccccacagtggacaggttggaaatgtaaggtcgtgtggccactgggggcccaggatgggctctgcctcagaggcacttccttccacctggcctgttttaatcaacagtcattaaagggaaatctaaagatgtttaaaacgttgtgtattttctcgttagcagagccaagaatcagtctgcagggagcaaagagcttgagtgtggagttagaagtcggggtccgggaaagggtgcttgtttctgaggctaacatgcatcaggtgctccaagtgggctctcattgaccccaggatgccatcagcccccttgccctgcctggagtatatcacatgggccctgggtgcctgggcctgtggagccacagctgctgaggtccggtgtttttaaagcctgagagaggccatctgggggtagcactacaggagatgggaagaggcccccaggaaaccagggagagcaagaaggtcttctaaggactcatgtcctcttaccaactaccatgtagttaagaatgccttacgaagggggacgggagagtcaagggatagaaaatcagtccttaaaatctgcactgtcctttccacatacaaagcacctttcacacaggtgagctcatttaccctcagatggcacttactgttgtgggaacctcattttaccaggaggaaacggaggggcgacaggacagcgttctaggaagtagctcagctgtggacattttgtggtgagctctcagggacagcagcaggcatgggatgcctgcagagaggctttcaggagagcgctggccccacctgcaggcccccagggcgaccttggataggctgccgtctgggcctgggagacttctcacctgcagagtggatgatgggggaccttgaggactgaacaggagaaagcacactgaaccgagcctggtacctagtaagcactcagtaagtcttggcacttactgtgataattgcattttaagcccagctaccaaaatttccagacctacgttaccatcttcaaatgagtgcccctacccgtttccctaacgttgctcaaacttgcattttctgaggagcgtctgttggatgcctttggcccttgcaccacgtacagctttccacgcttattggctggccactgggtaccaaggaccatggcgggcactctggaatgctctgttttggcaaactttcttccccaagaacagatttgacttttgaaaagtggtctgaaagtcagcctccccagccctggtcacagcagaaatagttttggacccaggtgagttgagtccacaaaataacaggccgtgtctacttgagctgaagccttatcagttggcccagtaggtcccatctgaagaagccctgtatttttgaaaaatgttaactctccctaaaaggttacattgaacggcaacacccgggaggctgctgttggccttgccagcaagctgaacctgcagttgagtggccacgcgtgtggtgcgaggcgtgcagcccatccctgagggctcccctgcatgggaaaggaggctgggaggttcgccaggactgcatgtggccctcgcaccaagaacctgacccatggtggaggtggtgagtgctgtgtggtcggccttgatgtttatacgagagtctctgaggtgtagacatcagtgtctccattttggggagagggaggcggttttcttcccagcttaccattaccactgtgttcgaggagggactgatatttcgagtggggtcaccatcacactcacaccaccaaggctgctttccaccactcagctttctcatgcatcccgtttcccagaggtggccagtgcctgggccctgagtcggttgagactcatccagagcagagctgcagaagctgggctggctccagacagagatgacccaaagcctgtgtcagcatttgggtgcctgggcccaccgtccaggcctgagagagcatcagtgaggctcggagcccccatcagccaggtcaggccgtggctctgagcctagtgctcctttctaaatgggagttgcaacgccagctttgcaaagtggttgtcagggctcactgaggggctctggggagactttgggggaaggataatgattggggaagtagaaattggctcccaaaatgctagagcaggacttaagggactgatggccaggcacctgcccagtgtggcatcctcccatcgttggctcgagcgctgagctgcacctctgtgtcaggacttgctctcagtgttctgtctggggaggtcatgtgcctactgggtggggcaggtccttgtgtgggaggagccagaagctcccttttttcttaaaagttattgggccagaggtcatgaattcacccttagcctatgatctccagtaactctaccatccgcaggaaaatgacttcacaccatgcgtagggctggaaggagcactgggatggagtcccacctcggtgcgcgacccggggcgttcagcagtgccccaggaccgcagcagcccatgctcagagccaggtcctcagggccggggcattcagcagtgccccactaccatagcagcccatgctcagagccaggtcatcagggccagggcattcagcagtgccccacggctgcagcggcccatgctcagagccaggtcctcagggctggggcgttcagcagtgccccactaccacagcagcccatgctcagagccaggtcatcagggccggggcattcagcagtgccccacggctgcagcggcccatgctcagagccaggtcctcagggctggggcgttcagcagtgccccactaccatagcagcccatgctcagagccaggtcatcagggccggggcattcagcagtgcctcacaactgcaacggcccatgctcagagccaggttctcagggccggggcgttcagcagtgccgcacgactgcagtggcccatgctcagagccaggtcttcagggccggggcattcagcactgccccaccaccgcagctgcccatgctcagagccaggtcatcagggccggaagatggcaacttgatgcttagccttcaaagaggtggtaaacgataaaaaaacggagccatgcctggattcaagagcctctgaaatcctaccacctaatcactgtcttccctaatttccccttggccgctatgtgggtggtatatggtgggctgttgggtggagcggggcgggtcgttactgatctatctggaatacccgctttatctctacccagcaaactgctacccatccaagacccaggcccacctgtcacttccactctggcacctcgttcgccatcacctcactcaggagggttccactggtgcttgccggcgaacgccaccattttttgcagcatatctcatagcttgttggaaacccacgttgagttggggctttgttcatccacaggtgctgtcacgcatccgttttcaggagacagagatgtcctctgtggccctccgttggccgaccctgttgggtgcagcagctgtcagtggacagaggtgcatcagtgcgttggttggtggcatcgtggcctcaccggcccacagttctgacagaggtgtctgtgtttcaccaactcagtctgtccctgcccattgtccgcacactcattccctccatgccccagtctggcaccctcaagtgcaagtgcgtgcatttaattcacgtagtgtgttggttgggtgcactcctggacctttggggagactgtcttcttccatgttagctgcttccttcttccctgtggggtcatagaggtcacagctgacatgctgaaacaaatgccattgttttcacttaaaccacattgtattccatagccgctgtgtcatatgcgtatatataatagtgtgtaaggcgtatggaaagaagagattgtgtccagactggctacagatggtcatcctaatggcggaagcagccaggccagttgggcttgactctggagctttggagggccatcctcagtgtatttgtttttatttgtggaggccccgcagcgctcatgctggccatgcctggctgggatgggatgacctggtgaggacagaggaggacagcctctgcttccatgatgaataaaacagcatctggctgggtaggaggaaagcctgtgcttgttcagcctcaagtacgtgtttgaaagcttgccccaaagacattccaaaaaccaggcagtggtggtgtcctgtccttctagaggccaggttgtccaggcccaggggagtcttgcttaggggtcagtgagcgctgggactcagtctggctcctggcaagcccagagaaccccactgctgagtctctacacaaggcattggacggggctgctgtgggtgtgcgccaggccacctccatgcctgggcagctgtgcacaagctggctatgagctccatggcatacagagcacgtccaaactaacctggtagcccagtcccatggaaagtgtgtgacatcgtgtccctgccttcggagtgagcaagccacaagccagatgtcaggggctgttccttctgcaggtcacccactggctggccaagcaccgtgaagctgggcgcacctcctccagggaccatactaaagcagctagcagcaccttccccctgctgtgaaccccatgcctgacctgagcctgagccctcacaggcctggcaaaggctgcctgcagaggcctgggccacacaggccctatggctttcctgcgtgccacggagagccagccagtggggctgcaggcacctcctcccgctcactctcagtgtgcgcctccacagggaccacagaccacaggagctcctggcccgccacatcgccagccgtgtgcgcaaggtttatcaggttcctcttggccaggttgaagtagatgccgggtggggatctgtaggccctggttgtgtttacagaagatgctgcccttcactgtcttccagcctcccaggaaaggatggtccccaggctccatgctgacaccacccaccttgcttcacccagtaggcgcttactgtatgtctactctaggtcatccacagtgctgagtgttgggatagagccccgggaggtaggtgcctggtcctccgtgagtctggtggaggagccctccgtggtgacagccttctgtgagagcatggcaggtggtggggcctcgtagagggaaagattttgcagaaaatgtgacctagattcccttttaaataggaaatactggtccctagtgtcttgaactttggggagaaaactccctttgattaaagagaaggtaacttggaaatgtgttttccctcatctttttgttaatttattttttaaattaacatgtagtgaaattggctttttgtggggtatacagtcccgtgaatgttaacgcgtgtgtgtgtttctgtaaccacccccaaaatcagggtgcagaggagttccaccacctggacacccccacgccgccccctggcagccacggcctctccccacccccattccagctctcagcaactgcgacgtgttctccaacaccgtggctttgtgtttttgagaatgtcttataaatggaatcagacagtatttaacctttggagcctggcttttttcactcaggttaatgcctttgagattcatccaagttgttgcatgtatctacagcttattcatttttcttgctgagtgtacgctaccgtgtgggtatatctccattgatctgttttttattttggccattctaatagatatgtaatgatatctcattgttttcatttgcgtttccccgatggccagttatgttgaacatcttcttttgtggttattgacccctccttatatcctctttggggaagtgtcaattcaagtcttttgccttttttttaagttaggtggtttgttgagtttcagtttggaactgttgagtttggaaaaatctttatatattctggataggataggactcttgttggatttcttatttccaaatattttctcctagctagtagtagctagtcttttattctcttaacactgactttcagccgggtgcggaagctcatgcctgtaatcccagcactttgggaggccaagggggcggatcatgaggtcaggagatcgactgcatcctggctgacacagtgaaaccctgtctctactaaaaaaatacaaaaaaaattagccaggcgtggtggcaggcgcctgtagtcccagctactcaggaggctgaagcaggagaatggcgtgaacccgggaggcagagcttgcagtgagccgagatcgcaccactttgctccagcctaggggacagagcgagactctgtctcaaaaaaaaaaaaaaaaacaaacaaaaaaaaacacctgactttcatagaccaaactttttcacaaacaagttttttttccctttttaatgaagttcaatttatctctctcttttttttatcatgatttgaaggacatatctaacaactgtttgcctaaccccaggtcatgaagatttgtcatatagtttctttttttttttagtttaatgttttacatttaaatctatgatatattttgagttaatttgtttaagtaagtcatgagatttacatcacgtttcactatttgcctatggatatccaattttccagcacctctttttgaaaataatatgctttcttcattgaaatccctttgcacctttgtcaataaacatttggtcgtgcttcagtaggtctattttggaaatctctcttctattctgttaactccatccagtaactccatcaatactccaacaagctgggtatttatccctttgcaaatacataattattattatgtatagtaagtcttgaaacctgtcagtgtgatttctctaaccttttttgtctcttgtaaaatatgttggctagtctcaatcctttgccctttcatctaaattttagagtcaacatgtctatctgcaataaattcttctagggttttttaattggaatgataataaacctataggtcagtttgttagaattcaaattttatgatattgagatttccatgaacatgatatgtctcctcagttattcagacattcttgtgattactttttcagcattttgtaatttccaacaaacagagcctatatacaaattgttagatttacatctaagtattttatttggttggagccattatcagtggtatatagaaaggtgattgatttttatttagtaaccttgtatctagtgactttgctaaactcacttattagttctaagacttttctattatttcctgggtattttcccatagacaattatgttgtctgcaaatagggagagtttgtttcttcttttctaaaacaattgtcttctatttcctcatcttgctttttttgcacagttaggtatgatgttaactgtgggttttttgcagatacagttgtcagattgaggatgttaccttctgttcttaggttgctgagagcttttatcatgaataggtgttaaattgtattaaatattttttctgactggatatagattatgtgtttttctaggatattaatatgatagctattgttcgtttttaatagcctttgtttttagaatagtttcggatttacagaaaaattgaaaaatcagtagggttctctgatactgcacacctattttcccaaattataccattgattcttattatgatgacatttacacttgacatcttacattagtacggtacatgtgttatgattcatgaaccattgttggtaccttaatattaactaaagtcctatgatcttgaagttttcttagtttttacctactgcccttcttccattccaggatcctgccttggatactgcattcctagctcctttggcccctcttggctgtgacaggtccttagttttagatggcctagacagtgttaaggagtactgattaactattttgtagaatgttcctcttttggaatgttttatgcttttctcatgatttgactggagttacagtgtgtgaggagaaaaaccacataggtaagctgtcattttcctgagatcgtatcaaggagtcatgctgtcagtgtcatttatcattgttgatgtcaactttgattacctggctgggtagtggtgtttgtcaggtgactctatgataaagttaccttcccccatctcccctgcgtactgcactcgtcccgaagaagttgctgtacctaacacacttaggaatggggagttacgctccttgaagacagagtatctacataagttactgggaatgcttctgcatgggagagttcttctccctcacctatttctgtattcagtcatttttttatgttagtatggactcagggatattgatattttgggttgtcttccaatactactttattttgttgctgagattatcccagttttggccatttgggagattgtgcagtttgctcctgtgtccctttgtcgtactctcctcatcgtggtttgactggaatgtttgtctttgttcttttgcttcatttcattttggagtgtgtcctgactttctgatactgcaagattctcaaggctcatcttgtgtatttcctgtcccagtcctagggaggaaaaggccagttcttgaaggagtcttgtgtcttttattataaaatgcatgagaaaccatggactgggcactaggtttgctccttgctatgggggtggtgttgtttctaagtcttctcagttgacagaccacagaagtagctttctgtatactaacccacggacagataaatattgtaaacatttctgtatgcaattatctgtgtctatattaagctaaacattagttcctattgatatctgcaactctaatccattaccacatggattcttctagcctcctctccttacttatctgtaaaatcccactcacaatgagaaacctggctcacactttctgccatccatttacttaattattcaagcccagtatacatatagaatagtatcagagagtttaacacctgtgctcatgggaaacaactttatcaactagagttcagtatttatgtacagttccttttgcctttagtcttacagactccactcactttcaagttacttttggagaaatcagctcccctcccccattcagtgaggacgttttataagtttataatacagtcagattctcttgtcacagtctgtgtttcttcccaggatcccctgatctcctaaatattttgttgttgttaatttacatacattgcttagattcactctttgtgctgtaagcttctatggcctttgatagatgtatgatatcatgttttcaccattacagtaacatgcagaataattttacaccctaaaaatccccctgtgctccacctattcagtcccccgctccttctgaaagtgccccggcaaccacttatcttttttctgtctatatagttttgcttcttccagaatgtcatctagttgggatcatacagtatgtagccttttcggctggcttcctttgcttagcaatatacatttagttttctccgtgtcttctgcatagctcatttttttcactgaataatattccattgtatggatgtaccatagttgtttatccgttcacctatcgaacaacattttggtcacttacaacttttggcagtgttaataaagctgctataaacattcacaggcaggtttttgtgaggatgtcagttttcaaatcagtagagtaaatacctaggtgtgcaattgccagatcacatggtaaggctctgtctttgaaagaaattgcaaaacagtcttccaaagtggctttaccattttgcattcccatcagcaatgattaagcatcctttttgctccacatccttgccagcagtttttggtactgtcactgtttggatttttagccattctaaaagccattgtaatcatattcattattttagtgtgcagctcctaaagacaaattatgttaaatatctttccttgtgcttatttgtcacctatatatattctttggtgaagtgtctgttaagacttgcccattttttaattgggttgtttgacttttttcttgttgaattttaagagtctttttataatatattttagatgcaagtcttttttcagatatgtgtcttacatatatcttctcctagtctgcctctcgttttcagagtctcagcatcttttgtagtaaagaagtttttaattttaataaactccagcttattcatttttttctttcatgaatcatgttgtatctaaaaactcttctcccaacctaaggttgcttagattttctcctgtgttatattctgaaagtttatgattttcccttttagatttaggtccatgatccattttgagttcatttttgagaaaggtataaagtctgtatctggattcacttctttttcgtgtgatgtctaattgttccagggccatttgtttaaaagactatgctttctccattgaattgctttttgcttttttttgtcaaagatctttgtcaaagtctaaatttggcccttgtatttatgggttccacatccatgtattcaaccaactgcagataaaaaatgttcaacaacaaggaaagaatggttgcatctttactgaaagcgtacagactttttctccttgtcattatcctctcaacaatacagtataacagctatttacatagcatttacattattctagatatcctaagtaatctagaaatgatttaaagtctacaggaggatgtgcaagggttatatgcaaatactatgccattttatatcaggaacttaagcatccatggattttggtattctagaagggtcctggaaccaatacccaatggataccaaggaatgactgtatatctgtgtgtgcctgtttcattgacctttgtgtctgttcttttaccaatgccaccctgtcttgattactgtagtttcataatgtagatttattttcaaatattgaatcagccttgctttcctgggacaaaccccacttaattttgatgtcttgttctttttatatattgctggatttgatttgccaatattttgttgaggatttttaccctgtgttcataagagatactgaactgtactcttttggtttctgactttttctggttttgatggtggagtaatgctggtctcataaaacactttagaaaatgttcctttctctggaaaaaattatgtcaaatcaatcttatttttaaaacattttatagaattcactggtaaaaccatcttggccctagaggtttctttttcagaagattgtaagctatgaattcaacttctttaataattataggagtattcagtttcatcttggataagtttggtagtttgtagtttttgatgcattggtctattcgcagttgttggattttagtacacagttatttgtaggaataccttattatctctttaatatctgtgggatctgtggcaatatcttctcttttattcctgatattgattatttgtttcttcttttctgtcagtcttttagagatttataaattttattgatcatttcatggaactcatttttaatttcttggattttactcttatcatttgtctgttttcaattttgttgattttcgcctttgcctttattatttcctttctggttgttttgagtttatttttctcttctttttctggtttcttaagttggaagtttagattattgagacctttcttttttaatatagacacttaatactataaattttcctctaaatattgttttagctttgtcccataaattttaatatgctttattttcagtttcattctgttcagtatactcttttaattttccttcagactttctctttgacctattgattatttagaagtgatatgtttactgttcaaatgtttggagaattttctattatggtttttgtcgatttctagtctaattccattatgatcagaggatgtaacttatatgattgcagtcattttgcatgtgttaaggtttatggcccagaagaatatggcatatctttgtcaatgttttatgcacacttgaaaagagtatagattctactgttattgggtggagtgttctgtaaatatccattaaatccaatcggttgataatattttttatttgtgtatctttgctgattttctgtcacctagttctattgattattgagaaagaggtgtttaggtctccacatataattctagatttgtctaattttccttgaattttttcatgagttttgaaatctgttgtaagacacatatacatttagaattgatgatttctttttgtgaattgaccctctcactatgtaatattcctttttaccctctgggaattttatttgttcttaagtctgctttgtcttttattaatttttttttacatttgtgtttgcatggtatatctttttctatccgtttacttttaacctacctacaggtatcatttgaagtgaattctttatgacggcattttcttgtgcatgtttttaaaaatctattgtgacagtctctatcttttccttggcatggttagatcatttacatttaatgtaattattaatgtttcaatttaggtctaacattttattgtttgtgccctctttttttcctttttcttccttcttttgggctatttttaacttgttttagtgttttgttttatttgttgtggtttttactatatctcttcatatagtttttctagtgactgttttagggattataatactttctttcacagtctaattagaatcactgttttacctttttaagtggaatatagaaatcttatgactatatagatccttttagctctcccattatgttataatatcatgcattatgtttacataaattgaaaatctcatttcatatgtcataatttttgcttttggctaataaacatatcttgaaaaacttgaggaaaatagcctgtaatagttttccatatacttacatttttcttactctgcctgcattcctgatgttccaagcttctttagagtaagtatatggataactataaccatcatttcccttttttctaaagaatttcctttagccattctaaagatcagatctactggcactgaattaccttagattttcctttttatcagcaaatgtctctaactctaacttcattcctgaaggattcttaaacatcggatatagaatcctgagttgtcaggtttttttctttctttcagcacttcaaaagtgctgttttacttcctctggactcagtagtttctgatgagaattccacattcaaatgactgttgccttgtacataatgcattgtttgtttctagtggctttcaagactttctctgaagctttcagcagtttgatcatgatttatctgggaatggatttctttgaatgtgtcctgtttgcagttttttgggcatcttaaatctacagttgtgtatcttttgccaaatttgacaaaattttagctatcgtttatttgaattttttcccgtactacactttttttcctctttttctgtaactccagtgacataaatagatctgttgaccttgtctcacgtgttctctttttgtctattttaaatacttttttttctgttgtttggatgattttttgttaacttggcttcagttttattgactcttttctcggcatctccattctactattgatcctatgcagtacagtttttaattttggttattgtatttttcaacactaaattttctactttattattcttgatagcttctatttgtgttttttcatttgtttcaagagtgtcttcccttgcagcatttttataacagatctcttaaactttttgtcagatgatttcaacttttgggtcatctcagccttggcatgagttgattttttccctggtgagtttatttttctgattatttgcatgcttggtaattttggattgtatcctggtcattttgaatattatgagactctgggttttatataaatcctacagataatgttgatatttttgttttaggaggtagtcaacctggttggatttagttagttcataagttctgaccagccttcaatatttgttcaattttcaaacccttttccgtcctcttaacatcagttcttttgtgcaccactcaccagccagtttgggaactggcagtgccgaattcttacagcagttctcaaagtctgtggtttagggtcagatacacatgtgcataggcggggaagtagacagctcacccgaacaggtgagtccagaaatctatcaacagctttttggtttgcttccatgaactccttttcctccacaatctttttggcactttttagttctcagggctccctcctcagtcccctggacagacagctggggcttttccccactccgctaaactcttcctattactaaacctcaatctgggtccaagcattaggaagacagaggtaaagagcaaagacatttcgcccacctcttagggggagcacacctcttcccatcagaaagggaccatctccccctcactggtttgggctcctgcggcccctgttgtcccccacaccacaggattgcttagggaggagctgacgttcaagggctcagagataacaccaaaaagggatgattcctcactcgccctgaacatagttgtctcagcccattttctgctgctataacaacactgccatctaggtaattgataaagaataggaatttattgggctcacagctctggaggctgagaagtccaagagcatgacgccggcatctgctgagggccaccccgtggtggaaggcattccatggcgaggaagcatgccagacaggagaaaaggggccagagtccctcagtaaccaattccagcagtaacagcattcatccattcctgagggaggggccctcatgacctaatcacatcttaacactgtcacagtggcagttgtttccaacacaggaacacattgaaaccttagcagcaggtgatgcttttccttcctcaaagtggattagagcccctagggggctccccagctgtgccaggctttgcctccagggctcaggctgtagtaagttcgggctgaggacaacagagggataacccaggaagcccattcatcttttccatggtacttgaaattcttatcttctttccaaggctgccaactactactgactcttctcagccctcacgtagctgctctgtgccttctgcccaggttttataaagacattcagtagaagaaacaagtatagagtgcttgcttcattttacctggaaccagaatccccctttccctccatttgtgtttcaggttagtttattctggctgcttttgatggccagggagcattaggtcaaatagctgtgacttgtgccagggacaccagctcctggggattccccttccaggccagtggctgctgcacagggatgtcctgcaggagctgaggacctgctctttcttgctctctgttgctctttgttggccatggccacagcacagctactgagatgctctgcaagcatgacccggcaggtagcacctgtgtgtatgggcctgagtatgcccctgctagctgcagcctggctaaggaaaagtcccaaagcctgggctgctgaaggatgccccttccccccaggaagccacacggaccttgacaggtcaccacccatggagctgtgatggttgagggaaaggagactcctcctcaagaacttggaagcacaatggcctgcctcccaggaaagagagcctcagtgcttgtcggagccctgatctcagagagggccagctgcctggccagctctgctgttgcctgtgctctgagcctggccgtgtgcagtggacgcacaggtgtgtttgctgaggtggctcgtagcagattatcaccgaggagagatggacacccaggataaggaagtgatgagtctgagcacagcggtggcagagccaggctggtcccggtctgtgtcctcctgccgtgctctggtgtgtgttgtcttccttattggagctgggtttggctgagttggtccaggttcaggtgtcaggcctgctcagagccttgagctccactccatggcgtggcatgaaaacacctcgcataaaaacccagtgtctgtgacacaaaacgatttctcccgtgaccagcatgagaaaagggcatccagacccttggcggaggatgcacaatgcaggcagagggtttagaaaacagtcttctctgggtgaggcagttatggtgcacacatttaaatagctgcccaagccgaaatgaaaatagccatgtccttcagatgcagagactccaagatgcaggtcctctcccttgaccccagccacagaagcccagcccaaggtacccagcaccacaggacaggcaggaggaagggcgagtgtgggaaggagacaagggaagtggaggggtaagagaggaacatccagaatgtggcgttcggaggccgcgtcacagagccccaaggtctcggggctgccctctggggaggcccatggtgaaagagagaaggctgctggggttttttttgttttgttttttgttttttgagacggagtctcgctctgtcgcccaggctggagcgcagtggcacaatctcagatcactgcaacctctgcctcccgggttcaagtgattcttctgcctcaccctcccgagtagctgggactgcagacgagcaccaccacgcctggctaatttttttatttttagtagagatggggtttcaccatattggctaggatggtcttgaactcctgacctcgtgatccgcccgcctcggcctcccaaagtgctgggattacaggcgtgagccaccgcgcctggaccagaaggctgctgttttaatggttgcccctttgggccacctgaagtgattgttccagctgctgaggactgatgtggtcacctcaacctcaagaacttctattttccacatgagttaatgtctatgagtggatttcactccattatagaatatgatgcttaacagcaaggattgcccttcttcaagaacgggtgtcattcagccatgtgattctgcacaggctagggttcgaagcactgtgctctttgagagctgcttcaactaattactgcattcgttcgctgcagggtgaaacagagttttcagatacatttgtaaaatcaggtgcctgattgctaaatactacattgtttgagctatacttcctcatatgttgcctggtacggaccagttaagaaatggtttcccatgagaaactgacaatgaagctgaacatgtttgataaactctgtgctcatctatggacatataattgttttattatacgatacttttacacttggaaagaaaggtgctccgtaatttggcagcaatttgtcagagcagcactcaaggctggcgctcagatgaggcccttggaaccatgccattgtttctcggaactgctctgtgctccggttaggtttgcacacacctccctcgtttcattcctacaagtttagtaaagttccaggccgttctcccagaacacctaacggaaagcacagaaaacaaaaccaccaactctgtgttcgccgaggaaggcaggaaattggcctctgcttcttgcggtattgacgtgctgctttcattgtttcttttccaagacagctgtccccgaaatctctttacctccaagtcaacagcaggctaccttgctttgctttgcttttttttaaagttaggcataacaacaacagcaaccatgataatgattaacagtttgatttcaaaacgttttctgaagaaatgacagtaaacagtgcatttgcccagggaaatccaccaccccgccagccatcagccggtaatacaactgcatgtgctaatgaacccaaagctgttaatgtggtttcttcagttaaattgattcatgaattttgaagagaacattatctaatgaattttctttgaatagaaagcaattaaaaggacaaatcagtctgattaaccccaaagtcaccctcctgccacaaatggtgtacagtttgaaattatatcataaaaaactagagcacatttgctatctttttgccctctactaatccatgtaaattaatgaacaacaaagttaatttctttgatgacccttttctagtatcacctggattatgctgatgtttaatttgcttaatgttataataaagactaaacagatttttttcccagtgaagtgattatcgttcccttcagttaagaagtgatttttattatttaacacacatgtaagggtgtgtttcctttaagaaccaaatcacactttgccagcttggcaccaagtgtaattagtgttcttgtggacacactcagaacatcgttcctgcccgcggaagccttccctttgttgctgctattcagaaactcctgcccctggaggggctggagcccctgcgatggaggacatggctctgtctccagtgctcctgagctgcatgtcccccttggaaagacaataggtactgattcagacaggccttcttcgcgtgccccagtttctctcccaccgacaccactcccaggtaacagttctgaaacctggaggcagagggagagaatgttctcctgcagtcacctcctcattcctgcagcaggatgcggcacaaatgcagttggatgtggttagtcaattaaaatgggaatcaagtcattttatttttgcagccctattcactaaagatgcctgtaaccaaggtcaccgccagcccctgcgtactgtggtgcttggcactccgagcagtagctgggggaatcctgcacgcggctggaggtggacagccggcataatatcgcagcctggcctgtggctgcttttgccttctttgtcccagttgaagttggaaattaaccagcagtacaaaagatttccaagcaggcgggcaggcagggacttctgtgtgtattaattgagccatgagctcacttacacacgcccagtcgctagaagagtggcacacgcaaccccacgcggaacacgggaagatggaaagaaattgcaaacctgtggtgccagctccaaggatgccttccaaggggccagcctgcatggtggcctgccacatgcttgcgtctcctcgcctggtgacatggtggcagcagtgcatggaggccgtgttttaattgagtataatacctctatttgtgtagatgcgtttcctgttttgggactagtggctatttatatcagagctgctgaagccgtttgtccaaataacattatcctgcattcttcctttcagagtcgttcaccagacaggtgttatggaagctgctgaaggttgtgaaattcggagaagtgatttcttaccagcaattagcagccctggcaggcaaccccaaagccgcgcgagcagtgggaggagcaatgagaggcaatcctgtgagttctcatggcgcaagcatggctgtgggtggcgggtgcgtgcaggtggcagggtgtcatctgatcccacgtgtttcctcggaaggcaggctgtgctgctggggtgggcagaggggcgatatctgtgatggggaccattatgccagatgcctccagaagaggcaaggaggctaccccagcactacactcctggaagctcccccctaccgggagcacatctccactgcatgagctcctggttgtcacagtgagcaggagaggagggagcctggaggagtggcaagcgggcagagggtgccccacctgctcactcaggaggtggacgtgttgggtgcctgttttatggcccacactcttctaggtgcccagagtacagcagctaacagacagaaaggtctacctgcgaggtgcctgcatcctagcaggatggccaagcaagggtgcacatccaaccccatctctctgtgggctgcactccccctgaggcccagggctccctgggtcccaagagctaaagcaccacacgtgagcacacgaggcaggaggccttgcagcatgggacaagggacctagaccacacgcacctcgtgtctcaccagggatggcgccctccccagagcccttctgtgtcctcgtccttcccatgcgtctgcagtcagatttcactaaactccaggctcccaggctatgcagcctcaggccatgctccccagaggacaaggcccaaccgggacacagcatgggtggggcagcgtggcctgtggtgcctgggggccacgtgggtgccgttgctctcccatctcacagcacccaggcctggcagctgggccgcgggccatctggcatctggcatgaggtggtaagtcacagcatgccatgtgcgcccggccaaggccacacgtgcctgtgtgtgtgggggcagaaagggtgccccgtctgcgtggcccattgggagaacccacacaacctcaagaatgcccctggaatattcacccagtgatggtgtgtggtcacgttggcagtgtcttctcccgaaagctctgtgaaagtttctagcatgatggaagcataccatctgatcagggagcacaaatatgatcactccatcatgggatgggaaattactaaatcagatagacctcactttttgaaaaattgctgtggctttactgtctatttccaaaactacttatatccctgctcacaggggagaggccggcgtgttcataccacagcctgctgctcctgctgcccgctgcagcagcctgggggcagagcctccgtttctaggagatgacagttacgtaggcttttgcacaaaactgcattgttagtccttaaaaagcaactctggtaggtttgtagtggattgcattgtcgtaatgtacaccctaatctaggcgagctttctaccctattaaaatatcccaaatatcccaggagtgagataccacagggacagccaccatccccacctcctccatctcttcctgtcctcagttttggtgacagtggctggtgggcgcaattggcccttccttttgcacctgttgcacattaattgcaatgtcttcagctacattgtcataaaacatctgcaccacgcagtagggatctgatttttacggcgcgttgggggatatttccgaatcaaatttctgaggatggtttttgacatttcccaataaaacttaacctacatgcccctctggaaggctgctgtcttctccccggttgtgagtcaattttgaggtgttcaacctgatgaaaaggcagctcagatgctgttgtgttgtggctccgtgtagggcccatgagaactgtggatgcgaatggggttttgggggtgctcttcctgcatcagtgcagtgactgtttcaggcagtgtctactctttgtgccccccgaggagagtaagtccttgtcttctccccactgaggtggattctgctccctccgtgcacacacatgaagatgggagtggccccgtcagcgggcgccgactgctcgctcccttgtgtgtgcagctccccttttgctgtaaggacaagctccactaactgacatgtgcagcgtggcagcaccctcccccaccagcctttggtgatgccagcagtttctcactctgcagtggagatgccgtcgctggttagcaatcctgcttgtggcgatattcggagacatttattgttctgcaaaccagcgtgactctcttctcctgctattaatctctatgagtgtctctgttccagtatggcctcagtcactgaaatgtataaagtagtatcacatgggatgtaaaaccctaatgtctgtaaagtccacacatcggcaccctgtcccatggcaaagccaagactggaggtgagcacagcatcaggcaggagggttctacaggcaccaagtctcgcccttctcggcgtccacatgcctcctgtgccgagggcagccaggcggtggtggcttctcgtggcctttctgtgggctccaccgtgtgcagtgaccttcagcctgaggagggggctgcagcaggacctgtggctacggtacccacagacgcctcaaattatagcacagatatgccagagatattcctgcaagaagccttcagctacgtagtttactatggttcaggttgacagcctcccaagttcccattagaaacctcattagaatgggctaggaggatgaaaaggtgacccagggacttgctagaggaagggcgctggccagcagtgagccattgctgctgtcagtgtcctcaggaatgtttccctttggcgctgacagcagtgtcccagccggaaggctgcgcacatccactccagcccagacggtgcgtcgctgagactcgctcattgaaaacatcccttatattcaggatgaatagagtgattgtgcatttaagggaggagagtgaaaaatggacttggaatgttagaaaacatcgtaaagctcattgtgcattaattccttaggtggcttgcaataaacaggagcacgtgctggttcatattactgcatttgctgtcggcatgagtttctcttccccaaccggagtaagggatggcttttgccatgcggagctttcctctatcctaggagcttgatttctccagaatcctccaggaaggactcaccagccggtgtaaggtggttggtcagcattcctggaaggctgtctccccaactcagcgggagaggatggtcagtttcccagtatattgagtagaaaactcctcacgacccaccccctccacaaagcacccttcctcttcatcctcagacagaatttgctaaatgcagttcaaaggcaatcgatacattgcacagagagtctccccacctttttctgaacaaatgcattcctgaggagttagtttattcacggattgccatgagcgttaatgaccccccgaggcttgttctgcccgtcacccggatggctgctgataaagacttagcatcatgttctaagtgtcaaggttgtcagtggagctgaaccatttgaccagaagaaaaaaacgcacagggagctattgattacagcttctcggtgtcacttgttcaccaggatttaggtattgatgaggctgcgagtgaaaacaagctctttcccttgtgggctgctgcccagaagaacaaaggcgaagttggaaaaaatattcagccggtaccagaatcagagggattccatcattgactgaaaggccccttcatgttatttttgttggaaacaaatctatgggtttggaagttttatagcgtttgagaaaggggctgcataagtgatggattcacgtattggatgaattagatttcacagcatgaagatttcaatgcagctgtgatattatgagcttcttggttattgataaaaattacattttatgcagcacatgctttaaaggagagggcatagagggtacagatcctttgaaaatgtccttagggccccaataaatttcagcaggtttcattatcttaatagtctgaaacctgccaccaaaattcacacaaacagaagcagcgttccctatttctaacggtaaaaatagtgcctatttggtaagtcacctcttccccatcacagcatgctaaggtgaggaccggtcacagctgtcggggtcattgttattccgtgccatctgtcctggcctctgcattgatgtacaggaagagggagagggagacatgtttattttactcatttttataatttcatagctcattgagagggagagaagaaaaaccaaagctctgctgtgaaatctgctattaggtaggaaaattgaattggtgcctaaatgtttataaaactagattgaattaaatgcctacctctttatcagtcaaaaacgtgaattgtgtattatctaataatgccctcacagcaattattaatgggactgttgtatttgataaaaatcatcaatcagggtaaatattccatcctggagatttcctgtgactccttctggaagactgggattctcagctgttccagaacttggcagttactacacctcactctagtaaactcaatgttaaaaacagtcagccctccgccacctgcatgttcccatgtcatagtcgtcagaagcctcttagactgcgtcattggtgcacgttaccaaactcatcgtcaaattaggatgagctgtgtgatgtgccggaagccagagtcccaccttgcagccatgtcatctgctggcaccggctgtcaccccacaaggtcccacctcaacagtccacgtcaaggaggagaagtgtggtgcgtggagccatgcaggagagtggttagagccccttctttgccacttaacagctttatgaacttgggcacgagactccattcggccggaggctgagacaggcctggtggggccttgcggggtgatgggggccatagatggggtcgaagatgcagcagcatcaggcatgggcacacccgctcccaggggctttaagcaccttttccaaggggggctggggcttcccccacctccctcggggacgtgtgtagctgggccccacagagggccacacccaccaggtgaaatctgtggcaggtacatgtgtggcagtgacacaagctgcctgcaccaaaagcctcaggggatgcaaaagtagcagtcacctccccaggaagcagaggtgcccaagaaatagagcttggagatgctgggcacacgcccccagctgcttcctctaaaagctcacctgaccagtagctggttgctttgtccagttcactggctttggagggtggagcgtggggaagctgggcatgggcagaaatcatttctctgttgagctggggatacgctcagctggagagaaaaagaagagtggagtcggagtgatacccgggggtacccggagtgatacccggaggtagcctggacacgccccaaccttgggatcctgcagaaacagctgtttgttctcatcagggcaggatgctgggagcagggcagccatgtgtgagggcccagggagaggccccgggtctgcagcatccgtgtctgggccatctaggttgcggggatgaatgtgctgccctccagctcaggaggaagggaggaaggggggccaggcagtaagcgatcgttaggcatctcccatgtgccttctacgtgtcgtgccagctgagaaccttccagagcgagcttggtgcccttccccattcttctggagcctgccctggctcctgtggtcatgctcattggcagtttaccttcttcacggagcagccactgtgatgctttgcacgatgatgaggcatgtccccccacacgtcccccgagatgtcctggccccttagtggctgcccacccatacacctgctccccaggcgccaggagctacttagggatgaaggctgttgcctgggaggctctccagccaattctttctttagaaatctgtgcaagacttccccacatgctcctgggaagccattctggagcagatcttcacagtaactgcttgttgggaagcttaagcaaatggccctggagcccccagagcccccagagtcccctgcggtggccatgcaggctgtgtggccatccctgtctgcccaggcagagggggacaaccagagagatgcccatatgttactgccttgtctttcacctttctgagccagctgagaaatggatagcagacctcaagattttagctttattagggtaaaagcgagattgaaggcagggggtggggggccagtggcatggccatggtggcttcccagtaattcccacaagaattacattcgccatcactgtcccctctggctaagctctggcctccccagccaaggcaggggctgaccatctcagaagagatcagggcgccccgaaccctggggcaggcaggtcacctgcaggagccctaacagtgctaagctgggcatacccctctcttcctcccttgtcggtggtcagtgactcattctcccttgtgggtgtgagagtggaggaggccagcacctacatggaaaccagaggcaggggccacagcacctgcccccacccaccacaggtggctctcagagcttcagccagacagtggacccatggagctcctcctgtctacacagctcgggcaacgccaaaggaccaaagcagagtctccctgaggactgcactgaaggaggcgcccgcccctctggagggaacagggattcccttcccctggtgggactggccataaagaagcagttggtaggcaggatccggggcctgtgtatggctgcgtggttgtggtcctcactctggatcagcccctatcagcacagggcatcctgaggcaggggttggccaagtcctcctgtcaagggccagagagtaaatatgttaggcttggcaaagcagccacagccagtatggagaaaaaggcatggctgcgttccagtaaagcttcatttgcaaaagcaggtggtgggctgcgtgcgcccacagccacagttggccggccatgggctggagaggcccgtgcaggtacggtcttctctgatgcgtcctgtgatgcctgcgtggtacctggggagtgtttgagagcgtcacataccaccagaactcggaaacgtagttttcagttttgtaagcgaacgttgtatattactcaccggatgaaattaagttttctcctcccaaatcgtgggcctaaagcaattctctgaggatgccccacgtcacctcaggacactcgtccctcccccaacccgtgctgagacccccagggactcaagggcctcaggggaggggaagtccatgctgagacatagctgacacccacccatgccaacagcctgcccctggcacaggcccctgcttggtgggcacaggactcctgtcagtcagggccttggccttgaccccaaagacctcgttgtccagatccctgactgacagtggctgcccccctgtcttccaggtccccatcctcatcccgtgccacagagtggtctgcagcagcggagccgtgggcaactactccggaggactggccgtgaaggaatggcttctggcccatgaaggccaccggttggggaagccaggcttgggagggagctcaggtctggcaggggcctggctcaagggagcgggagctacctcgggctccccgcctgctggccgaaactgagtatgtgcagtaggatggatgtttgagcgacacacacgtgtaacactgcatcggatgcggggcgtggaggcaccgctgtattaaaggaagtggcagtgtcctgggaacaagcgtgtctgccctttctgtttccatattttacagcaggatgagttcagacgcccgcggtcctgcacacatttgtttccttctctaacgctgcccttgctctatttttcatgtccattaaaacaggccaagtgagtgtggaaggcctggctcatgttgggccacagcccaggatggggcagtctggcaccctcaggccacagacggctgccatagccgctgtccagggccagctaaggcccatcccaggccgtccacactagaaagctggccctgccccatccccaccatgcctcccttcctggctgtgtccatggctgtgatggcattctccactcagcagttcctagcatcccacacccaggtctcactgaaagaaaggggaacaggccatggcagtcagtgcttacagaggttttctagctttgtttcctacctgccaaaaaggctaatgcaagatgcatccacttatggtctgtatcaggtgaatagaaaataaccatttgccaagatttggaaagacagagagctctctggacacgggttcgatggagcttgcacctctctgagagctgaagtcaagtctcaccctctctccatactccctggcctagtgtgctctgggcagcaggtaggaagggacagggacctctcatctcaagggctgccccaaagggccctcagggaccatgggcctgttaggaccccagcaccccagtgtcgatcctggaagtcaaaggtcacgactgtggggggccagctcatgtcactgatggcagcaggcagggtttccagcatgggcggtgcgctgctgtctgatacttcattattgtgttgtcatcctagctgtataattaactatatccaaaagccggaagggaaacctgtagctctgcatatggagaaataaaacagagcatatgatgtatagagaaaatgaactgcacccagctgtgcactagagcgccatgttcttacccagcattccttgccacggtgtgaaccacagcagggaagctcgcatggttctacacgtcaccgaggcctggatgaaaatgtggcctcacgatgtgtatggttgggacccgccttctatttcattttatcttaacaccaacgaaagaaaaccgatttcagacgtttttcgctgatttatgatttattatatccctttctggcatcagccaaaatctcggtttttcctatgacatgaagtgatgtgactcttaccccgttgtcttaactcttggtatttttgaagcaggataagtcacacagcgggtcacgtagacacgtgctgttttgtgggacaggccctgggcctccttgctcctggcaggcctcaggtgccgcacgccgcgtcaccgtcaggactcgcaggctgtctggtcatttttgacgttgctgaaggtgagtgggaaaagctgggtgcactctgccccaaaggtggtgccctgtgtcccccacagatgatggccctccccagtgatggccggtcaccaggcacggctttcccctctgcatgaacagaacagaagcttctggctctccaaggcagcagcttggggcctggtggcccgggtgtgcgagccgcgagtgctttccaacagagggcaccagagccgtgcggtgtgctgtggagaccccagcaccacttcccctgctggaggatggatttgaaggagggtggctgggcggcaccccgatggctccctgtgctccctgagaccctacaggccgccctctgcagccacacctggaccggcaggcatgcacgctgcaggcaggctgcctccgctgtttgggtcccatgaacgatggaagcctcccagtgagatcttcaggtctctcatcaggcacaggctctgagggagggtcctggggccacatgactgcagccagcgagggccgagcccccagaatccaggtcagctcctggtggcaggggacctgcccgtcaaagccgtccaaggtgagccagcaaatccgtgtggcctg

SEQ ID NO: 16421 - DNA, 33155 bp, Human
  misc_feature (1)...(33155): n = A,T,C or G
ggaaaggcttatcagaaactcaaaagaaggcaaccatttgtctctcacctacctgtgacctggaagccccctccgtgcttcgagttgtccccgcctctctggacagaaccaatgtacttcttacatatattgattgatatctcatgtctccctaaaatgtataaaaccaagctgtgccctgaccaccttgggtacatgtcgtcaggacttcctgaggttgtgtcatggacacgtgtcctcaaccttgctaaaataaactttctaaattaattgagacctgtctcaaaatttgcgggttcacacatgttatttagaaatatggaagtaaacacaggaacaaaacttgaaagaattaaaaatgctttcctctggaaagtggatttaacttaaggaggaactgaacaggagaatgcgggttttggttacagaaaaaaagagattcaaataaaacagtagagaacacctgttctgtcctcccttgtgtttatcaagtgcttgccaggcactcaaagttcattgctgtcattattgtaagaattgaggacttgggcctccacgtggtattctattaatactggctctttttttttttttttttgagacggagtctcactctgttgcccagactggagtgcagtggcccgatctcggctcactgcgagctctgcctcctgggttcacgccgttttcccgcctcagcctcccgagtagctgggacaacaggcgcccgccaccgcgcctggctaatcttttgtatttttagtagagacggggtttcaccgtgttagcaaggatggtctcgatctcttgacctcgtgatccacccgcctcggcctcccaaagtgctgggattacaggtgtgagccaccgcgcccggccaatcctggctctcttaaactgaacatctccaggattttgcatctatcaggaagggagattgtgacctctgacaagttacagtcggcggtaggtatccatggagaattggttccaggaacctcctggataccaaaatccacagatgctcaaggcccttatattaaatggtgtagtatacagtatttgcacatcctcttctataattcacgtcatctccagattccttgtaatatcaagtactatgtaattgttacataagtagttgttacattggattatttagggaatgatgacaaggaaaaaaaagtccgtacatgttccgtacagatgcaagcattctttttttcctcaaatgtttctcatccgtggttagctgaatttggatgatgaatccgcaaatctggagggccgaacatgcttaacttccctgagtttatccattgctaaagcgagagaaattacaaacttagctaggaagggtgttgcggaaagtaattaatattatacttgcaaagtgcttggcacgttgttgtggttattatttcctgaaaacaaacaaacaccacttattggttggtgtgaaagagggcatctgtcaaagttgtcgtcctttggagccagaaaagtatttcttctgatgatgactgacctctcctcacctctccttcaaccttgcggcttctttggggctccctccccgtggacagcggtcaagattagcctgggccacagtgcactggtcctgtcctgggtgatgttccaagctcactcttttttaattttatttatttattaattttttttttagacagagtctcactctgtcgcccagggctggagtgcagtggtgcaatcactgctcgctgcagcctcgatcccctggggtcaagcctcctcacatctcacctcgcaggtagctgagactacagatgcgcaccaccaggaccagctaagttttgtatttttttgtagagaggaggttttctcacctgtatgttactcaggtttgtctcgaactcctatactcaagcgatccgcccgtctaggcctctcaaagtgctgggattacaggcatgagccgccgcgccccgccccacgctcagtcttgaaattgtctggaacgggaaacggcaaacagcgagatatccgagcgagagtcccgccctgcatcagtttgcggaaccgccttggtagaaggagagaaggggagtggaggaagcacgggactggagggaccaaagttccccgatggcggcccaggggtgcgcggcatcgcggctgctccagctgctgctgcagcttctgcttctactgttgctgctggcggcgggcggggcgcgcgcgcggtggcgcggggagggcaccagcgcacacttgcgggacatcttcctgggccgctgcgccgagtaccgcgcactgctgagtcccgagcagcggtgaggcagtcggccgggtggaaggggagccggaaagaggcaacggtggggagggcctggggaggggaaaactggcgctaaagttcggggtgagggggcaatgagagaggccttgaggggagaggtgagtgtggagacagcgatggtcctgaacgatgggggcgagtgaggagggggctgtgaagtgtgtctgcaggtgaggggtgcgctgtgcggggtctagagatgagtgtgtgtgtgtgcgcgcacacacacactgtagaggtgaggggtgtgtgcgtgtgttctagaggtgaggggggtgtgtgtgtgcgcgcgctctagaggtgggaggtgtgtgtgtgctctagaggtggatgtgtgtgtgtgtgctctagaggtgggggtgtgtgtgtgtgtgtgtgctctagaggtgaggggtgtgtgtgtgtgttctaaaggtgagatgtgtgtgtgtgttctagaggtaaggggtgtgtgtgttccagaggtgaggtgtctgtatgtgtgttctagaggtgaggggtgtgtgcatgtgtgttctagaggtgaagggggtgtgtgtgcgtgcgctctagaggtgaggggtgtgtgtattctagaggtgaggggtgtgtgtgttctagaagtgaggggtgtgtgtgttctggaggtgagatgtgtgtgtgtgtgttctagaggtgaggggtgcgtgcatgtgttctagaggtgtgtgtgtatctgtgttctagaggtgaggggtgtgtgtgtgtagtctagaggtgacaggtgtgtgtgtgtggtctataggtgagggatgtgtgtgtggtctagaggtgagggatgtgtgtgtggtctagaggtgaggggtgtgtgtgttctagaggtgagggggtgtatgtgtattctagagctgaggagagtgtgtgttctagagatgaggtgtgtatgtgtgttctagaggtgaggggtgtgtgtgtgttctggagttgaggggtgtgtgttctagaggtgagatgtgtgtgttctagagatgatgggtgtgtgtgttctagaagtgagaggtgtgtgtgttctagaggtaagggatgtgtgtgtgtgtgttctagaggtgagttgtgtgtgtgttctagaggtgagatgtgtgtgtgtttgttctagaggtgaggggtgtgtgtgtgtagtctagaggtgacaggtgtgtgtgtgtggtctataggtgagggatgtgtgtgtggtctagaggtgagggatgtatgtgtggtctagaggtgagaggtgtgtgtgagtgtgaaggagggtggagaggtatccctctagaagtgagggtggggtagaggtgaactgggtaacagcccattgccacccagcagatgtttagtctgaatactcagaacccagaatgtgatctcaggttggaattccttgagtccagtccttccagaattcaaatttcagatcccctaaatctggaggatttctgaagtttgggtctttcttgccagtgctgcatttcttactgatttttgttccttctgtggccccccttttcttatgtttgtgatgtctttcttgtgctgatcatttttattgtcgcacatttcaggcaaataagaaacagcagagaaccacctgtgttacacaccacccagtatgagaaacaaagttacaaatgctatgggaaatattttttgaaaactagcatggacctcaagaggggcttgcactggagggtgcacctgctttgccagaggtggaagccttttgcagcattgggcctccctcctaacactacacatcctgctggctggcctggcctcacctggtccccgagctccacactggaactggactatgagactggccccaccgttaggtctaaatgaagaggcacctgctgtatagttgactgaatttgtcacctcctgctcggtgccatttctgcttgtctccgtgagcctggggcaaggctgtattccttagctctgagaaatctgtgcagtgccttcagagagacaattccagtgtcagatttctgaatctgtcacctaagccatgacaattcgttgtcttttttgtaagcctacttctgcagttactatatgaaaaatctcttgtaaagctcttagacaaatgggcatacttcacaacacattatgatgtgcatgtgtgtgttcttcccaacttgtacttttgcacaggaacaagaactgcacagccatctgggaagcctttaaagtggcgctggacaaggatccctgctccgtgctgccctcagactatgacctttttattaacttgtccaggcactctattcccagagataaggtaacaccacaaccatcttgggtaaaactgtgttctctgtctctacagaaatggatggtgcatgggccaggttgacattagctgtcccctgcatcctgcaatgtcacagaaacatcaggcagcacacataatgtgtgtgctgagctctctgtgggaagctagctttgtttctgtattagtccgttgtcacattgctataaagaaatgcctgagactgggtaatttacaaagaaaagaggtttaactggttcacagttccacaggctgtacaggaagaatggcaacatctacttctgggaggcctctgggagcttttacttcagcagaaggcaaagtgggagcaggtgtcttacatggcacgagcaggaccaagggcagagggaggtgccacaggcttgtaaacaactggatcttctgagaactccctcaggagaacagcagcaaagggggaaatccacccccataatccaatcacctcacaccaggccccacctccaacataggggattacaattttacaagagacacaaatccaaatcatatcagtttccaatagtgattctagatctcccgctggttgtgggcagaagaaaatttcctaagttagcaagttagtgtgagaatcaacatgaggacatcaggacatggccatacctgtcacactgggcctccacatctggccagttctaaataaccttcatcctaactggcccaatggcctgaaccttgagtaattcagaaaactctcaatctcagtatcctcccgggagaccagtctctccatttaacgggtcttaagattatatttatttagtaccagtttatttaagaaaaccacatatctatattctgtatacactctcaggtctaataaaatgaaaataatgagaaaatttccataaaacccttgcttaaaacaatacctcaagtttaaggaatgctagacaccatttttgtttctgtgacataaacattgttaacctgattttttccattgtgtgttatttgtaaaggcaagtaaatggaactgtgaggttcaaagatagaatagactgaaaacatgatttttgagtatatgctgtcttttgaaccttgctgccctcctgtcactaaaagtggggaagctgactttttaaccttctgtttcatagattcggtgctagttgatgaactcagtaaatacttccggggctatttgtttgccagtcattggtgctaagggttaaggatgtaacagtgaaaaacagccctcacccttggggaccttctagtctaaatataaactgattggactactgagggtcagatgaaatagtgactgggggatttgtgttattgttatataaaaacactatggtggaaactataaagtataatataaaagcaatgtgtttttgaggcacttgacactttaggaagtgctttttgtgactgcttattatcctggccacagctctggaagaagagaaagggctcatgctctgcattttccagaagtagaaactgagaaacagggagattgcatgccttgctcaagattacatatctaatacatgacagagccaggattccagcccagttcccttgatcatttttaatgtaggggatcttaccacatgcacgtatatttagtactagtgagaaaatattccattaacatttgcatgataccctgggaataaagggaggagagatgctagcagtctttgaatgaataaataaagacaacgaaaaagaacgttcagttgttgtgcagcaggtcagagttgaatgagaactggattgcccaacttgccttgatgatattgtgcctgaggagtcggttttgattctgttttgtattttgatgttttgtttgtctttccttagtccctgttctgggaaaatagccacctccttgttaacagctttgcagacaacacccgtcgttttatgcccctgagcgatgttctgtatggcagggttgcagatttcttgagctggtgtcgacagaaaaatgactctggtaagactcctgcacaaatcacaggagacttaagaactcctatttactatgcattaccatttgtgctaaatgctttcatatgcatttatttcacttgatcctctccaagtcctctgagataagtggcaagaatagttaataataacaatactagagaatacttaactttgcaggtgccagtctaagcactctctctctctctctctctctctctctatatatatatatatatacacatatatatatacacatatatatacatatctatacatatctatatctatatatacacacatactcatttgatgcccacaacaacctcatgggatcctatcataatccccattttgataaatgaggaaactgaggcacagcaagattaagaaatctgctcagggggcatagctagtaagcagcagacagtctgactccagagcccattttctcaactttgcacaactctgccttactatcctcatttgtccagagggggaagctgaggcttagggaggttaaatgactggaagtggtaaggctgggtctcagtcctgtcctgatggattctgaagcctgtgctctgtaacaccactccaggccgccggcagatatttcgagatccaagtcacaaggaaagttagagtcacaagagctggcctgaatgttctgcaaacactcctcattcatccaactgtggtgctaggagctggagacacagcagtccccatcttcagggaggttatagcctcatgggggatatcagctcgagtgatatgggctataatgcaggaaaaatggtgttcgaggagtagcagagtgagacaccagcctccaccagatcatcagggaagcttcagaagggaggctagcaaggaaaggaggttagggagtgtttccattatgaagactggagatccttcctgggtatcagagttacttcaaaagttaacctaatatcaggccgggcatggtagctcacgcttgtaatcctagcactttgggaggccgaggtgggtggatcatttgaggtcacgagttcgagattagcctggccaacatgaagaaatcccaactctactaaaaatacaaaaaaattagccaggtatggtggtgcatgcctgtaatcacagctactcgggaggctgaggcaggagaatccctcgaaccctggagaaggaggttgcactgaggcgagatcataccactgcactccagcctggatgacagagtgagactcggcacacacaaaaaaaagagttaacctaatatcagttctgtttatttctcctccattcatttgtccatcaaactaaaatttatagtgtctactatgtgccagaccctcatcttctagacagtaggaaaacagcagagaataaaacatgaaattaataccccatgcttacattataggagggcagataagacaataaacaggcaagtgaaatatacagactgccttaagattataagggctatggagaaaattaaaacaggtaataaggacaaaaaagattgagggtggagggccagggaaaggaaagtgttgcatttttacctagatgccgagggaaaacctcactgataagctgatatttgaacaaggacctgaaggagatgagaaagagcattttctgatgggagaacagcaattgcaaaggccctgaggtgggagcgtgtgtgacatatttaacagcaaagaggacagtgggcaaagaggaaagtgtgagctatgaggctagaggaataaaggagggccaggtggcacaggatgttgtgaggcctctgcttttcactgtgagtgagatgggcagcattgcaggttccacgtcaaatggacacagccattctttcaatggagaacttccaggaagcttttgtttgatgatgctgcagagggtggggagaaggaggggaggaatgtgatgaaaaacacataaagaaagggagagccttccagaaaaccaccagttatttcttcttcacctcgctgcccttttctatctatgccctcctatcagggctctttgtttcagaaagaagtgaagtccagcagttcaggtcagctaaataaccatatgtgtatgtcatggaatcctgtggggccagcagcaatggtgatggggttttttatttattgacccagaaaggggcatgtttttaagcaaaaaataaatttacataaccctgtgattggtatgaggctattcaaataaaaacacatatacacaatacatctatgtaaataaacacagaaaaaagtcaagaaaatagcaaagccaaaccattgacagcagctcttttttattttatttatttatttatttatattttaaaatcattattattttttgaggcagcgtctcactctgccacccgggctgtaatgcagtggtgtgatcctagctcattgcagccttgaactcctgtgctcaagcgatcctcttgcctcagcctcttaagtagctggactacaggcacacaccaccacactaggctgtttttaaaattatttttgtagacacatggtcttgccatgttgcccaggctggtcttgaactcctgacttcaaataatcctcctgcctcagcctcccaaagcactggcattacaggccacagtacctggccttggtgctttttttaattttaattttaattttatttttgattgactcaaaaaattgtatatatttatggcatacaatgtgatgttttatacatatatacattgtgtaatgatcaaatcagggtaattagcatatcaatcatcttaaacatttactatttctttgtggtgagacattcaaaatcctctctactagttattttgaaatatacaatacactattgttagctatggccactctattgtgcattacagccccagtacttattcctcctatgtaactgtaatattgttgaccaacctcttcccatctcccttatccattcccctctccagcctctggtagccactattctacccccaacttctatgagatcagcttttgaagattccactttcaagtgagatcatgcaatatttgttttcctgtacctggcttatttcacttgacataatgtcctccaggttcatccatgttgttgcaaatggctcaatagtattgcattatgcatatatgccatattttctttctttttttttttgaaacggagtctctgtgtgtcacccaggccagagtgcagtggcacgatctcagctcactgcagcattcgccccccaggttcaagcgattctcctgcctcagcctcctgagtagctgggactacagatgcgtgccaccatacccggctaatttttgtatttttagtagagatggggttttaccatgttggctagtctggtcttgaactcctgacctcaggtaatccacccgcctcagcttcctaaaatgctgagattacaggcgtgagccactgtgcccagtctattttatctattaatcagttgatggacacagattgattccatatcttggctattatgaataatgccattaatagcagtttttgctaggaatatgaggtcaacttgtagattagaaattttttttctttatagagtatatggtaagtacatcccacatcccattgatctgctagggtctttagtctgtccttaaacattgtaaaatgtaatacattttaacattttatatatttttcaattgtataaaatttctgtttctggctaagcattatcactttcttaatcctttgtttccttgcatttactactaagataatggctaacaatttaatttttggagacggctcttctcccaataaagcaaaggtttttgttgttgttgtttgtgggtttttaaacattgttgagaaataacccagctaatacactgatgctcagtggtcagctagactcactcactagccagctatttagttctctgccttcctcacatttgtgatgagcaaaatgaccaacatctttagtatcatggacaaggtggtccctcaccaggctccttgtggattgagtgggaagaactgtggatgttaaacttgtacacattgtacagaatggaagctaagtatacatcatggaactgggatatattgtaagttaattcttctctgagatagataatctttggaataaaatgtgtttgtctacttaccccttaggactcgattaccaatcctgccctacatcagaagactgtgaaaataatcctgtggattccttttggaaaagggcatccatccaggtaatgctgggatgatatctgagtggttgagcatgtgtgggacccatagagatggaacatagtcattcagagtctgggccccaggtcatcactcaacttctctgagcctcactttccacttttaccacatcatgattcatgctctttgctatataaagttgtgagaatttaagggaataaaatacttaatgcagtgcctggcacggagaaaacattctgtaaatgttagctatacatgagggttttaattagtcattattatttccattatgtcctggttatcattagtatttcaaatcaatgattttgattgctacataaaatggggcaactcctgctttatggaagaccctaggatgctggagatcaatttgtggggatcagaaatgtccacaagactaatattaatgggagaggaactgataggagatggaggataagctggagacacagaaatggtcccctgaaggtaggtctgtttcccagagaatgatgtcaccagagttgatgacagctatctgtagctataacatgccagtgactacagctgacactctctgtcatgagaattagaatagagattacaaataaagagggttaagttcttagttcagtgcctggcaaagagctgttgactataaaacattagctaggttgaccaggtggatgtcaggccccttccacccaccaccgccaaccccctttcaggactatccatgtctttttcagtcccatcttctaccctagatcctcaggtatccactaggttgattgttagtcagggtgagaaggaccttggccaaatcctccatggtggctgcagtttggagctaagcagggggtccctcccagataaaacatattctgtttattattgtgctctgctgcccaccccaagagagcaccatttgctcccactacctgtaggtttcatcttgagcacagactccagtcagttggcagtggctgccagggcccctcattgagaactgggaggctacagagatgtcatcatctgaaagtgggatcaaacagtaactcaggggagatgtcaacattacatgtaaaggaaccatgtattttacccagtggatctgccagacttccaagagtgtgctacaaaccaccaccttatacttcctccaattctataatggaaatctcatactagtgcccacattttttgagaacttggcatttgctctgtagtcgaagcaagaggagaggtagtgtggtatagtgatgggaagcagatttgaactttagcagacaagtattcaataaatgttagcagtcattattttaaatattttcatcttttttttttttttttttttttgagacggagtctcgctctgtcgatcttggctcactgcaacctctgcctcccgagttcaagtgattctcctgcctcagcctcccgagtagctgggactacaggcgtgtgccaccatgcccagctaatttttgtattttcagtagagacagggtttcaccatattggccaggatggtcttgaactcctgacctcataatccacccgcctcagcctcccaaagtgctaggattacaggcgtgagccactgtgcctggccaaatagtttcatctttatgacaattctgtgaggcagagacttttaacacccttattttacagataataaagtaaggtacagagaggtcaagaagctttaccaggattatggaactgacaagtaggggagctaggatttgaaaccaggcaggctggcttgagatcagactttcaaccacgacgttatacagccttattgcattggcatactttttatttttatttttatctttttttttgagacagagtcagtctctgtcacccagactggagtgcagtggtacattctcagctcactgcaacctccacctcctaggttcaagcgattctcacacctcagcctcccgagtagctgggactacaggtgcgtgtcaccatgcccaactaatttttgcatttttagttgagatgggtttttgccatgttagccagactggtcgcaaactcctgaccccaggtgatctgcccacctcagtctcccaaatggctgagattacaggtgtgagccacagcgcctgactctgcacacattttttttttaatatttttttctttttgtcagtgtaatagctgctcataatagtgaatgacacatatagaaaatataaattaatcacccacattcctgccacctaaaggcaacccgtttagcatagtggtgatcaggtattggcatttaagaatttaactatgactgttagcactatttggaagcaatctatgacatggagtgtattgtttggtattgtgtatcactttgctagggagtgaatccagccacctatacgtcagtgccacatatttcacctctacacctccttcattctagtataaacattttatgagggaaattacatgctccagtagtattctcaagtggagattttggaatttctgtggacctgtctcacccttgggaattcctggacttcagcccatgtatttttcacacagtagagcccatgcccctcaaatgactgttgaattttgctttgaaagcaaatacttcctatgctattgcaaatactttgtatacagacttttactaatggctggttaagatttcagacccttaagtatcatagtttacttaccattcccttgttgttgagtattctgtattagttacaatatttcagtattatgaggaattgctgcactatacatctctgtgcacagtgctcctggtagtccttagtgctgtttgccaaatatttctggcttgtcttctgagcccacggtttgcactccctgcctcatgaaattatttacacgtgacttacactggccaatcagttgcgagcgggagtgtgacttttgggtggaagcctttaagaagtggtctatgatttgtcactgtctcctccctttcctggcaatcagatattttgcagatgtgtcccagaatgaggacacttgaaacaaaaccccagtgggcctgtgataaacatgtagtgtgagcatgatataaatcattgttgtttaaagccactgcagtttcgaggttctttgctaagggagcataagctagtttattccagctgataagatactgtgtattttctattatcttcttagggtagattcccagacatggattactgagtctatgagttttttgacatttcaaggcaatttgctttccaaaataaaccagtttgcatttctactaagccatatgaaatgccacatttatcatatccttgccattatttagaactgacaatttgtaaaaaatgcacatttcatagcagaaaaatgtcacgtctttatttgctaaaaatacttggttcttctcgtagtattccaaggatagttctggggtgatccacgtcatgctgaatggttcagagccaacaggagcctatcccatcaaagggtaagaacaccagcacattcaaacacaagagagaatgccaaaatatttatttaattgttttaaatagaggctaaagaaaattatcctagtccccatctcatgcgtgcttctgtaaattcaggtaaagcaaaacagatgaatgacctggtgatcagagccatgtctatagagttaaaccattaacagctgatgaatacaggaataaaaagtaacctaaaaataaaagctaaagaagaaaaacttctaaaagctctttatttttttttaagaaaggtaatgtgtaaattaacaactgaaatggaaaagatatcatattgctttagggcttcaagaaatgtttctcagtttttttgcagattatgaaattccaaacctccagaaggaaaaaattacacgaatcgagatctgggttatgcatgaaattgggggacccaatgtgtaagttatggtgatattgatgatgataattgcacaagtttgtttttcttgtatataatatgataaagttcgtttaacattttcagtttaggggaaatgacagccttctttgcttctaatggggttggtagagaaagacaaaagcttgactttctgggaatgccactagccagtcccgagcccagagagaaagcctcctttatctgggatattcttctcagccagcgaagacagtgttcctttctgaatgaccttggtagctttggatgggtgagttccttatgcatttgtgagggtctaagccagtttctccttctggtcatttgaaattcaaaagccctcaccactggttctcagaattaacctagggactctataattaagacgtcattctcagagaacaaccagctcttcaactgggtcttgaataactggttgagaaagcttttatgatccacattttctgggaaagcacgagtttacatgtaaatgcaaacttaaactcattcttctcagcagtaaagagcactgctggcacaaactcaagataaaaaagttaaactgatttggtttaaagacaagccaacaaggccacagcctaaataaagctggacagccatgatggagcttcagaagcaagctgaggccttgtccttcagaacagtccctccgtgctacatggaggaaggtattactaaccccaaggagtgcaggtcccattgaaagtgtttaggagaacttcagtgaattccctgtgtccgtgttggcccccaggaccttctaagactcaccatataaggggttatttttcccgtctcttaggcaatagattgtgataaatttgcaaactacttaattacgtaagttataccaagatctgcattccccttctcagaagacaaattatacttatttttgcatgcatgaaaaacgtgtatcgttggtcttatttttgtgagaagttgctctctctggaagttatacttgcttgttgttttaatgtatctatcttgttgcccaggctggagtgcagtggcgagatgtcagctcactgcaacctccgcctcccgagttcaagtgattctcttgactcaacctcccgagtagctgggattacaggtgtccgttaccacgcccagctgattttttgtatttttagtggaggcaaggtttcaccatgttggccaggctggtcttgaattcctgacctcaggtgatccacctgaggcttcagcctcccaaagtactaggattacaggcatgagccaccatgcccgtcctttatagttattttaacaacacgttcacttatctctgtgtccaggtgtcctgcagcctagatgtcgttgcttactaaaaagaaattctaagtagtgagcctggccccgagtaaggcattttcccgggtattggcaaagttctaaaaaatgatgttattcaacactgtgctttcttcattcctataatgcctggaattccacttctgtaaaaatttccaattgctcatttcctccctgtacactccccctctattaattttatggtggtgaggctgtttaccatcccatttcatgtaaactcagggtcctgcctgtaatataccgtgcctaataaccacagctggtggtgttgtgtatctacctctgtttgcgtttgtaaattctccctgcttaattgtgaccattagtgaaagtgggcaagaatcactgttggtacgagtgtgggaaattgccactctcatactttatcagggtgtaatttggctgttcctataaaagccttaaaatggattcaaatctttgatgctagaaaacctactttcatgaatttatgccaagggaacaaataattaataatgtgtaggaaaatgaagttccaattagtgactgggctggtggcatgggaggtaagaatttaccaagacagttgtaggtaaagaaagatagatttattagagaaagtatgaaaatatgttgcaaggatgcaactggcaggtcagcaagagactagctgactgcatggagacaaaggcttactgggcattttgcagaatggtgcttgtgctgtgtactgaagagcacttgtgcagttctgataatgccaaggttgcagtgagctaacttgcctttttctatcagctgagcgtctggtgataggtgggcatgggaaggttgtgagttatttgtgcaggaagcctatgtgtcctggaccatgaagaaggtagacttatagcttatctgctttgtctttttgctttaccctgctcctgccagcctggctcctttttcctaattaggactccacagcaacaaagtttgttgtagtgtaaatggtatcgaaatgaaagaatcaacctaggtcttcaacaagagaggacgggttccatgagttatggtctgtttatgtaagggaggccatgctggagctaaaaataatggcagagaagtgtgtgtgtgtgtgtgtgtgtgtgtctgtgtatacacacacacacagagacaggagctaaagcagactacaaaacacattggatagcagagaccctttgctgtatttttaaaatcttgcagaaataaatatattctaaaagactagacctatatacaccaaaatgttaacagagctatctctaggggtgtgagatttggggtaattttttaaaatttttgtttatttgcattttctaatattttaaaatttgtatgttttggtggttacttaaaacttcaaatgaatatactgtagtgtagggtgaacaaattggcaggtagcattgtgtcgagcccctggagcacattgcagatatgtgtcactgtctggggacagactgcacaggtggctgacaccacgcacatgcactggccctggctctcccagtgctcctggctgcccagcttcaggcccggtgctggggtcctcagagcatcgtctcttgggtcctgcaggtttaccggaagcagccctttttaaaccagagacattccagttttctttctgagagtagaatatccaggagcacatggtcaaaagaaattatgtttaacccagaaacaacttcctcttcctcctcttatttgcttactttttaattatatattttcatgttttagggaatcctgcggggaaggcagcatgaaagtcctggaaaagaggctgaaggacatggggttccagtacagctgtattaatgattaccggtaggtggcctatatatcaatgtgctcttgtagaggtggtgtatgattttggaggaggtgggctgccgaaagggtattgatggctctcagctctgaaggccatggtgtcttccgggtggcttctcggtgtggaggcaaggagcactttctggcctgagtttggccagggccccacccactgctgtccagagtccatcttcacggcactggacgtttaaagaacacacagagcagcactttctcatttgctcatgcccagttctctcctcactgtgcttactgtgcagcgagatgctggagtacagggactgaggttcctatgtctttggatctctgtgggatccctgtgcatgacaggtgctaaggtgggagcttgtttgaggtatttacagacacatcttgaccacagaccaataggaaaataataataactaccacttggtgagcagctatgggccagacactttatatatttataatcaggtatcatttgtgggccttgttgcttggacattttttttaaaaaaaacttggctcaagccctaaggtagttgcaagccatctctggactcaaacgcctgcctctggctctctctgccccagcccctaagactgtggacctgctgattctgcaaggggctggaatccaacattgcaaaaactgagtggttttcttgaacatttctgagtgtcgctgggtggaaatgacgtcagtggtcttttgttgcctaacacccttgattatcctgcttctctgccactctctgccttccagcagccccatgggctggatcattctcccagctgagcaaagcaccctaaacgtgtgaaccactccctcccactccatgcctcctcaagacaaggagcccctcaaggctgttctgttatctgtaccttttactcataaattattgccagtgctctcaaaagttagatgttgtttatcaccccttttaaatacaaaacaaggcaaatgtccttttctggaaatataatctatgtacagaaaaatatacaaaccatgagtacacaggtggatgaagtttcccccatttagtgcatacctgcaaccagccctcagaccaataaacagaacatactcagcatccccaggggctcccattggcctcttttggtcaccacccccatagtaaccactctctagatttataatgccatttattagttttatctgtctttaagctttaaactcagtgacagagctgagttttgaacccagctttgcatggccttaacgcacgctctttccctcctgctaccaagctcttccttccttaattgaagctccagtagtacattttaaaaaacattcaattcttggccgagtgcagtggctcatacctgtaatcccagcactttggaaggccgaggcgggcggataacaaggtcaggagttcgagaccagcctggccaacatggtgaaaccccgtctctactaaaaatacaaaaattagccgcgtgtggtgactggtgcctgtaatcccagctactcgggaggctgaggcaggagaatcacttgaggcagaggttccagtgagccagggtgacaagagcctgggtgacaagagcaagactctgtctcaaaaaaaaaaaaaaaaatcagttcttaatccaaaacagctcaatagccaagtgcagtggcatgcacctgtagttccagctatttgggaggctgaggtgggaggattgcttgagcccaggagttcaagggaacagtgagctatgatggtgccactgcactctagcctgggtgacagagcaggacctggtctcaaaataaaacaaagtaaacccctagccatcgccccctcaaaaacaaacaaacaaacaacaacaacaaaaagctcaatgatggagaaaattgtagctaaaattgttgcattcacaaccactttgctttgtttttatgtcattgggctgagttataatagccgggccagagcccaggtctccttgcccctcacggctgccctgggtctgggcttatgtgcttcctctctattgtgtccctacctcagtcagcctcagggctcttctcttccaggcctgactcagtaaagaaatgaggaagctcccatttctttattgcccataggctgtttctgtgttagtgtcaggagcagagaggatataatgaaaggtataaatgggaaagtgatgagggttaacataacaaatccaactccaacccagatgtgagaaactcctgcccctcacaattcaggtggcattgccttctgccccacatcagtagaaagttctccctgaggttcttgcccattttggagggggcttatcttttcatggcctcccttaccttctggttggtttctgccagtactgtgttgaatcagactcagtgaaaactccatacctgtttttgggcataaacaatgacagataactacttttattaaaaatatgtgcatcacatatacaccatggaatactatgcagccataaaaaggatgagttcatgtcctttgtagggacatggatgaagctagacacaatcattctgagcaaactatcccaaggacagaaaaccaaacaccgcatgttctcactcacaggtgggaactgaacaatgagaacccttggacacagggtagggaatatcacacactggggcctgtcgtggggtagggggaggggggagggatagcattaggagacatacctaatgtaaatgacgagttgacaggtgtggcacaccaacatggcatgtgtatacatatgtaacaaacctgcacgttgtgcacatgtaccctagaacttgaagtataataataaaaaataaaaatatgtgcatcaagtagacactactgaaaggtagctgagtcaaggacagaagacatggcatgccatagagacaacaatatcacgttcctgttcttccatagtcccctgcagtgatcgtgccacagagatcctgtctaggcttgcctcctacctaactccccgtgtgccaccaagacctggctcctgtcttcattgctgcttcccttcccctcctggtggcttggaacttcacatcttctccctctgttgtgcacagcaagttagctttcctctctgatgcctgagcattggccatcacccatgtggttcaagtccaaccttctgcccaaagtacttatcaggtcatacgagttgtacgtgcatacagaannnnnnnnnnnnnnnnnnnncagcctgcatagttcaagttcagcccttcaacttgctactgtgagaacttgggtgggttattgtggtcagctttctcaattgtaaattggagaagataaagcacctattccatttggttgttatgaggattacatgacatgatccttacaaaagatataatcaaatgtcttggtacgtaggaagtgcttgataaatgctggctaatattttcatttgttttagtttttctagatacaaggcctcactctgttatccaggctggagtgcagtggtgcgatcatagctcactgcagccttgaactcctgggcctcctgcctcagcctcctgggtagctgagactataggcatgagcgtctgcacccagataatttttagatttttttttttttttttttttgtagagccaaggtctcgctatgttgcccaggctggtctcaaactcctggtctcaagcagtcctcctgcctcaacctcccaaagtgctgggattacaggtgtaagccaccgtgctgggccactaatatttttagaggaaatagtttgtgtattatttgaggtcagagactactgtatctccaggacttttcaggcaagccataaatggttgatggatgaaagttatttaaataatcccttaaatattattttctttctgtagaccagtgaagctcttacagtgcgtggaccacagcacccatcctgactgtgccttaaagtcgtaagtaaatgtcttaacccaaatcgttctttccaaagataaccatctcctttcagaagttttcagttcacaaacatgaacatattatcagaggcagatgtaagtgtgctcattggattctggtttggccttatttttatttatatgtatctgtcttagtttttgtacaaaaagcaatcacgctacacataacgtcctgctgtgagctttcttcacttgctggtgtaatggggccaccctttaaagtttgttcatacttctgtcctagtctgttagtggctgtagagcaatctgtaggatggtcacactacctttttttttgggaggcggggggcagagtctcgctctatcgcccaggctggagtgcagtggcgcaatctcggctcactgcaagctccgccttccgagttcacaccattctcctgcctcagcctcccgagtagctgggactacaggggcctgccaccacgcccagctaatttttttgtatttttttgtagagacggggtttcaccgtgttagccaggatggtctcgatctcctggccttgtgatccgccttccttggcctcctaaagtgctgggattacaggcgtaagccaccacgcctggcccacaccaccttttatgtaatcctttctgagtcatgggctggcttggttgtatgttgttatagtagttgttttgctattataaacaatgctgaaatataatccttgattatatactttaagctgttgtgcaagtatttgtgtaggatagattcccagaaattgagttgctgagtcaaagaatgtgtgtgtattttaaattttgatatgttctgagaaattttgatatgtttcaaaaaggctgtgccagcatacacttccaccaccagtatatgctaggagtgcccgttctccactcctccacgctatgtattttctatatccatatctgtatctgtgcctgtacctatagcctatcattttagcccatcttaggggtaaaacatagtgcattattgtcatttcagtttgggtgggcaggaagatttctgatccctccacttgaattcttttccgaaatctatttactaacatcatacttatcctgacaatccaactcaagtgttctttgctctgtgaggctttcctcattctccacgttgattgaggaactcccttctctttgcttccaaggactttgtacacaacctgatgacagtgctttactcttcctagccctgctatcgttcattctgtaccatctgcctgcctcactctgccttcctctttgtgtttctcttagtatttttcattacagttgcacatagtaggtgcaccatctatgcctgtaggatccgttcttccatctacaagggaagagaactaatcagagtgcacagtaactatatgctaggcatttgctgtgtgcactacataaaatagtatgtttatctgaataaccagtacattaaagagagtcaggctgggtgtggtggctcatgcctgtaatcccagcactttgggaggctgaggcgggtggatcacctgaggtcaggagttcaagacctgcctgaccaacatggtgaaaccccatctctactaaatacaaaacattagccaggagtggtggtgcgtgcctgtaaccccagctacttgggaggctgaggcaggagaatcacttgaacccagtaggcagaggttgcagtgagccgagattgcaccagtgcactccagcccagtcaacaagtgtgaaactccatctcaaaaaataaaataaaataagagagagagagagagagagaaagagagcacatgcactggtgagctggcttgtcatccccatatagttcttattctctttttcatttagtaatagaacccttgaattttagatggttcatggctatcaagaataatgatcctagcctctctacccactgtggccaagtgacatgtgcaatttctgggtttagcacttgaaaggaagggacttacattccctttctccttttatgctggctggtatatgggcccacaagatgtggaggtgagcgtcttcaactgggcgtggcagagtaacacagcaaaaggaagccgggtgcctctgtaccatggcatcactctaccagccctgaagagttactgagagagaaataaacatctgtcttctctaagccactgtcatttagacagaagccagattttatttgatccaatgtgggtaggttcatattctcccttcagaagcaaagaaactctggctcagagaagtttatgaaggactcacccaagaccacccagctagtgcaggcagaaccaggatctgaaggagtctgagaactgtcaaaattcactctggcagatgtcttgctctttgggctggaaattaggacaacagacccatcatctccagcatgtattctaggagccaacatcccagggttcggtgatggatttaagtcctctcctcattctttaatgctattcgttccctgtgaatttggcatgcatcgtttctgagtcctttcacaggaggtaaaggatagcctgtgaacctgggtctttcctttcctcacctgaaaatgaagtccaccctcatgtcgctgctgctcaaaaaccttcaaagttacctactaccaagttcagacttctagtcccatcttccaggttcatcatactctttccagacacgtcacccacagcttctcatctggaatgtttatttcaaggctagttttgatccacttcccataagatatcatatgctttcctgctcatcagcctgtggaaacaccgttttggcagtagtaagcactctgttcttactgagttagtcagatgatctgaaattgtcagttttcttatctacaaagcctccatgaggttaccctgatccctgatctcaatatttaaaatcatagcctccatctcacaactgtggctcttcaaaaccctcatgtgactgcattttttttcttttttatagtgtttatcttctgactgacctacttgtgaagtgcggtctttttttttttttttttttttttttgagacgaggtctctctcctctctctgtcacccaggctgtagtgcagtggcacaatcacggctcactgcaggtttgacctcctgggctcacgtgatcctcccacctcagcctcccaaacagctggggatacaggcacttaccactacgccagctaacttttaaagtttttttttttttttttttgtagagatgaggtctcactatattgcccatgctggcaaattcattctttagcgcctcccacctgtcagaacatgagctccaggaggtcagggactttgacctgtttttttcactgatgatggtattctaaggacctaaaacagaacttgcaactcggtagacacttaggaatgaatgaatggatgaatagatgaatgaacgaatgaatggttggattctaccctggaaaggcatagatttaagaagaacgatgttcaaaggtgctgggcagccagaaggaatgacaaatgctctacaacaccttcagagaagtgcccagaggctgcatatgcataaggtctacattttgattgcaagaaaaagaatccttgtgtggctcacttatgtggaaaagggggaataaagttgttgcaaagattagtggtatagactttctaaggagcctggaacctcataagtcttggatagggaagtgtctgtggtgttagaattacttaggtttgtatggttttactctttgtctcattaatcagactgtcaacctatacagaaacagaccatgtaaaattccttgttgtaaaacccactgcaccctacaccaccattcctgaaatgggcaaatggtgccatcctagcaccagtgccttgggttagctcccctgctgcaggaagaataaggagaacgagggtagctcttctcacttttcctcggtatttttttttttttttttttgagatggagtctcgctctgttgcccaggctggagtgcagtggcgtgatctcggctcactgcaccctccgcctcccgggttcaagcaattcccctgcttcagcctcccgagttttcctcagtatttctgagcactttgcagtgtcaggcttccagctggcactctggagtcatcatctcattttactccaaccacattcctagaaggaagacagtttgattgtcatcaatgatgctgaggttcagaaggattaagtgatcacttaatgttactcagaggccgaagcaaaacggagatttgtctgtgtgtaaagttctcattcttcctaccacaccacactgccttaaaatgtctctgggtctcacaccacagcaggtaagtaaggggtttgcagttcctgacctgttcttccctgtgtgtgggcattctttcagtgactgttggtagacatttttgacaattctggctgattcctttgaatgtcaaggataaaactctctttcactctgccaagtttttcaccaactttcatcaccctggcaggaatttttctaatctattttttaaacattctagctgtgaatagtcatagataatttacaaaagagaaaccacaaatagcaaatatacaaaattatttaatcactctaataataatggaaaacaaattcaacaaggtgtcattttcacctaaactttcttggcatacattaaaacatagcagaaaaatgttttagagatgttattcaatgcttgatgtcactgtaaattgataaagtgctttgggaaaacaatttgacaatatgtgtcaagaattagaaaaatatcacagtctttgacctaggtcacactttagggtacttttggtgccctattccaaacaagtgatttgaaatgcacatacagcctatatgctcaaatatgttctccagagcattctttataatactgaaatactgggaactggactcaaatatccactgacaagtaaacagttacatcaaagggtacacttactggagggagtagaatatagcccttaaagacaatggtaggataatcatacagcaagcagaagaccccatgaataatccaaggggaaaaaaccaaccttagcgcttataggttataatattggccaaaaattcagtagacttttaatctgcaggattggtgatgatatgagaaaacagacatatagtactggaatgaggactcagtgtggcactaagggccaaaggcaaacatcagatcttttaacttagctggaaggctctatcctaaatgccccaggccacagagacaggactactcatctctacttgtttaggaatagtggggtaaagggcttttaatctgcaaaggtttcaaatgaaataaacaactgttgatgtaaatccacccattttattaatagttttgtggtaaatttagggacaatctgtatgttttggtatttaattattggcaatattttagagaatgtagcatataagaacagctgttggattaaacctgtgatgccagtatatgggttactattaagtaactaattctttttctttttttttttttttttttggagacaggttatcgctctgtcacccaggcatggagtgcagtggtgtgatcatggcatattgtaacctcaacctcctgggttcaagtgatcctcctgcctcatcctttcaagtggctgagactacaggagcaagccagcactactggaaaattttcttttcccttccttccttcctttttttttttttttttttgatggagtcttgctctgtcacccaggctagagttcagtggcttgatcttggctcatcactgcagcctccacctcctgggctcaagtgattctcctgcctcagcctgccaagtagctgggcccacaggtgtgagctaccacgcctggctgatttttgtatttttagtggagatgaagttttaccatgttggccaggctggtctcaaactcctgacttcaggtgatccttctgccttggcctcccaaagtgctgggattataggtgtgaaccaccatgctcagccaagtaactgattttaggcttgggatttttagtaggaagttataagagaattttactaagttttgaaccagtattggaatttgtaaaagaattaagattaaattttatacatttattaggtttactacaatcaagtaattgagaaagttttgctaatttaaagtcatttaaaatattttttaaaaaagatgtaatattttaatatttaagttgaaaataacctgaagccttgcccagtggctcatgcctgtaaccgtagcactttgggagttcagtgcgggaggatcacttgaacccaggcattcaagaccagcctaggcaacatggcgagaccccgcctctacaagcaaacaaacaaaaaattggctgggtatgttggtgtgcacctatggtcccagctactcaggagtctgaggcaggaggattctctaaacccgggaaggtcaatgcttcaacgagctgtagtcatgccactgcactccagcctgggtgacagaatgagaccctgtctcaaagaataataataataataataacttaacctgaaataacttgagtttaaaacatcacaggaattaagtaagtgtgacaaatccttaagagttattgtcagagttcaccaggtttttaaatagaacaatgtgatttataaattaaataaaagggcatgggaaaattaggcttttgagtatataaatgtaataacaagaatcaattttaaaaatcaaagtaactgcaaatagtgcagttaccccctcaagtatagtctcacattgacaagaaaaggtttttaagctacaaagtgagaaaccaatgcacagaacatgaaccgagacatgtaaaccagaagaaagcaaaacagcatgtttctatttgtgcatgataatggatgtaagtgatagaaataggtctgagaaagtaaactccaagcacctaactgtgggttccttctaggcaaaggaatagaaactggaaaaagatgaagggaggctgtcattattagtgtatctaattatgtgttattttattttttaaaaaagtaaagaaaaatgtaaccttatgttaattagttaattatttgaaagcaaaagtaattttaaattttgagtgaatcgagtctgggacattaactgcatcacaggtgcaattgtagaaaatgtccggtaggtggagcactaatacaaacctgtgggtcagatttctttagcaaaaaagagaggaccagcattcaaatggagtcaggaacttttaaggacagggccactagtccagagccatgggatatatttccaagccaacattagatggtttcataattttaaaattcatcttttagttggtttaaaagaattcagtaatttctgtttttacaaacccagtggccagatactgtttactatgaatagggtccatattttgggcaggccctctgttgatgtcttcatgtcaggacaggtttttcttcaccacttaaactctgatcatgtaatagccatcagtaggaaacctggctaacactgtgttccatccgtacaataagaattcatccacaaggaagaatgagttaactccctgtgtaccaatatggaagcatgttcaaaatatgatgttaggtgaagaacgcacgttgcagattccatttgtgcttagataaaaggatatctaaagacatctaaggataatttgcagggcagcagcaggtcctgttgtctagagaagctttttgctcaggaaagaatgtcttgagatggtatttcaatgacgtgtgtgctcaggattgcagaaataggaattagttatattgagcaggttcagcatgcatgtgttcattgcattcctggaaagagaactcaaactatcaaagttggttttctatggaaagtgcaaatggggagactaagagacttttactttccactttataacttcctatatactatgtacatttctccacagtgtgcacaatttgctttttttttttttatactggtagcagtagaatttattcaaatgtgccttaatataggcactggggcttgcctatggtgctctcgatatataaggcccggacattctgccagtttttctgccagtttttcttgagcaatgtcaccaagaagttgacaggcaggtgactgttacacacaagctcattgtctgtccttttcacgtggccaacagccacagccagacataacaccttcttcatgtggaaattgattacggacttcatctcatccactttggccaccatgttttccttgtgtgtgagcagggaggggcaatttcctgccttatttaggactgggccgaggattcgtgggatctgcttgatcagagactctgaggccaaaaatgcatcatactcttggccagtttcttgaccagtttcttattcttgttgagttttttcagtacctcgttttccatgtggtggaaatccacaggcttggccttgtcacagtgctgctggttacccaggacacacatggagaacttggggcagggagtggacttaagcctgacggtgcccgagaagcgcttgtccttctggggagtcatagttcttgaagctgatctgcaactccaccatctccagaaacttggggtgcttgcgctggtttcggtgcaggacttcgcgcaccgcctcctacggggtgtcacgggagactttgctgctcatggcttctcgctccgcgctaaccagaaaagagactaatactgcacatatatttttgagcgtagattccatacaccaatactgacactttctctatttccttgttaatttgcagggcagcagccgctactcaaagaaaagccccaagtctttatacagaacaaagggcgggtcttatcattcccctctttctggtgctggcttccaggactcaactgtaactggaaactgtgttgctctaaccctcctccagccctgcagcctccccttgcagtcatcattcgtgttctgtgtataccaaatgattctgttatctaaagaagctttttgctgggaaaacgatgtcctgaaaatggtatttcaatgaggcatatgttcaggatttcagaaacaagaagttagttctatttagcaggttaaaaaatgctgcattagaattaaagcaagttattttcttatttgtataatgacacaaagcattgggagtcagactgcttgtatattatcaaacattttaagagaattctaataaagctgtattttacatcatctatattttcctatatctccagcagcacggacactgcatgcttgttgattgcttaagacatatgtatactatataaatgtatgcatatatggtctgcaaagttttcatttttcatttatttggtataaagatgttcagttaatggttcctttttgttttgagagacagagtttcgctcctttgcccaggctggagtgaggtggggagatctcagctcactgcaacctctgcttccaggattcaagcgattctcctgcctcagcctcccaagtagctgggattgcaggtgcctgccaccatgtccagctaatttttgtatttttagtagagatggggtttcaccatgttggccaggctagtctcgaattcctgacctcaggtgatccacccacctcagcctcccaaagtgctaggattacaggcgtgagccaccacatccagccataatagttacttataatgagggaaaaacccaaaatatccagtaatatttacatatttactgaaactgtttggaacttgtattagtttgttcttgcattgctataaagaactgcccgagactgggtaatttacaaaaataaaaataaaaaagaggtttaattgactcacagttctgtgtccagaattgtgacaaaattgtgacaacctctgggtttttggtcttgctgacttcaagaatgaagccatggacttttgcagtgagtgttacagctcttaaagatggtgtgttcagagtttgttccttcagatgtgtctggagtttcttccttctggtgggttcgtggtctcgctgacttcaagaatgaagctgcggaccttcgcggcaagtgttacagctattaaaggtagtgcggacccaaagagtgagcagcagcaagatttattgtgaagagcgaaaaaacaaagcttccacaatgtggaaggggacccaagctggttgccactgctggctcggtggccagcttttattcccttatttggtcccacccacatcctgctgattggtccattttacagagcgctgattggtccattttacagagtgctgattgatgcatttacaatcctttagctagacacagagtgctgattggtgtgtttactatcctttagctggacacagagtgctgactggtgtgtttttacagagtgctgactggtgcatttacaatcctttagctagacacagagtgctgattggtgcgtttacaatcctttagctggacacagagtgctgactggtgtgtttttacagagtgctgactggtgcatttacaatcctttagctagacacagagtgctgattggtgcatttacaatcctttagctagacagaaaagctctccaagtcccctctcgacctaggaagtccagctggcttcacctctctgttccacaggcttacaggaagcatggctggggaggcctcaggaaacttacgatcatcatggaaggcaaaagggaagcagtcatgtcttacatggccagagaaggaggaagggagtgaagggggaggtgctacatgctttcaaaccaccagatctcgtgagaactctgtcatgagacagcactaggtgatggtgctaaaccatccgaaaccacctccgtgatccaatcacctcccaccagaccccaccttcaacactggggatcacaattcaatatgaaatttaggtggggatacagagccaaaccatatcagaactatttacatgggttttagaatatttgtagaatggagtatcattcaacaagtaaaagccatgtttaccaattcacatgtccttcagatggtgaaggaataaactaactggtaaatctacaccatggaatactactcagcaataaaggtaactaccttgatatatgcagcaatatggatgaaacccaaatgtgagagctgccgcaccaaaaggccaccaactgtatgattctatttatatgacatcctcgagaaggcagaactatagtagcggagagcagaccagtgattgtg

SEQ ID NO: 16422 - DNA, 29769 bp, Human
tcacttggagagtgtcaaggaagcagagggacacattaatggaaatgtcagtttccttcctcgcaactggggctcacttcagtggccactccacaatgaaaataaaaatgagaatttctgagcctgggcaatgtagtgagaccttatctctacaaaaaataaaaaaaaaaaatagttgggcctgatggcgtgtatttgtagtcccagctactggaggctgaggctggaagactgctccagcccaggagctcaaggctgtagtgagctatgatcatgccactctgagtaacagagtgagatcctgtctcttactatatatacagatgagtggcactttaccatgtacaaaatgcaaaatgctttgaccatatgcttgctcacctctgatgctccagcaaccctttaaggtaaacaggagatgcacgatttcagccatttctctcatgaaaaactggatgtcagtgctggggctgaaattcaggtctttgaattacaacagctcatcttcatcccagtgactttgaaacagcaaatgtttttctggtaaaaaataacagaatacatataaaaggctcagaagactgcttggcacattaagtgatcaataatgttagttcacgttcttattttaacattaagcatgctttgacaagtcaggacttgcgtaaatatcattgagtcatatttctgccgtcagtgagggacctgtgtcaacttttggtgttttgagggttaagcaattgttttcagaaaaactctaagggaaacacttgattcccaacaagcctttgtcttgctgaacaaaggtgtggttaagtggaactctagctattgaagacctgtgttcaaattcccactcttccagacaagtgtctgtgactctcatgcctcagctttctaatctgcataggattatcgtgtggagtaaagtgaaatagcacaggcagatcacttagcgcagtgccttggatataaggagcactaaatagatggtgctctcctctccatccagcctcctagcagttctatttctgataatgaagcttctgacaacaaaatgtgctgctggctgcatcctcttctctagtgacatatttctgcatgctttacctggcacaagtttactgaacaaacatctgtgtctgctgtgtacaaggttatatgtggatgggaagtgacacaaagatgtatgtaatacagggttctgctatcaagaaggttatgagagtgttagagctctggttctctatcagtgatgaatttgcccctaggagacaactgttaaatctggagatatttttgattcttatgagtgaggggtaggggtttgctattgatttctagtatatgcaggccagggatgctgtaaatatcctacagtacccagggcagcacctgtcacaaataattatctggcccaaaatgtcagtagtgctgtagatgagaggctctgtgttaaagatacaggccatgggcagaaataactaatatacaagggagaaaatgccaggatctgtgtctggcgatgggtggcatgtagtaaaagggccatttggattaatgggtataaatttacggttagatagaagaaataagacctagtgtggtttgtctcgtctcggcagtggactttcagctccttgagcgtagcgacctcttctgtttttttggcaggtgggaatacttaaatctctattttgatgcacaattaaaaataaaaaattgccaaaacagtggtcgaaaattgtactatactatattttacatgcttacacttcacaaattaatgctcgtaaaacacccgctctccaccctcctcgcccttagcccggctcgctgcacgccccgaggcccagcacttgctggcgggtgggaggaggggcttcgccgatgtccccgtcccaggggcagggcctggccgaagttacagtccctccgggtggcggggcgccccgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactgggtaatgctgcgggctggggctgctgggtctccgcgggggtggccgggggctttcgtgtggaacccggcggggggcagtctagaggaaggtgggggcccctgtgcaccccctgactcgtgttgcttgcacgtgcgcgcacaggtctacgcgtctattcctgtttccgagtgcgtgcgcacgccagtcccagggcgctgggcctttgctgtgcaaggaggtgctccgtgggcctccgccagacccaaaaagtccggcgtgactcgggagagaattccaaaggggaggaacgggagcaggggtgagaggacggagagagagtgtagaaggaaggctctagaatgagacagcccagtcccggttactagtcatgagaccgcgtattgattacctaacgccgtaggacctcggtttccccatttgtacaacggagattctgacagtgagagttgggacgattagatgagataattggtgtcgttgcacataaattacctgacgcctggtaaaaactgtttaaatgctgtctattaatgttactattactacccacccctgttcttttagccccattggatctgacagtttgaaggctcagcacggaaaaacgctgacggcttctttgctctgcaaagactatttcaactactttgcatagtcaggtgtcaatttccaggaggcggcaagtcggagcagagctgatacatggccaaagacccttgacctcagccgctcagcaggcctcagcaatttcccggtggagacactgccagcggcagcgttctgggagcttagttagcagcagcagcacagcagcctgggcaagagttcccctgggaccagaaaaaggctttcaggattttctttaaaaaaaaactatctaatttttatagatgaagggggcaaaagtacagtttagttacatggatatgttgtgtagtggtgaagtctgggcttttagtgtaaccatcacccaaatagtgtacatttaccaaggttttcttgttgctcagaatctggtacaggaatatgcttctgaagaattcagtcacaccactcccttcctgccacccatctgctcagtgcttggggacactgatgagggcgctttcccaggtcttcagagatgcatggtggtgacagaggcagcacttctgccaagggccaggcactgtgttcccagtaccagagttcccatagactcttaatgcccccaatatctttaaggcagtagatcctgttagcgtcatgtgttagagggtgaaggctgtgctttctcctggtggtggcactttggtttaccttggtcttggcagaatctggagagctgatttacctctggctcttggtctttcccctccgagcttcttcctgccatcttagggagggctaggatgatggagacttttcattgtttcagtatcccccatgggataacaagttaattaataatataacaaatgttgatgaatagatgctgtgtttacagcttaaggtagagataattatctctggggacttcagaccaagagaccctgagtaaggactgaacatcccctgtgccaggagctttagcatcttccatttcatttaattcttacactgaccctgttaatcatcaacaaacaacctcttttgttgggaacctctgcccggcatcggagtgagaaagccactctggcagagctgggattcaaacctgatctgtctgatttccaatcctaaagtccatccctctctgctgcaggacagggatcctttgtgagctgaatctggtctgccacctgtttttgtacagcccaagagttaagaatagttttacattttcaggtggttgaaaagaaaatcaaatgaagaattatattttgttgtatatgaaaattaatgaaattcacatttcagctctgaagatttattggaacacagctgcacttattttttccccctatttattgctgtgttctgttacaattgcagatttgagtaacaacagataccatatggccagcaaagcctaaggtaattgtgatctggccctttacagaaaatttgctggcccttgatgtctctagaagtgcagggtttgtgttttagaggtgaatgtggaggcggagtagagtgtttggaggtaggagggcctgggatggagcccaatatagggtgtgttttcattgaagcctcttacctgtctccactctgctcctttatttttctttctttttctttttcttttatttaaatggagataaggcctccttctgttgcctagcccggagtacagtggtgcgatcatagctcactgagctcaagtgatcctctcgcctcaacctcccgggtagctggggctacaggcatgtgccaccacacctgactaattttaaaatttttttgtagggactgggtcttgctatgttgcccaggctggtctcaaactcttggcctcaagagatcctcccacattggctcccaaagtgctggcattacagacgtgaaccactacacctggccaactcccctcatttctatgtgtgactctttcatggaataacaactcactgcctcttaaccaaagctgttttctccttccagtgggttgccagcgttgatgtggtggagaatgaagaggccagcgctagcatcattgttaaaatgacagactcgttcactgagcaggctgaccaggtagtttcaaaaaggcccccaaacattgtgaggggaaccctggggagaggtgaccactggctgtatgttcttcctttggctgtatgttcttccttttatttctttttttccccgagacggagtcttgctctgtcgcccaggctggagtgcagtggcatgatctccgttcactgcaacctttgcctcctgggttgaagcaattctcctgcctcagcctcctgagtagctgggattacaggtgcctgccaccacccccagctaattttttgtattttcagtagagacggggtttcaccatgttggccaggctgatcttgaactcctgaccttgtgatccgcccgccttagcctcccaaagtgctcggattacaggcatgagccaccgcgcctggcctgttcttccttttttttaaagctgttgtttctctaactaggaaagccatttgtgttcattgaggaaaatttggaaaaagtgaaaaatgatacaaagataaattatataatcattttgagttagttcactgttaacattttggcctattttcttgtctttttctatgcatattgtatgttactccttttacaagtttaggtaattttgtattttatagtttatggtaagctttgtttttttttttttttatacttaaataattctccagattactgaaaaaacctctttgtagatgtgtgatattccattttatggaatggccacaatttatttagtttgtttattgtacatttgagttttttgcaggatttttgttttactattgtcaagaatgttgtgatgaacgtctttgtctacatatctgattattattgttttttgttttaagagagtcttgctctactgttgacactggagtgcagtggcacaatctcagctcactgccacctctgcctcccggattcaaacaattcttgtgcctcagtctcctgagtagctgggattacaggcatgcaccccaatgcccagctaacttttttgtatttttagtagagacaggtttttgccatgttggccaggctggtctcgaacttctgacctcaagttatccacccaccttggcctcccaaagtaatgggattataggaatgagccactgcacctggcccacatatctgattatttaggatacattctaaaaagtggagttacccagttcacagcaggaacactaacaaaacaggttatttttaattataaaatgatatgcatattataaaacaaaagtccaacaaaactacgtaaatatagaaataaactgtgaaactgtcccttttctccccatcatagtatcatttcccagaaggatgcactattaacagtttgatggatatcctggtataaatatcttagatgctctaggctgggtgcagtggctgacacctgtaatcccagcactttggaaggctgagatgggcggatcacgaggtcaggagatcaagaccatcctggccaacatggtgaaaccccgtctctactaaaaatacaaaaattagctgagcgtggtggtgcacgcctgtagtcccagctactcgggaggctgaggcaggagaatcacttgaacctgggaggcagaggttgcagtgagccaagattgtgccactgcactccatcctgggtgacagagtgagactctgtctcaaaacaaaaaaaaaaaaaagaaagaaaaatctttgatgctcttaagcagtgcttaactttcttgagaagcccttctggtgagctgcctggatgacttttgagtcaggttctcactgtgttgcccaggctggactggaactcctgggctcaaaggatccttctgcttcattctcccgaatagctgggacttcctgagtagccactgtgcgcagctgactctgtgtttaatggtttttagtgctgtagcccacattcccaaggataacttcacatcactatgtgaagcgccttattttcccaaccactcagtgtggcaggcaggcaggccattttacagctgtgaagacaagtttgcgcgactaagtgacaaggccaacaagctactcagtggtggagtcaggatcataggtctccagatacgaactttaataagttcaggtgccacttggtctgtacgtgggtctgcttttcatttagttgcactttccttggtaatctcaatactgatgttttatgatccttatctggtttttataacaaatttttaaaattttagaagtgatgcatgtatgatatagaaaatacaaataagcaaaaagaaaagggaaatcatttatagttctaccatatagttaatcatttatttatatttccttccagtctgtctctccaaaatatacatgtataaatctatacattttgaacataaaactgtgagcacaactctgctactcatttgctctttctaaagtgtcagtttgacatagattggaatgtaaaagccagatgacttattttagcacttcatttttgttgttcttatttttctcactgtggtctcaatgttcccatacctaagtcatacagattgaccttagtgaatttaatagtgaaagttgacatggcatcattgttagttgccaggcaccattctcagtgctttattttcattaacacgtgtagtcttcattacatccccaaacaaagcttctaattttatcctccttttaaatgggggtaactgaggcacagaaaggccctggtatttgtccaaggtcaaacagataaaaggttgcatagccactatttggacatgggcagtgggggtctgacggctgttctcttaactgctatgctaagctgccttaaagcaaaatagtttcatgtgaataaagtaataaaggccaaaatggctgggtgcagtggctcatgccagtagtcccagcacttcaggaggccgaggcaggaggatcacttgagcccaggagtttaagaccagcctgtgcaacatggcgaaaccccatctctacaaaaaaatacaaaaattagctgaatgtggtggcacacaactgtagtcccagctactcgggaggctgaggtgggagggtggcttgaggctggaaggcagaggttgcaatgagccgagatcatgccactgcactccaatctgggcaacagagcccaaccttctctaaaaaacaaacaaaaaataaagtaataaaagccaaaactaaatggaagggcggttcctgggcttggagagcagcagccctgccaggtgcgggtctctgtaattggtgtctcttcagtgtctcttctgctctgattaattataggtttctaatgtccctgtagattgaatgtggaggttgtccccacccaaggcttggcagtagagtgcatctctaagacagagattgagagatgcgtttgtgcttataaacttttctttgaaaatctcttccttcttctactactccaccaaaggaagaggagtaccttctccaccatacccccaaccttaagaatttctgaacaaacagcataacattcagttttgtcatgaaactggggaaagaggtaatcaactgaaatgttcctactgggagagacacagggtgttgatttaagtcttttttaaaaaaaactaaatgtagagatgaggtcttgttatgttgcccgggctggtcttgaactcctgggctcaagtgatccttctgcctctgcctcccaaagtgctgggactactggcatgagccactgtgcccagcctgatttaaatcttaagaagattgggccaggcgtggtagctcagtcctgttgtcccagcactctgagaggccgaggcaggcgaatcacctgaggtcaggagttcgagacaagcctggccaacatggcgaaaccccatctctactaaaaatacaaaaattagctaggtgtggtggcaggcgcctgtaatcccggctactcaggaagctgaggcaggagattcgcttgaaccggggaggtggaggttgcagtgagccgagatggcgccatcgcactccagcctgggagacaagcgaaactccatctcaaaaaaaaaaaaaaaaaaaaagaaatcttaagaagattgatcttaatgaagcaattgggatttgtcatctcagccattccagagaaatacggaagagtcgtggtggatggccagaattgcctgtcctgacagactgttcttttcataaattataacaagagggcatacatatattttcaatgctttaaaatctcaaacaaacagaagcagagagatcattaaagtgaacccccatgtacttaatattaccaacatattgctattgactgtattttttcttggctcatgatttttcttacaatttttcgttggcatttttttcagagttgcagttaaagggatttttggattggggtggggaaaacagggttgatcttctttttggattataattctgtgatttgtgaagagagtctggaaagaaatacaccaggatgttaactatgtgcaggcagtgaagctctaggtgcttttttcttttttttttaacctttccctacttttatttattaattgttgtatttcaagggatgctcatgtctctacctttcagaatgtatacacagagactctagattgttttttaaaaatcacactgaagtgtacttgggcttcaatgtctaaaatgctcatcagagcttagtcttccgtctaattctcaaagcattaattgccaggtactgtaaactggcttaaaaagaagagaaaaagaaactgagtatccgtaaagatgctagcctgtgttggcttaccttacagtttatacatttttttgttcttgtgttgaaggtgactgctgaggttggaaagctcttgggtgaagagaaggtggatgcaattctttgcgttgctggaggatgggccgggggcaatgccaaatccaagtgtgagtcctttcctgagtcactcatttgttctgctctgctctttttccagctgacaaggattgggtttgcactaggtgacaggccagctgtttttttgtgtatatcccggaatctttacagttgctcggggagagagtgattaatgctcttaatccattttacggataaagaagaagcttcccctggaggacgtgaggggacggggggcattgagtttgagtttaaagtagaggcagaatgaaatcagcatggcctgtgccccaggccatgtgctattcaggcattggaggatgtgtaggaagtgcagagatcatttagaaagtcagaagaagtcaaacttgagattttactaaagctgattccttttttcatcttttcttttcccttcccttccctcccctcccctctactcccctaccctttttcttaagacagagtcttgctctgtcaccaggctggagtgcaatggtgtaatctcggctcactgcaacctctgcctcccaggttcaagcgattctcctgcctcagcctcccgagtagctgatattacaggtgcccaccaccaagcccagctaattttttgtatttttagtagagacggggtttcaccatgttgcccaggctggtcttgaactcctgacctcaggtgatccacccccttcagcctcccaaagtgctggggttacgggcgtgagccagtgcgcctggcccatttttcaacttttcattatgaacatttctaagcataccagaaaagttgaaagaacagttcaatgaacacccttatatgctccatctagattcagtaactgttaacatttgctgtacttgagttgagcttgttttcttgtgcctgtgtactttgtgcattgttttttgttaactgtttgaaaataagtttacacctcactatatttccgcgtgtttctccaaagaataagcccgtcctacattattatggtaccattgtacctaagaaagttaacagtgattatctaagattaatgatattgagcccatattcaaatttccccagtttattccatgtctattatagttctttttccctaaacatattccactcaaggtttatgtactgcattatgttgtttttagtctcttaatctagaaaatctagaatttttaaaaaaatcccctgtgataagactttttgtcaagtccttgggagttttcatatagcatgtctcacattctgaacttgtctgaacttttctttaaggggttgtttgacttgttcctctatccttggtattccccgtgaactggaatttgggtctagagactcagttagatttagcataaacattcttgtggtgcgaattcttcctgagtgatggtgtgtaccttatatgacatcacctgggaagctcagcatggcagcttgccctacccttagggatgccaaatttgatgcttggttgagatggcaactgccagacttccattataaaggtactttttttctgtttgcagtaagtcagtcatctgtgggatgtgtggtattgtggtattgtgtgtgaatgtcctgtttcccaagtattatacttttcacccagtggttttagtccttcgttgataatctctgcctgaagcacttattcaggggttggaaaatggtagttttctaattctgtcatcccttctacatttattagccaaagccatttaaaaagacgttgacattctgtgacccacatgtcaatgtgagagtggtgctttgtgaggtgatcaggttagcaaaacagcttgataacctttttgtatgttttgggagcaagaaatgataaatgtggatccatcaggtttttttcctagtcttttttagtggggaaatgcaatttcttgtttatcacctaccaacccctcctatatcaggaggacatccttttttgatcaccaggtaccacatgcccttcgagttgcccagttggtggtgtgacatatgttaccatttgttcttccttatgtctctggcaaggccggggagttaaaacaagtgtaaaatggttgttattttagctttcttttgaagagtctttaaagctaacattaaactttcagacataaaatatgtagctcagtaaaagctctctttatagctgtacagtaataggcccttggatttttatcacagagaaaacctgacgtagacatataggttcttattacaaatctgataccattcataaaataaaacaatctttgaattaaagccagtccagcaaatcagtaaactccaggtttattttgtaaaatttattggccaacattttgccagtgtataggtaaggaagctgaacctcaggcaatcccatggcctggatttgaacctgtgtctctgaccactgagccctgtgctgtttgtgttagaccttgctgtagatagggacctggggaccaggagggagggcctccctgagtgtggggctgcatgagttgagctcaccttttggtttctttcctgggaatgctgagcccacatgtttttttcactcagctctctttaagaactgtgacctgatgtggaagcagagcatatggacatcgaccatctccagccatctggctaccaagcatctcaaggaaggaggcctcctgaccttggctggcgcaaaggctgccctggatgggactcctggtaagcctttatttccctatctgtggagtggggttgcttaccttgcttgctggggctgctgggcactttcatgggatgaggactgttaaagcctttaccctctaagctgcttaacagatagatggattttgtcttcttttgggcctgaatcattttagggagaagagttctgatcttttgtttgcctgtccttatgtttatggtggtggtaaggaacgctatgatctggtaacccccatttagtttatttatctgtgatctacactggaatgaatggtttagtggatattaattaattaataaacatggattattattatcacattgaatccatgtgttccagggaagcagcttagcagctggaaatagcataagtttaaaatgagagaggttcatttggccagcacagtggctcacacgtgtaatcccagcacttttgggaggctgaagcaggaggattgcttgagcccaggagttcaagaccagcctgggcaacatagtgagaccctatctctacattagaaaacaaaaagagagtgagagggttgggggtggattctttatcctagatgtgtgaccctgaaccagttcttcagtctctgaccagatgtctactgtagtttccttaattgtaaaatagtgacagtgacatctaacttgaagagtactgtaaaactgtagaggtgtagctatgtagaaagtgcacatggtaggcacccataaatggcaagtcttactgttattcacaataaatggtaggtcttatagtcactcttttcatttcacatatattctcactttaatctcatcaatattatctttttcagtttacaggttaggaaactaaaacttggagagttaagtaacttgtctgggtttgtgcaggaagtaagttgcagacttacttgaaccaaaaccctaatcatctaccaactgtgtattttttccattatgtcatttcttttgcattttttatgacctgtattagtttgtttgggtagccacagactgggtggcctaaacaacagagatttattttctcataactctggaggctaaaagtctggagatcaaggtatctgcagggctggctccttctgaatcctctttttttatagatggctgccttctccttttgtctgcatgtggtcttccctctgtgtgtctgtcctcgtttcctcctcttctaaggaaaccaggcatattggactagggcccatctcaatgggctcattttaactttgttgcctctttaaagatcttcgaatacagtcccattctgaggtactgggaattaggacttcaatatacgaatgttggggggatctatttcagcccataacactccctgtgggatagggctaaaggaatttaagcaggggtagaaaggggcagcatagggaggcagaaagtgtctacctcaactacctaagttgaactcttcttttaaaaaaatgggagcttttggccgggtgcagtggctcacacctgtaatcccagaactttgggaggccaaggcgggtggatcatgaggtggagattgagaccaccctggctaacacgatgaaaccctgtccctactaaaaatacaaaaaattagccaggcgtgatggtggctgaagcaggagaatggcgtgaacccaggaggtggagcttgcagtgagccgagatcgcgccactgcactccagcctgggcaacagagcaagactccctctcaaaagaaaaaaaaaaaaggtggggggagctctttttgactctcttgtaagtggtagagaccttgggacccttctcagttgtttatttttttagagacagggtctcacccaggctggaatgtagtggtatgatctagctcactgtagcttggaactcctgggctcaagcaatcctttgcctcggcctcctgagtagctgggactgcagacacacactgccatgcctggctaatttttgtattttttgtagaagcagggtctcgctatgatgcccaggctggtctcaaattcctggcttcaggtgatgctcctgccttggcctcccggagcactgagactactggcatgagccactacgccaggccccttctcaattttaatgtaactcactgaactgtgaggctgtgactactagcaataccttccctctcattttcttcttccatttcttagagcatgtgatgttacaagtccatggctatagcaatcattaaagctgtgtaaatgttagctgtctggttggttgagatctgatttttatttaagatgacacggaacagaggcagtagaaagtaaacagagaaatgagtcttagcttgacattttaaaaaacaaaaccctaggaccaaaagactgatttttctaaatgacagaagagtctcctactttcctttggtttgcaggtatcctttgattacattttgggtagtggttaagactgcaggctctggaactgtgcacgttggacttctcttaaggctctgccacttactgtgacacgttcggcaagttacttcgcctttctgagtctgcgttttgtcatctgtaaaataagataaaatagtgtctcctttatatatatggtggttgtaccttgtaaatgtctcaatggatctaaatggatgagaaaggtattacagagagtcaatagtaagtgtgagccattattattatttactccaggcttatttctgcccagctgttctgcctcagatgttaatgaatttgttcatctttaacctcttaagttagattttgttaagctattaataatttgagtcatgagatcttttaagtatgctgcagacctcagaaaaatctggggaaatagatctacaatttgaaagtaaatgatgaatcaggcttagtagtccctcaaactcaagaagatttgtttgcacatcagaagtttttcacttggaaggatactgagaaaacctcaccctcctatttccaagtttgtatttctagactgtcttctgtaggacaaacagtattaaaatggtgttcacttttgtttaccattaaaggatctgtgctgtgattggaaatcagttttgggggaccacactgatcattcagtaatttggaagtgttgaccttcttagtgaaatgtcttttttttcatatcttgcaaataaccccttttgtgtccccaaggaaaggtcattctttagaattaagccattacggttgctatttgcttgtttctttcctttgtcagagtccctgctcttgtgttgtgttgttcgaatggagtcaagagagagctctgggattttgaggaccagggctgggttaatgagcacttatgccctggtttattttaatcactgaagagtttgttatgccccctgattaaacagagaagctaaggatggcgaaatattcttcttgtgcttccaaatagctctttgagaccttgaccctcttttgcaatttgaggtagttgttgaagcagttttgtgattggtcccttggctgggctgtcatccccccacctcccgctggacttgcgatgcctccacagcaattacatcttaaacagtgtgtgtgccgaggattttagggagcctgatgacctctagaagaaatagtggttttcagaaggtggagaagtttacagtgactcatcattccttcttgctatcattattctgtgatagcagcatttagtgagcagctacagttgggcacagtgggggaacataaagaggaaagactccattcctgccacatgcctgcggggcagagggaaacctaccttaataaaagacatcccttgcttctgtcagcaaatatccatcgaatagtgggaggaaaggaagaccaataggtagcaggtatacacaatgtcaaaatttgctcaaatggtacaccctaaatgtgtttaagtttattgtgtttcagttatacctcaacagacttggcgaaaaagaaagaaatatttttaggcatctgtcttctgggtgcttggcttgttgggctaagcttgatcttatttcatcaccagaggtatctgtaaagtaggtcctattattttcccttgattatggaggaaaaaaagttcagtgattttaggtgccttgtctaagacaacctagctagttagtagcagattggtctgagtaatacattgatcagtaattaatatataattataatcagtaattatagcaattactgataatataattatatagagataatataattatattcagagcctcctccggcagcaagggtgcgggtggtgtgagtgtgagaccgggctacattacggtctaagcggagtgctcttggtgggggtgagtccacctctgaaaaggttttgttgagggagctgattcaaacagggtcttggaaaaggacttgctttgacaaatagagcttatgggaaaagacaaggcactgtattagtttttatttaaataatttaatcagtttttaaattggaaaactaaccaatgcatgtagtaaaaattcacatggcactaaaagaaacacaatgaataggaagactctctcctactcacaccgctgatctctatggcactccctcccaggcccaactacagtgatggcttctcaggtgtcctttgggaagcattctgtgcccattctagtgtgtgcccatgtcacattcacatactttttaaaaagcaccataatttggcagggcgcgatggctcatgcctgtaatcccagcactttgggaggccacagcgggtggttcacctgagttcgagaccagcctggccaacatggtcaaaccccatctctactaaaaaatacaaaaataaccagctgttgtggcagtcacctgtaatcccagctactcaggaggctgaggcaggagaatcgcttgaacctgggaggcggtggttgcagtgagccgagattgcgccactgcactccagtctgggtgacagagtgagactctgtctccaaacaaacaaacaaaaaaagaggctgaggtgggaggattgcttgagccctggaggtgaaggatgcagtgagctgagattgcaccattgcactctagcctgggcaacagagtaagcttgtctcaaaaaaaaaaaaagaaaagcaccataatttgatgactcgatagaggcttttccatgccttattcttttcacttcatcatagattaaataatttaaaagttagtttgtctggaatattgagaaactcacgagttactgagaatcacctaccatagttttaatgaacagagctaccagtttgttcttttttttttttttttttttttttttttttgagacagttttgcccttattgcccaggctggagtgcaatggcgcaatcttggctcaccgcaacgtctgactcctggttcaagcaattctgctgcctcagcctctggagcagctgggattacaggcatgcatcaccacccccagctaactttgtatttttagtagagacggagtttccccacgttggtcaggctggtcttgaacttctgacctcaggtgatccacctgccttggcctcccaaagtgctgggattacaggcgtgagccaccgcacctggccccagtttgttttttcattcccacagtttttgagtggccaccatttgattaagccccattatcctcctttgagaaacccacctattgctcttttctgaaagcagtgaataaagtatttatttatttatttatttatttattttccttttttttggagatatggtctggctctgtcacccaggctggagtgcagtggcgtgatcttggctcactgcagcctcgacctcccgggggctccagccgtctttccacctcagcctaccgggtagctgagactacaggcgctcgccatcacacctggctaatttctgtattttttgtggagacagggtttcaccatgttgcccaggctggtttcaaactcctgggctcaagagatccacttgccgcagcctcccaaagtgctaggattacaagcctgaactacctcacctggccaaataaagtatttattgattgccaccttttggtttgggatacattggtgaacaaaacaataaaaatccctgcctctgtggaacttacattcttctgggaatgaaagagccctttcgagtttatgagatgtgtcacgtttcatgtcgttttcaggaaagcctatttagcttagcattggatcccatttagcagggaagaaccagaggctgaaagagctgctcgcccaagtcacagtggtgaggaatcacctgggttccaacccctggcctcgaagtccagattctgggttctttctggtgtgctgtgccgttcctgggagccagggagctgccttgtgcttcttcgtctttctaacactgagcctagggattcccacatagaagaggctccatgacatggggtggggtaagtgggttttgatgcccgggagcaggcagaccctggcagcccctttccaggctctggctttacaggcagcagagtgatggcaggttggtttgatggtgttaaggccagagttgtcaccatccccgtcatgccacagtccttccactgctgataaggaaggaaatgccccggatgggccgcagatgactgcttgatctggagaggaatcatctatgataatatgaataatgatgagctgggagagtgggagaagcatcaccccctccctgccgcagtcactgggagaacatctccctggcaaggtgctgagcaaagcccctcctacaccaggctgggctccctccgccctgatcgggttctgtgcgtgccctccatggtttccaaggcccttgttggatgcagtctccttccatcctcagcagagccttgtgaataaattgtgatctgagttaccactcccactgacagatggaaaagcaggcccacagaacctgtgattttttttggtggctggaaaaacaggagttagggctgcactttttgaattccaagttgatgaccctttttgcaattccttattgctgtccgaggaaaaagagttgccagtgacctgctgagagtcatgaatgacaataatggccaggattgagtgttcctctgtgctcagtactgtacaaaggggatttgttaacctggaaaaaaaacaatcaatggagttttattacttgacataattaaggaggatgctggaagtattctccaaagcagcgtctctcccaggagggtttcatggggtgatggagaggggaaagggtgtgtcattgcatgtggaggaggggtcccagtggcacagatgcagtgagtcatcacgccagcacatagtcacatgttctggtgatgaagctgtagctcctcccgggtggagactgtagcatggtaatgaggaaagtccacttgggatcatctctataagttgctggtttcacctgacttggtgactgcattccatgcaagttgtgggaaaaaccaggctgaagggcaggagcctgtgaaacaggctgattgttcaagctgatgaaactcctatagtccttggagaccctccctgtctgctacacttgtacatggtattttatttgattgttgtattatccttaggatttgggattgtcattcccatttcacgaaatgggaaactgaggattccaaggtttagtagcctctcccagtgtcagtcactagcaagcagcagagcctggacacgaagccaggtagtcgggttccagggcacattacttctattgatttgatgggaaaccttcattgagtgcctgtcctgtgctaagggtatgctcacaattaagtactctattcctgtgtgtcgttatgagcccctctggatcacacctgagtttatactgataaggtgattagtaggttggggcccctagacagcctcaggatggagctacttcttagaatgaccaagcaattaggaggttagaactttcagctccacctaccgacctcctggaaggaagcaggggctggagattaagctctataaaaacttacagatgtgataagcatctgggttgaacacatggagggcactgggagggtggcgtggctggagcaggcgtggaagttccatgcccaccccctctcctaccctgcctctgtgtcattccacctggctgttcctgagttgtatcctttataataaaccagtaactataaaaaaagcgtttgcctgagttcttcgagccattctagcaaattattgcacctgaagagggggttgtgcaaacccctgattaagcttgttggtcagaagtctaagtggcccaggacttgtgactgccatctgaagtagggtaggtcttgtgagactgagcccttaaatcagacgggagtacagtgacgtgatcatagctaattgcagccttgacctcccccaggctcaagtgaacctcccacctcagcctcccgagtagccgggaccacaggcatgtaccagcaggcatggctaatttttgtagagatggggtcccactacgttgcccaggatggtcttggaactcttgggctcaagggattctcctgcctcagcctcccaaagtgctgggattaaaggcacgaggcaccacacctagctgggagttctaattgaattgtcagacacccagttggtgtctggagacttagagaattgactgtgttagaaaacacctcaaacccattttacagatgcagcaactgaggattagagaggttttgggaactttcccagaatttatttagtggtaagtggaggaactgggatttgaatgtgtgtaatttgactttaagtcctatactccaagtgactgcttgattttgctgtcccattgagtacctctgtgtgccaggtgctcacaagcatttagtgatcaaaaggttcagaacccatttcttgcctgggctttaacctctccatcagctttggcacaagtctgtgtgtgagcctggcatgtactcaacctgtcttgagtcttggtttcctaagaataaaaataagatcaaccttctggcttttgtaataaatgttaagtgttagatgaatagtaagtacacctgaaatgtcatgtctcctccacttttctctccataaatgttcatttatcttttcttcctggcctcttctggaccctggaatgctgcagcttggatgcaccggtggcctgtgtgaagcctgtgtgttcttggaaactggccagaggccataattcccaacccacgtgttcccatcccctctttctcgtggctctctgccattttttgatgggggttggtgagggcgtctgacctgaaggaggaggccagatgcagctatttataaagttttcagggaatagagatctcaagagaagattgcatgtccttgctgtccccctggccgccagtggtcactgagccatcttctccccatttcccaggtatgatcgggtacggcatggccaagggtgctgttcaccagctctgccagagcctggctgggaagaacagcggcatgccgcccggggcagccgccatcgctgtgctcccgtaagtgcttggggttccctggctgctgcccacctctgccccactgctgcaggtgaccgtttgtctgactgtagctttccacaggcgacctgggtgtgctctcacctctggttctgaaacacaccaaagtctcttaagatacttattatcttaatctgtttgaattgctctaacaaaataccttagactgggtgatttataaacagcagaaatgtattgctcacagttctggaggctgggaagtccaagatgaaggcaccagcagatttggtgcctggcgagggctcattcctcatagatggcgccttctatatgtgctcacacggtggaaggggcaaatgggctccctccagcttcctttataagcatgctaatcccctcctaaaggcccccacttgtctcctgcagaccccacctcttaatactattatgttgcagtttgtgttttgtatgtgagtttgagggggatacattcagaccatagcaatacttccagttttgggttctcctgggctgtccagaatgtttgattggctggttggatgggtctgtcttttttgcctctttttttcctctccctttcttttctcccttcatttcttcctttaaaattagactacacattttacttttttatatgtagttctgtctttcaagtcattatatggggtatgtatgtgtgagagagagagaatatgggaaactgttggaggtgtttctgttggtcatcgggggactgtcccccatcagctgtcccaggcagaggcagctgctttggagggaggctactccttctcgctggaaggcttccagcaccagcaggcttgcctcttgcctgtggtcctataaagggatgctgagactgtagggactgcactgattgactttctggttcccttttagttgtgaggttctgtgattctgtgacatgattcccacagctgttttgaatgattcgaatgattcctgaggccttgatgttcttgggagattcatgcatatctgaattctatattattctgccaaaaatcttaaggttttgtggaaaatagccacatatttaaaattttagtattttagtattctcatatttaaaggcatataactatcttaaatccttagaaatgagtgtgctgcatgttagggagtgaataaagacacagcaacaaagcagtttaattcagtgaagactcttttttaaaaaggcaaaatgtggctccttctgttttgttcttatctgcctaagtggtgagccacagcgcaccttattgaattatgctcagatctggcctttgctagcggggacagcttcctgctctctctctgcttatctttctgtctgatctttccatgtaaatagcaccctcagtgccagaggctctaggttgtcctgctgtatgtttgcgttttcctggccaagggggactgggcacctgttgttagaaaggagcgacatgaatgacgtgcttatctgtgtccattgcagggttaccctggataccccgatgaacaggaaatcaatgcctgaggctgacttcagctcctggacacccttagaattcctagttgagtgagtattacagacatgtccatgactgagcagcttccagcccctattctctgcctgctgtggtccagaggacaagtctgtgttccctgagatcgtcaatccgggtggtcttgggaggtctctgggactctgaggatgcattgcacatcagacggaatctcagagtagctggacttggagacaggcagcacagtggcagaatgggtagtgccgacatgaatcctggctcgctccctcaccaccggccatgctgagcacattattgacctgctgaggcctcagtttccccacctgtatcatgaggtccatcatgcttgttaggattaaacgtgatagtgtgcggcaagcactcaacacagtgtctggccataacaagtgctcagtgatccccagctgcagtttgtgtccttactgctgtgatgaggagactccatgggggagggggacaccacgtagatggcctgggggcacatatctgaatctgtgtcaagccacagacccacagaaagtgccctttaatttccgaaatcctttttgcccatttgtgaatatgggtggcatttgaacgctcatgggacagagagctgaattcctcttttgtgtttgtttaggtatcagttcctcaagcccctctagttagtaagcatgtgttcatcgagcacccactatgggccaggtgctgccctcggctctggggtcacggtgaggacaaagatgggatccctgcccacagggagcaggggtgccgagagggtcaaggtgacagcctgacccagtagtgcctctgtgtaaactgctttgacgactgtttataagagatgtttgtgaagttagcagtgtgcttctggcctgatgtcacaatctcatttaaattaaatcgggagaaatttgggacttgcgttttatgtttgaaacgtgtacttacagaacactttttatgtcccagtcaccattctaagcacttcataactcttatttaatgctcatagcaaactctgagggaggagctgtcatttttatttaaggcttagagacttggagggatggcaggggccaagtcactcgcctaaggtcacacagcacagccgggatctgacacaagtggtgtggctgcagaacctatggtcttaactggtgtgctgacagttatttctgtctatgccaggaatcatgcttcatgcttgatttgcaggaaaaaaattgaagttgtagatgaaatcaagctttgaattgtgtttgtgtttgaatttctttttaaaggccgacactcccaccacacttgagatactgatctaagacctactctagatggaacatctgggatcttgtgtctgaactcgtgctgagccacagacccacagaggacgggctgtcacaggcccccttttgttctagagatcacatccacccatttgtggtatttgaaaactctcagaaaagctggcataaagtttgctttgagatgtctgtgagcacatccttcctctaccatccctggttagaatggcgttctcactcacctatccacgctgcagatgagggtgaagaagtaaaaccatttaaaacatgcatcgcagcaaaccaacatggcacatgcatacctgtgtagcaaacctgcacgctgtgcacatgtagcctagatcttaaagtataaaaaaacaaaacaacaaaaaaacatgtgtaaccaacacacaaaaccctacacaaccaaacggcactggtctctttcagagccttccctcaccaagccctaccctgtccccagagatgaggccatgacatgacagtactttagagagttttagcaacgctttgttttttgagcccatgtgctcatatgagcttgttcaaaccccagagtaggggcctgaatgactggacctttacacatcagcgctggcccagaaggttacagattggcactgggagtctcccaggaaggaaatgctgagcactttttagttaatgaaggtccgaagtctcagctggtgaattgtcaaaatggatgatgtactcaaatgtaaatgttttgtgttaaagaattatcatctacttcttgtttcttgtgaatttcttttgccctttttcattcctgtcttcttagagggtctttttgactgctgcaagtggggtcagttgctcctctcctcagatttgtgaaaggccctgttactgtatttaacattttattgtaatagtctgtttttttctatctctttttccattgtttggtgcagctgtgggtactctataaatgtttgattaaaaaaatgccaaataaatgaattgcatctgtttctctcataaatttatgagaaggtaatatagcaaagtattgtgcatgtgtctctctctttgaatgaactaattaaaatctttaaaaacaattttttttttttttgagacagggtctcactgggtcacccaggctggagtgcagtgtcacgatcatggcttaccctagccttgatctccggggctcaagcaatcatcccaccacagcctcctgagtagctgggactacaggcatgtgccatgcccagctattttttgtatttttttagaggtagggtttcacccagttgcccaggctggtctcaaaaactcctgggctcaagtgatccacctgcctcagcctcccaaattgctgagattacaggtgtgagccaccacgcctggccaaattagaatcttttaaaatcacaaaagaattccaacaatgtagaaaaataccaaaatgaaagttaaacttatgccaaatcctgccactcagagattagaatgagtacaccactgaactcactgggggcctgggtatgtgtccatcatgcctactggcttttattaattttttattattttttggagatggaatcttgccattgtgtccaggctggcctcaaacacctgggctcaagcgatccgcccgccttggcatctcaaagtgctgggatcataggggtgagccataatgcctgacctttagtggcttttatttatttatttatttattattttttgtgagacggagtctcattgtgatgcccaggctggagtgcaatggtgcaacctcggcttacctctgcttcccgggtgcaagtgattctacttcctcagcctcctgagtagctaggattacaggcacgtgctaccacggccaatttttgtatttttagtagagatggggtttcatcatattggccaggctggtctcgaactcctgacctcaagcgatctgcccgcctcggcctcccaaagtgctgggatcacaggtgtgagccatggcgcccagcccttagtggcttttaaacagtcgctgctgtgccaccccttccccccaccccacaagccgtcactgtgaaggtcagcatgtgcccagatttttgctttgagaatataaaaaaaacttttattttctgttccagaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgttgatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactacatggactctgtcctggtatccttttcctgtgtggttgccccgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctgatgttctcagaagggggtggatttaaatcctgaaataaatatttcaacacaagaacacaggcctgattctgccttggacatgtcaaaatctgggggtgatgggatggccctgtgcatttagaagcagctctccacatatggccaatgtaggctgtcctggtcgagaactagtagtggtttaatccaacccgatcattttacagatgaggaaactgaggcccagagagacattaccttgttgccagtaactggcagagctaagcccagatctctagtcaccagacagttgctgtttttaaaggcctttaccacgtattttctttctttttttagtgaggtgaaattcacataattttttttttttttttttgagacagagtcttaccctgtcgcccaggctggagtgcagtggcgccatctcggttcactgcaagctccgcctcctgggttcacaccattctcctgcctcagcctcccgagtagctgggactacaggcgcccaccaccacacccggctaagtttttttgtatttttagtagagacggggtttcaccgtgttagccaggatggtcttgatctcctgaccttgtgatctgcccacctcggcctcccaaagtgctgggattacaggtgtgaaccactgcacccggccaaaattagccattttaaggctaattttaagtattaaaagttaagtaggtgagcagttcagtggcatttagcacatttacagtagtgcataatcaccacctctgtctagttcccaaacatttccatcaccccaaaagaaaaaccagagctctttaagcagttcctccccattcctgctccctaacccctgcaaccaccaatcttcattttgtttctgtgaattaattctgggtattactatttttttgagacagtcttgctcttacccaggctgaagtacagtggcatgaacatggctcactgcagcctcgatttcctgggctcaagcaatcttcccaccttggcctctcgaggagctgagactacaggcacgtgctgccacacccagatattttttaaagttttttgtagagacaggtcttgctatgttgcccgggctggtctcaaactcctggactcaagcagtcctcctgccttgtcttcccaaagtgctggtattacaggcgtgagccattgcacctggcctgttctgggtattttgtataaatggaatcagtatgtgaccttttgtatctggctgcttctacctagctttatgttttccatgttcttccccattgcatcatgtatcagtactttctttctttttgtggcataatattccattatatgtatccactgcaattttgtttactgatctgttgatagacatttgggctgtttccaccttttggctgttgtgagcattgccgctgtgaacattcatgtataagtgtttgtgtatctgttttcaatgattttggatatatacctaggagcaggattgttcgaccatatggtaatttttgtgtttatcttttttttttttttgagatggagtcttgctctgttgcccaggctggagtgcagtggtgcgatctcagcacactgtaacctctacctcccaggttcatgtgattctcctgcctcagcctcccgagtagctaggactacaggtgtccaccaccacacctggctattttttttttttttttttgtatttttagtagagatggaagagacagagtttcaccatgttggccaggcaggtttcaaactccagacctcaagtgatccacctgcctcggcctcccaaagtgcttagaattacagctgtgagccactgcgcctggcctctatgtttaacttttgagaagtctcttgattcttgccactacgaggtgattttatccaactattacaggaaagaaaatgggagctcagaaggttggactgcttgttcaaagtcacctagctagagagctgcgcagctggaactagtatacaagtctagctgttgaaagcaccctgagcacattacctcatgctgtaccttgcatgtcttgttgttttcaattt
